United States Patent 7,745,391 (HUMAN THROMBOSPONDIN POLYPEPTIDE) - sequence listing, part 206

SEQ ID NO: 495267 - DNA, 300 bp, Homo sapiens
gatgttttacacacatgagggggggggttcattaaaactgttttctaatttttccaaagttaatctataattaattacttccctatacaaacaaattaagatgttcagataattgaataaggccctttgggtccttgttcatttatatcgcgggccagcattataagcagggggaaacttttagcttggggttccatggccggtaaaaatttttcccataaagggaacaaaggtttagttttttttgtataggaaatttccctgcccctaaataaaacattttgaaatgaaacaaggtta

SEQ ID NO: 495268 - DNA, 448 bp, Homo sapiens
tcttaagtctatgttagtggcatctattgtgcattctagaaataaagaatttgggatatacccattatgttaatcaaagtcctagcaaacacatttcgcaaaagcattcattttgtcttcgttttcgtgggatgggcagcaggagagaatctacagcatttgcgtttagttaaccaatcataactccagcatagtgacataggcagttcacatagccggtcaatatgtgaggtatccatcagtgtgagacaaggtcccggtctgttcctattggcctagctgacgctaacaaaatgggaggcttatggctctgcagcgacaattccagcaggacaagatgactttaagcccatattcagagccctagaagcagggcactactgagtatgtaatatttagaggtgaaacttgtgcaagagcccataatggtgcccctctaccttctttg

SEQ ID NO: 495269 - DNA, 155 bp, Homo sapiens
atctgtagaacagatcttagtatctaatctccagtaggctatccacttgctcttcatttatatattcttgtcctttcattatgcatttggatttttttttcaataacttcctgaatatgacttcattatgaatctggctttctgctatgttaatt

SEQ ID NO: 495270 - DNA, 199 bp, Homo sapiens
  misc_feature (163)..(163): n is a, c, g, or t
  misc_feature (174)..(174): n is a, c, g, or t
aggttgtcgcgtgatctagaggatcccgagtaccacctgaaataccatcttcccttggtcactaccaccgatactggtcttcctcctaccttttgggctgttcctcttgtacagacttctcctgatccctcttgatgccatagctgtgggagcaccccagggnctcagttcctnttctctactaagaaggtctcagaat

SEQ ID NO: 495271 - DNA, 213 bp, Homo sapiens
  misc_feature (35)..(36): n is a, c, g, or t
ttttctttttcttctttcttcataattagacgccnnacgccaatagttttctattttcaaagttttttatttaacataaaaatcatattattcgactgggtgcagtggcccaggcctgtaatcccagcactttgggaggacaaggatggaggatcacttgagcccaggagttcaagaccagcctggccaatatagtgagaccctgtctcttca

SEQ ID NO: 495272 - DNA, 988 bp, Homo sapiens
gcttctcctgcttccccgccggcggggccgacatcatgagggaaattcgtgcacttgcaggccgggcagtgcggcaatcgaatcggaacgccaagttttggggaggtgatcatgacgatgagcacagtgcgatctgaccccacgggtacctaccacggggacatgcgagcttgcaagctggaatcgcatcaacgtgtactacaatgagtgccaccagagaggcaagtacgttgccccgtgccgtgcatcgtggaatctggagcccggcagccatggacatcctgttcgctcggggccctatcgggcagatcttccggccggacacacttcgtttacggtcagagtggtgctggtgaacaatctgggccaagggtcactacaacagaaggcgcgcagctggtggactcggtgctggatgtcgtgacgaaaggagtgctgagagctgtgaactgcctgcggggcttgccagcgtgacccaataccctgcggtaggggggactgggtctgcgatgggtaccctacctcatacagagagatccgagcggagtacccagagcaggatcatgagcaacgttaacgtgtgggtgcctacggcccacaagtgtcagacacagtggtggagccctacaatggccgccctgctcgagtccgaccagctcgtagcaagacacaagacgaagaccttactggagttgatgacgaagtctctacgagcattgcttcagaagcctaaaggtgagcaagaccaacctatggtgacctgaaccacctggtgttcgtgctaccatgagtggggcaccacctgctgcgcttccaggcatttcaatgctgacctggtagaaagttggctggaaacatggccggtatcaccggatggacttcgaattgcccgggtttgcccaattaactagcaggcaagacagcagacggcggataccggccgagatcaccagagattgtgtgcaagaactgtgggtctgaacccggt

SEQ ID NO: 495273 - DNA, 252 bp, Homo sapiens
ttcccctgatgtttgcctgctagggtctctggttgttttttctctttttttttttagagacagaggcagagtctcgctcctgtcgcccaggctggagtgcagtggtgtgatcttggctcactgcaacctccaccacccggtttcacgccattctcctgcctcagcctcccgagtagctgggactacaggcgtccgccaccatgcccggctaatttttggtatttttagtagagacagagtttcaccgtgtta

SEQ ID NO: 495274 - DNA, 157 bp, Homo sapiens
actgatgctcgcgaaggtagagaactactgctttataatgatcgtataataaagtctctgaaaaggccttgattcagaataagcaagaaaggttcagtgaattcactttgtgcttctggggctgggaaaaacctttctctgtaacccgacactagcc

SEQ ID NO: 495275 - DNA, 322 bp, Homo sapiens
  misc_feature (83)..(83): n is a, c, g, or t
  misc_feature (88)..(88): n is a, c, g, or t
  misc_feature (116)..(116): n is a, c, g, or t
  misc_feature (137)..(137): n is a, c, g, or t
  misc_feature (142)..(142): n is a, c, g, or t
  misc_feature (277)..(277): n is a, c, g, or t
  misc_feature (295)..(295): n is a, c, g, or t
  misc_feature (311)..(311): n is a, c, g, or t
ggcacgagaagaagttgctgggaagaaaagtttctctgctcaggagcgggagtacatccgccagggaaggaggccacggcagntaagnaccagatcttggcccaggaagagaactngaagtttgagaagaataatgnatatngggacaccgtgtacaccattgaggttccctttcacggcaagacgtttatcctgaagaccttcctgccctgtcctgcggactcagtggtaccaggaggtgatcctgcagcccgagagatggtgctgtgggacaggncagtgactgcctgccagntcctggcagcggagtngaaagacaaca

SEQ ID NO: 495276 - DNA, 837 bp, Homo sapiens
ccctttgttcccggtttggaatatgccccccgccccccttccccaatattgtcttttcctccgcccgtccccggttgttttcctcccttgtctggtgacgagcatattcaatttccgtgtagcgcggcgcgtcaggcgtccgggtagcccccctttttttcttatcaagaaatcggccggccaccccgtcgttttatatgaggggggagtgagggcgcgcggcgcccacacatcgcagcctcatctcctcgtggtgggactataaaggggaatatgattatccctccggcaccaccaacatcgggggcactgggtatgaccatgttatccgggaacagccctcggcccccctcgtgggggagatctatggttgtgagtaaaagaagaccaaaactatattatggggccgacactctctcttggtgtggccgtagagagaacaaagaagacacacatcacatttgttgcgctcacatacgcatctcctcgcggcgagagataaagaagcggccgagtccatattgtgtcttctagtactccgccacatagcgccccgccagaccaggggtgtttgcccacaaacctgccgccaggagttatctgtgagagatagaatgtggtaaaaggttcaggtaataacgcaagaacactactctatttcggagacaacattctgggtcctcggacccgagttcggtggttcttaagtcgatgcggcgcctccccgcgcaggctgtttctttcacgggcggcggaaaagcgaactacgggctccaaaagggttaatggtgaaacaccccttcaaaaagttgatttccccggcagaaaaagacaaga

SEQ ID NO: 495277 - DNA, 122 bp, Homo sapiens
aaaaaaaaaatttgaaaaaaaatttggtttttccaaaatttgctttgaggggggggggggtttattaaaaaaggcaatttcggggattttgggggggaaaaaaaagccttgggccctttcca

SEQ ID NO: 495278 - DNA, 167 bp, Homo sapiens
  misc_feature (135)..(135): n is a, c, g, or t
ggaccacctctttgcctcatcttcttgtcaaaaacataaaacattcacatctcatttctgagtgccgatcatctttatcatgagagaagcaccggtacagacttctgaataattctgattggtcctcccaaaatnatttgagctgaatcagcttttttgcttgataa

SEQ ID NO: 495279 - DNA, 323 bp, Homo sapiens
agggaagatgatcgagttgggttggtaaggttaattcgtgtggtttgtgtgcagctagctgatatagtagccggattattactaaagggtcacagattgtgtgtatagatatgttggttgtggtgcacgagttgttcttcgtaggtataagagtcgtcatgatatgtattaaagcttggggtcctctgactagtcccgcatgactgagctcgctttctatggtcgccataggctcacagtttgacaggcagtctgtcgtaatcagccaagaatttaacatttgttttgttgagcaaggcaaccatcttctgcagccccaccag

SEQ ID NO: 495280 - DNA, 211 bp, Homo sapiens
ctccagggttttcttggggtgttttctctgatcacaacttttttgctacctggttttcattattttcccccaattcttttgaaaaatgggaatcttttttgaggtttagcgttttaagccctacgatggggtcattatttcatgactggggggttcctaaactctgaaatcagccttgcccaaggacttgagaataaatgagcctttttta

SEQ ID NO: 495281 - DNA, 877 bp, Homo sapiens
  misc_feature (1)..(1): n is a, c, g, or t
  misc_feature (21)..(21): n is a, c, g, or t
  misc_feature (212)..(215): n is a, c, g, or t
  misc_feature (224)..(224): n is a, c, g, or t
  misc_feature (226)..(227): n is a, c, g, or t
  misc_feature (232)..(233): n is a, c, g, or t
  misc_feature (242)..(243): n is a, c, g, or t
  misc_feature (246)..(246): n is a, c, g, or t
  misc_feature (248)..(248): n is a, c, g, or t
  misc_feature (250)..(250): n is a, c, g, or t
  misc_feature (255)..(257): n is a, c, g, or t
  misc_feature (264)..(265): n is a, c, g, or t
  misc_feature (268)..(268): n is a, c, g, or t
  misc_feature (284)..(284): n is a, c, g, or t
  misc_feature (287)..(287): n is a, c, g, or t
  misc_feature (290)..(290): n is a, c, g, or t
  misc_feature (303)..(303): n is a, c, g, or t
nctgactgtaataactgcggncctaaatggtctgcacagtcttacacaaaagcccaatacagtacatgaactatcggaaaagcagaactgctctaacaaggaagaggtgggagatctgagtcctggccccagcacccacttcaacttcagtcacctccttggaatctggggttctgcagcttgaaataatcagtttggattttaaacttatnnnnaacataatncnnctccnnggaactttnnaanantnttttnnnctaaatnntanaattattataataagnganctnataaaacagtctnttcctgaaaaacaaaaaaaaaatggcctttgttggtctgaccgggggagactattgcccccgctatacatgcagtgagggtgcactcctgaaccccgccaattgacttgccgtgtctccttccaccgttgagacgagcagtctagctacatcctacgccgccctaatcccatttttccaattccagggccacccgacgccccactgcggatacccaaggtccggcctgtctctgacctgctgcgccgcccgcgaccacctatgtcctgtaactctcactccccaatatctttaccatctcacgaacgtactaagaagcaccacgccccacactccaacacaaaccctttccgccgcttgcaccgctcttacacgatcccagatgaaaaatccgcacgccccccacacatactatactaccgctccattttatccactctcctgcttccggctgatcactcaatagcatgtccgagccgtcgtcacccccggtacacctaacgatacactgatcttcacccagacccctcctcctgctgcgcttcccagacgcgccagagtaaacataacggcct

SEQ ID NO: 495282 - DNA, 238 bp, Homo sapiens
gccgcggagaagaggaagagacaggacaaatgcaacgaggaagaagagagggaaaaagagagagaggaagagagcaagagaaggaaaagaaagagagagagaaaggaaagagaagaaggaagaagagggaaacaagagagagaaggagagagagagaaagaggaaaaagaaacacagcaaagaaaagaaagagaagaaaacgaaagagaaaaacaaaacacaacaaacacacaaaagg

SEQ ID NO: 495283 - DNA, 496 bp, Homo sapiens
  misc_feature (28)..(28): n is a, c, g, or t
  misc_feature (40)..(40): n is a, c, g, or t
  misc_feature (65)..(65): n is a, c, g, or t
  misc_feature (75)..(75): n is a, c, g, or t
  misc_feature (90)..(90): n is a, c, g, or t
  misc_feature (134)..(134): n is a, c, g, or t
  misc_feature (145)..(145): n is a, c, g, or t
agacataaaggaacgactgaacctctgnctggactgtganctgatgaactccagaagtacctatncttactgtgnactttaaagtttganggaagagaaagctgtaggaatccataaattcctaccaggaaatnccagggatctnccaattcctagacactgagaaatgggacacccagtggttccaagaacactttctgggactaacatagtcctcacacagggactgaggaaagaaagtgtctcctttcctgggaaagcacatgtaaaagttaagggcctgaatctcttctaaaccaataattgacctctagggcacccaccataatactgctaccttcagggcagaagacactgctctttgtaacccagccaccaccaaaaagcaaacagaaagaaggaaggatggttaagccattggataatactgaatctgtttccctaaggtgacttaaccttagagcaagacaacatccagggtaattttttgtagatt

SEQ ID NO: 495284 - DNA, 914 bp, Homo sapiens
tcttgttgtcatttataactattgaaccctttgctatgctcctgtgtcattgcattataagtcacagtgaaatgaatgtgtttcatgcatgtgatgatgattgagtaataattcctcccagaagagctgtgtacatacaaattaccattgagggctgatgtacgaaaggactcaatgacgacgcaaatggggcgacactaacgggaaagtactgagcttttgtagagaatttacctgacagacttgattaatgtacagctattttatctcgtgattttaagcatgccattaacactatgatctcatttcattaacgtatttgcatcatagtcgagtgatgctgaagtatggcggcttcattttatctgttgtcgcgcaaactgtcaatttagctatttctgtcagtaataattttgctaacgacgctagtattgtacactaaaagggcagttaggcttcattctcgtaggccactacttatgtttacccaatggttgactaaacgcatagatagtaaccacatcatgaccatgataactatagtgcgcgtatgtagtacgctgtacttggagagacactttatttattaaacaatgtttaggactaatatgacgactggtatgtcaacagtcattatctccctgatgtatagaaggcatcatacgtaggccacaatatctttagaacaacttcacccctctaaacgcgtcagaattaggcaactaaatctcagagtgctttgaccgtttatacatcgtcaggagacgttaggcttacagattctacgcacggttataccatgttaaatgagattaaatattctgcttagcccccatgtttaccacagcaataggcacctctcttcaacgcagaaccccacgatgacagcattcgtagacaagagagtacttcac

SEQ ID NO: 495285 - DNA, 593 bp, Homo sapiens
  misc_feature (221)..(221): n is a, c, g, or t
  misc_feature (232)..(232): n is a, c, g, or t
  misc_feature (259)..(259): n is a, c, g, or t
  misc_feature (271)..(271): n is a, c, g, or t
  misc_feature (281)..(281): n is a, c, g, or t
  misc_feature (289)..(289): n is a, c, g, or t
  misc_feature (299)..(300): n is a, c, g, or t
  misc_feature (303)..(303): n is a, c, g, or t
  misc_feature (305)..(305): n is a, c, g, or t
  misc_feature (312)..(312): n is a, c, g, or t
  misc_feature (315)..(315): n is a, c, g, or t
  misc_feature (317)..(317): n is a, c, g, or t
  misc_feature (327)..(327): n is a, c, g, or t
  misc_feature (338)..(338): n is a, c, g, or t
  misc_feature (358)..(358): n is a, c, g, or t
  misc_feature (360)..(360): n is a, c, g, or t
  misc_feature (362)..(363): n is a, c, g, or t
  misc_feature (366)..(366): n is a, c, g, or t
  misc_feature (371)..(371): n is a, c, g, or t
  misc_feature (375)..(376): n is a, c, g, or t
  misc_feature (379)..(379): n is a, c, g, or t
  misc_feature (383)..(384): n is a, c, g, or t
  misc_feature (391)..(391): n is a, c, g, or t
  misc_feature (396)..(396): n is a, c, g, or t
  misc_feature (420)..(420): n is a, c, g, or t
tttttttttttacaagactagttccaaaataaaaaggttaaaaaaaaattggtctaaatttaataattagtatagggatatgacctaataaatgtctccttacctaaagattcattggcttcctttaaaaaggggagggcaaacttagtagcttttcggaaccaagctaaggtctcggtccccaaaataggcggccctaaaagagttgttagcagggaganaaataaaagtnaatgtgctcctggtgtatatggcagtnaatctcctttcngttctacttnagcatacnatatatattnnacngngtacatnctnangcaattttangtatacactcngcaataattagaaaaaaggngngnnganaaggnattnnacnaggnnggattcnactcngtgggggccttcgatggaactcanggtggagctcagcctttccaatgagctctaagcatgtagatagcctgagctgtgtctaagcctggtgtttaaagatgggtatttctcatacaatatgggccctaaatccaaccatctacacatttttatctggtgtacaaaccaaagcacaatggtcttctcaaccattgggg

SEQ ID NO: 495286 - DNA, 822 bp, Homo sapiens
  misc_feature (404)..(404): n is a, c, g, or t
  misc_feature (555)..(555): n is a, c, g, or t
tggccggagtcaaagcgggtgctgctagcggaggcgccatatgggaggggacaaaactccggcgaaagcgagtgacacaaataaacccctggacccccttgttccctcagctctaagggccgcgatgtggtacctagaagactactcgggaattgattggagcagctccctagtggattctgcgggaccgctctcagggaaagtgcgcgagatgtggacctgccaggtgcagatgttgcagggattcacctagaacaaagagtcagctgaaatctttagtgacttgcaagaaaaataaaccctgagtgggagggaagacgcaattgggcttccatcaaaaaagaactactataaagccttgcgaagatggcgatgagacggtccagttggcaacccagattatntgacttggcagcctcttctaaaagattgaaaaccccaagaagatagatagactatcactatttctcatatgatgccatggtggggccttttccattggaaacatcttctcctagattattaccgttttaggaaaattagtcatctcctggntgcggcgttaaggtagagttaacgcggaaaaacacgttgctcacctgtggtgggcaagccttcaggggtatagatatccactacttattggtggtccttcccctggcgtcgccagcatttctttaccggaaccaaacgtccgtgtcagctcacaaacggcctctgtgggcggggccggccccaccagctgaggggtggcccccctttttggtgtgcgttggactgcttttcccccaaccgtgtacactgtgtccgttcagccctgac

SEQ ID NO: 495287 - DNA, 166 bp, Homo sapiens
  misc_feature (3)..(3): n is a, c, g, or t
tgnaacattcgtgtctatcataacattccatacatacttaaaaccaagcaaagggtggagttccatctttaaaaactaaacggcatttgggacaacacattcttggcaatagaacctggacacctacagactcgtgcccaactgagcggacggacacgaatgttca

SEQ ID NO: 495288 - DNA, 157 bp, Homo sapiens
atactttaccagtcctactcttccagctccccatttatatcctatgctcctgctactgatatacacccactatggtgcacttgcttatgggatgaggaacctccagggcttccaggaaagatacatttctaaatatcagtgctggccattgaggaag

SEQ ID NO: 495289 - DNA, 535 bp, Homo sapiens
  misc_feature (2)..(2): n is a, c, g, or t
cntggtggcctggtttgtgctcagatttcaaaattcaaggtcgtgacatgtgaacgaagaactagcttggacctagaataaaagctaagtgcttgacacatgcttatgtttgagatggaacttgttcttgtcctgaagggtagggtaggagcaggtgtatatgatctagcagttgctacatttccttagagaacaagacacaaataatccacaggatagaacaaagtatcatctcagcgttataaattcattccatttagagtttatactaaaagaagaaatcttggtcaacagtactagtcactgcttcctctttatgatcacacaaagctatgtccggtatttttattaagcaaatgcatcaattaatggaccatactagttttggtaatatgaaaacagttaaagatatcaatgagtgaaaaaatggtatcataagaaaaccaagccgggcacagtggctcacatctgtaaccccagcactttcagaggttgaggtaggtggatcattttgaggtcaggagttcaagaccag

SEQ ID NO: 495290 - DNA, 551 bp, Homo sapiens
gaatcagtcggtacctgacagtgaaatgaacacatgccatattatgctggtgcccagacaagtgagtaggtgtctacagtgttcccaaggagtggcttatcttcacagcatgcaaccaagagcgctcatttcacagggacctgaagaccagcaaagtaagttataataatgtgacacccctcagcctcttcctccttctctctcagtctcaccaccccgaagcccactctctagttctagctactcgggaggctgagccaggagaatcgtcttgaactcaggaggtggagtttagagggagccaagatcggcatcactgcgctccagcctggcgacaaagtgagagtccgtctcaaaaaatggaaagaacaaagaaagtacaagatcacaagcaggactgatggagcatatggatatgtagaaaaatacccagtcacgtgttctgatagtgctggcattcacattgtgtcttttgtgatatgcaatacgagtcgtgtcagtttgtgcctcacttgcgcagcgctgcatggtgctgaagcattgccatatta

SEQ ID NO: 495291 - DNA, 892 bp, Homo sapiens
  misc_feature (1)..(1): n is a, c, g, or t
  misc_feature (61)..(61): n is a, c, g, or t
  misc_feature (90)..(90): n is a, c, g, or t
  misc_feature (109)..(109): n is a, c, g, or t
  misc_feature (136)..(136): n is a, c, g, or t
  misc_feature (139)..(139): n is a, c, g, or t
  misc_feature (148)..(148): n is a, c, g, or t
  misc_feature (155)..(155): n is a, c, g, or t
  misc_feature (172)..(172): n is a, c, g, or t
  misc_feature (190)..(190): n is a, c, g, or t
  misc_feature (197)..(197): n is a, c, g, or t
  misc_feature (226)..(226): n is a, c, g, or t
  misc_feature (238)..(238): n is a, c, g, or t
  misc_feature (242)..(242): n is a, c, g, or t
  misc_feature (262)..(262): n is a, c, g, or t
  misc_feature (266)..(266): n is a, c, g, or t
  misc_feature (274)..(274): n is a, c, g, or t
  misc_feature (291)..(291): n is a, c, g, or t
  misc_feature (306)..(306): n is a, c, g, or t
  misc_feature (308)..(308): n is a, c, g, or t
  misc_feature (324)..(324): n is a, c, g, or t
  misc_feature (404)..(404): n is a, c, g, or t
  misc_feature (406)..(406): n is a, c, g, or t
  misc_feature (437)..(438): n is a, c, g, or t
  misc_feature (453)..(453): n is a, c, g, or t
  misc_feature (458)..(458): n is a, c, g, or t
  misc_feature (460)..(462): n is a, c, g, or t
  misc_feature (467)..(467): n is a, c, g, or t
  misc_feature (483)..(483): n is a, c, g, or t
  misc_feature (487)..(487): n is a, c, g, or t
  misc_feature (515)..(515): n is a, c, g, or t
  misc_feature (517)..(517): n is a, c, g, or t
  misc_feature (522)..(522): n is a, c, g, or t
  misc_feature (524)..(524): n is a, c, g, or t
  misc_feature (544)..(545): n is a, c, g, or t
  misc_feature (555)..(557): n is a, c, g, or t
  misc_feature (587)..(587): n is a, c, g, or t
  misc_feature (589)..(589): n is a, c, g, or t
  misc_feature (595)..(596): n is a, c, g, or t
  misc_feature (603)..(603): n is a, c, g, or t
  misc_feature (607)..(607): n is a, c, g, or t
  misc_feature (619)..(619): n is a, c, g, or t
  misc_feature (627)..(627): n is a, c, g, or t
  misc_feature (629)..(629): n is a, c, g, or t
  misc_feature (641)..(641): n is a, c, g, or t
  misc_feature (736)..(736): n is a, c, g, or t
  misc_feature (741)..(741): n is a, c, g, or t
  misc_feature (878)..(878): n is a, c, g, or t
ngaggaatagtcgggaggtgctgtgagggatacaccgcccggggcagcgacacagaaagcnttgggggggtctagagatggatggaagtnagggaagggccggggcaangaaggaggcggagaggcaactgtagcntcntccccaganttcagtntcgtggaaaaaaggctntttggtcaaaaaagcaangaatgcnggggagagcagaaacgaagcccttgaaangcccggccaggnatcntgcccctacaccggcacgcntttntttcgggnacgcccggagccgcggngccgcacgggtttcntngggggatttgggcggnggcgacctttcggagcgcggggaagcgggcagccgcgctcgctctgcgtatccgaggactcgtcgatgaaggccaggttntngctgggataatccagggccgaggccgtgggnngggaaggcggctganctttntnnnggggngaaggggatcggggcntgcncagcggctgcgctggaaagggcgtggangnagcantngctgctccttctccggcggnngggaggcggnnncggttcgctgggtcacgcgcgctgtcactntnccagtnnaactggnagcntgatctgtgatntgcccatntnttctcgatttcngtgggacactactcgcagccagttcccgatggtggtgagcactgaggcgaagtaagccaggccgagcaggatccagaaccacaccagcggctganaggcnggggagtcctgcctgggggtccgcgccggccacatagtcgccaaagcccacggtggtaagcgtcactatgacaaagtagatggcctccagcttgctttagtcctccatatagcagaacacgaacgtgggcgtgaggncaaagagcaggcag

SEQ ID NO: 495292 - DNA, 493 bp, Homo sapiens
  misc_feature (40)..(40): n is a, c, g, or t
  misc_feature (113)..(114): n is a, c, g, or t
  misc_feature (121)..(122): n is a, c, g, or t
  misc_feature (135)..(135): n is a, c, g, or t
  misc_feature (140)..(140): n is a, c, g, or t
gcccccgggcgccacctctgtacacttccctgacccttcncaggtgtgggtcactgccacctgtgcccatgggcaccccagagcacccactgtgaccactcagtgttcctttnntcccttnnccaaagttagggnccccncccaccagggcactggcctgtgaccttcgcaggggtcccggcccctcccaccactctagcctttctcaggctgcaccaaagattccatcatcagggccaactgagagtgagggagtctcacccaccgcttaccccagccctcccctgggagcagagagagaaaccctcttcatggaccagactctgcacccggtgagtgaggacagtcccagctgagtcccatcgatgttgaatctcatgccactgcaagtgccattcaccactgcgtcctgggctttacgagaccatgcaagacgggggttagtgaggaaggaggatttggggtgggggtggggtgattgaaaattagtata

SEQ ID NO: 495293 - DNA, 207 bp, Homo sapiens
gcaggcagtagcaagacagcagacttaaacatcagctagatggtaacatgcattgtcagctctcttgaagacatgggaaacctaagttacaccttgggttaaattcttcaccatattggtctgctgctcataaatttacctagcagtggtctgctgcctcaatccagcagtcttgaccattggagcattcatggttaactggtcaag

SEQ ID NO: 495294 - DNA, 107 bp, Homo sapiens
cgacacctaagcctgccaaggatgcgtgtcaggaggggtcggggagaaatcaggctctcgaagctcataaaattcaacgtgagggagcaagtacaagtacgcccgaa

SEQ ID NO: 495295 - DNA, 518 bp, Homo sapiens
  misc_feature (279)..(279): n is a, c, g, or t
  misc_feature (289)..(289): n is a, c, g, or t
  misc_feature (297)..(297): n is a, c, g, or t
  misc_feature (342)..(342): n is a, c, g, or t
tcggatgcagaggtcgtaggtacgttttatattatataaggacagaccaaaaatcaacctatcaaagcttcaaaaacttggggaaagggtgggattaagtacaagcacattgggcttacagtaaatgaactgatttttattaactggctttggcccattataaaaggctgcatatttactgggaaaccatagccgagcttcacggattatgcactaacagtaccagtattataatggccagcaatataatgctgcagcgcaagtcgtggtatgtctctngacgaagtgntgtctcanaaaataatatacttttacattaacagaaatttaatgtttctctgngcgtgggggctctgggctttcagagttgggttaatcagtgtggattctagatgatcaacataatggaccactcctgaatgagacttaatttggtctttcaaatttactgtcttaaatcagtttattaaatctgaattttaaaacatgctgtttatgacacaatgacacttggcatc

SEQ ID NO: 495296 - DNA, 883 bp, Homo sapiens
gccctggtgtgattccgtcctgcgcggttgttctctggagcagcgttcttttatctccgttcctgctcattctctcgctacctatagctgcagtgtcgctgtcatccgcgattgtgaacgcattcgatgtgacgatgtgaccatgaaggcctcccgtgcagtggccctagtaactgatctttgtcggattgatgacactagaggcctgacagaagattacttcactgtgtaatggctggcactcagatgagtggcagatacatggatgccagcacgatgtgtaactcttctttcatagtaaagcgaggtacacggtatccacgggagtgacctgcgctggcaaacacgggagtagatgtttgcctcgattggatgtagacatgacactgagtggcacactgcatacttcaccgcagagggccgaggattccaccattattagaaaccgtgaaagcgaccgttgtggcaaaaccgttgtttgcacacaaagtagttcattgcttagaagggcctacaaccgggatgtctcccccttctgttggggaggcattgtgtagagaagtagaatgaaaccaaaaccaaggattggcttcctttgaccggatttcgagcgctcgtggggatctccgaggggtcccacgatgccacttatttacggtggggaagccacggcgacctttttcatgcttcagccatggttagtgaaagtgcagacggcattggcgaagtaagcttccaagtacaagaacttgacacggaagagtacgtggcagaggacctgttggtaaaaacctccttctaatacggtcatttatttccttggcgaccaaactggccgtggtaccttggcccctcgtgagcaagcggttgccggtaagaccca

SEQ ID NO: 495297 - DNA, 101 bp, Homo sapiens
actcatcctggacttcagcttcatgtggtctctcgggtggtcttccatccttccgcgacttccagaggtaccatccttccgatattcaccttcttgcgatt

SEQ ID NO: 495298 - DNA, 141 bp, Homo sapiens
cttatgtgctcctcttcagcattcacagcacagtccgggacgtaggtatttcttaatgccaatgctgattgttgaacccacttattccaaaaagcccctctttcccaaggttggattttggcccaaggtttaaagttcttc

SEQ ID NO: 495299 - DNA, 202 bp, Homo sapiens
attgtagcgttctcagctcctctcggatgaactgatccgtcaccgtgtccatgtagcacggactacatcgaagtgataggagacgtcgaatggtcgtcgcgcacgggggcgtgcgatcggccgaggtatctagatgtcaccaaagccgcgggcccgccccccggcgggccggagaggggctggaaccgggttggttttgaga

SEQ ID NO: 495300 - DNA, 972 bp, Homo sapiens
tggatacattaggtatggtctggagctatgatatcaagttggtcttcctagtgggttgtatcgtctgtgagcgacgaccgatgatatttacgagataggagatagacgatagaacgaccacgtagacattattgtcactcgtccgtgctacccatgaatctatcgactatcccctatcggccgtcaaaggtatttagcggaactcgcccacactccatcgggaagcaatatgaagatgatcatgctgctagtgactctgagcccatagagatctcatctattcattttacagctcgtaaggtggtcctgactgtgcatcgtattaggcaaactcatcactagacatcgtagtacacgatgacgtagtaccgctgaaggttcatcattcgcactatgtcgctaatcgatacaggagcgtagtattgtgccattctatgaggaggctttcattcagctggaatttccccttattctcatggctatacctctaagacctacacagcttaagcgccaagaattccaatttcatctatgcattatttacatgtcggcgttcattcgtaactttgacttccgaaaacaattttctcggacctagtccgagaactggcaccgatcgatgactcggaactaccccgattgcatacaatcatatgagagaatctctattcattctcgtcaggctcattacatttcttctaacagtcggtaatattggattctttttcatgattcgaggaaagcccttcgctgtacgaatgagaaagagtccttaatagtacgaccaagaaacgcactctggatagaaaccatggaagttcgaacgtagaattggaatgtggcaccaggcaaactttgaacaagagcattacgaatgggaccccggtattactttaaacatcgtaagagcaacttgtggacaccaaattgaacgcaacattatacccgcttgttggagcgacttgcaacggg

SEQ ID NO: 495301 - DNA, 120 bp, Homo sapiens
agctcggtaccccttcgcgaatcccacatttaagcgaaaatcacgcgttttctcttcgagaatcccccatttaacacaaatatcacgcgttttctcttcgcaaatcccccatttaacccg

SEQ ID NO: 495302 - DNA, 1069 bp, Homo sapiens
atgtgaccgagtaccatcgaagctttcgtatggacatactaatatagtctgctcacaccttacatatttcatgcgctactatgtgtagaaggattaatagctgagtacgctggttcgaattcaatatgctactcgtcgagtatatccctgcaatgacctcgacgttccgcattcttatgcctagtgatttgttgcccgtactctgcccaatactgagtttcctcctaggctcgcctggctgatgccaatcctgggatggggacctcatgcccgttacataagatcttgcaaatctcgcaacaccgattatgggcccgtgagaactgatccgttccatacacccgtaagagcgcattatcgtcgcacattggcctcaaagaaactacatgcgctccgcgaagcaaatgtatatctactgatccacctgtggcatgacatttctcaagagagaatgagcataactccggaatcagacacaaccaacgccactagtgctaagttaatgaggattgattgcccttctatttattctgtaagatcgcacaaagtcaataaatgagagcgcataaattgtgaaggctcgctatgccccgaattgctgtctctaccttctggactcccacgtaacgaatacactacctcgcgtagatatctgatctacgctgagtcgtagccgtccacaatcgatgggcaagccatgtggtcactgtatccacgtagaagactagccatcatggtagggggcaagacttctaaccggctcgtaatagcgtaagtcatcccataccaatatgtcgtgtatctcatcacgatattaccaagtcagaagaacataaatcagtattggtgaaatggcgacactgaagcctgaaactgcaagcttgtggatgcaccctgggaccttggcgccagctgattgttggccccaagaccctttcgtggacttcttgctggcacaaggctggtggggcgctggagcctgcatgtgtatagaacacgccgatcccgcagcgaggatccccttggcggcgaacaggccactgtctcgaagacatgccatgagcactcg

SEQ ID NO: 495303 - DNA, 651 bp, Homo sapiens
ggctccctgtgacgggaagtggagggccgctgaataagcttccagaaatgatgcccacaccagtgtatcctattgaaagaggggactgatatgctcccaacgcatcccccagcttgtgagtaacatcagtgcctgccagtgattgctgaggctgtaagaactaccctgggtccccgtggcatgcacaagcttattgtagatggcaacgaggcaaaagcaacaatttctaatgatggggccacaattctgaacacttcttgactgttgtccatcctgcagccaccagactttggtagacattcgccaacatcccaagatcggctgacgtgggtgatggcaccatcctcagctgacctatggcatggacgtagcagagtttctgaaggctaggtgaaaccctatgtggaggaaggtttacagcctcacagatcatcattgcgatactttgcgcgcagccgtgcacccagatgtcaggttagggcaagatccaaaggagattagctgtgaccgggaagaaggcagagtaaagtggagcagaggaagctgctggaaaagtgtgccatgaccggtctgagctccaagctgatctcccaaagagaagctttctttgctagatggtggtggatgccggattgactgctcgatgctttg

SEQ ID NO: 495304 - DNA, 491 bp, Homo sapiens
ttctagaggatcctcggctgtgctgtgctctcatgcttgtaggacaggtgctgtgcattcgtgactgtgcctttccatggctgtgctggggtagggctgggcagagctgctttggaccttccgcctgtcctggcatcgtgcccttacttgagatatgatcacctgtgcccccgcccccaccccctggccatatggtgggacagcaagagccctacaatgactatgatctaatgaatgtcaccagcgccaggcttctcactcctcctggccaccgagccccctggaacccatggccagtgtagagcagctacagcttgtctggtttcaggtccacctcagggtgccaggtcccgtctccagcacacccctggaaagaaactgctgcaaaggcctactgaagcctgactgtggtgtttactgtcactctgcagctcaggcctcacatttcactgtagtgactcatatcccataatcggtagtcattagcaaaa

SEQ ID NO: 495305 - DNA, 515 bp, Homo sapiens
  misc_feature (22)..(22): n is a, c, g, or t
  misc_feature (28)..(28): n is a, c, g, or t
  misc_feature (199)..(199): n is a, c, g, or t
  misc_feature (497)..(497): n is a, c, g, or t
  misc_feature (513)..(513): n is a, c, g, or t
taagtccagtagagaaatggancctaanggaaaaattccctagatgaaaattaccaacatcctgatgaaaaatttgccctagatgagtttaaatagtaggatccagatgcctgtaaaaaaaaaataaagacctagtgaaacatgcagtccagggcaaatagaaaagtattccaagtgaggctgggtaccagtggctcanaccctgtaaccccccaacactttggaagactgaggttggaggatccccttgaactcaggagttcaagacccagccctgggcaacatggtgagacctcatctccactaaaataaaaaagaaattagcccaggcgtggggtatgtgcccatagtcccagttatttgggaagctgaggcaggaggatcacttgagcccaggaggtagaggctgtcgtgagctatgattatgccactgtattccagcctgggcaacagaacgagtgagaccctgtctaaaataaaataaaaagtacccaaantgaagcacagaccggncc

SEQ ID NO: 495306 - DNA, 574 bp, Homo sapiens
taccgatcgcttagctcagtgatcctcgctgctggagtgtttctgcttgagcgcatctcatgcgccagtagtggcgcccgccccgaacggtgtcgacggggcgtctctgagcggttcagggtcactggaagggacagaggtgattggaatattcattggagcttgaaaaggggttggaatgagagaaccgtttggaagcactggaatacagctttattcctacacgattagacccgttaccccgtgggtctggccgaccgtcctgactcggagatccctgagctgcgccgccgtttccttcgtcaacatccagcagctacttgatgagcgccctccagtgggcctaaggtccctatgccggcgcggggttacagcgagtggacagacaggccggtccctgtcctcgaggagcccatgatccgcgcgaagacaggcatttaacgacgactcaaacgatcacttaaatacaactgtggtgaaccgcacaagagggacgcgcggggctctgcggggaatgacgagcccgacctcgtctgcgacccaggaagggcaagggtggaccaggcaaggcgac

SEQ ID NO: 495307 - DNA, 214 bp, Homo sapiens
gctagcggcattctgtgaacgatctcaaaaaaagacaaaaaaaaaaaaaaaaaaagaatatttattctctggatctggccaaagtgtggggctcttgcgaagggaatgtggggagagggtgtccattgtgggaagagagaggggcatgtgtgtggtgggagaaaggagaaaacgcaaaggagaaccaagattggggagatttttctggtctggg

SEQ ID NO: 495308 - DNA, 218 bp, Homo sapiens
acttctctcagttcaacctcgagcttctgcaactgctcctgcatttctagaacctgtttcaggggtggcgcaggtgggctggcctctccttcaggaaggggaatatcatctctattaatttcctgtaccaattacaccaatattcgctctagctcttcacacctcttcacctcaccatcaaattttctttggaaagacttacgttctggttgaggtct

SEQ ID NO: 495309 - DNA, 523 bp, Homo sapiens
ggtcaccatagttgatggctctcaagcatataccaatattctccctcactaaacgtaagccttctcgctcactctctcaatcttatccatcatagcaggcagatcgaggtggattaaacgcgagaacccagttacgcaaaatcttaggatactcctcaattacccacataggatgaataatagcagttctaccgtgactaaccctaacataaccgttcttaagtttaactatttatatttatcctaactactagcgcattcctactactcaacttgaaggctccagcgaacacaaccctactactatctcgcagccgtgaaagcagagataacatgactaacagccttaattccatccaccctcctctcgctaggaggcctgcccccgttgaccggcttttggcccaaatggggccattatcgatagtaattcacaaaaaatcaattagcctcatcatcgcaccatcatagccacattaccctcctttaactctacttctacctatgcctaatctagtccacc

SEQ ID NO: 495310 - DNA, 217 bp, Homo sapiens
agttccaaggtaggcgagagcaaggggcatatacacagacttctaggaattccagtagctgaataagttggatagaactagatatatatctatatgcctttgctgaaatataaatgaaggcaaggaaatacggagtaagggataacgattcatacccctagcagctgatgtaatatttggacttggatctcaaattcctgaggatagaccctaagaa

SEQ ID NO: 495311 - DNA, 366 bp, Homo sapiens
ggtgaggagtgtgtgtgtaccggtaatgtgatagatcatacgtaatcatgatataccgtaatatataaggtaacatttatggctgaggtaccactgcatctctttgggtacacaaatgacgtcctgagtccagtcaggggtcgcagcttatcagaagaatcagggaacctcacgctacacaggcaatttctaaatatcatgattacctgggcttttcttctctagcttggaggtcatctctctatgcaccctgacaaaactacatcaatagaagggtatcatcaagtcaagctctcataaaccaaaggtatactatgaaaggccatgatcctagcagataaggggctcatagctgctcagtccctc

SEQ ID NO: 495312 - DNA, 179 bp, Homo sapiens
tgaacaaaaattgggcactcatctattcttttctcttgtgtcctactcattgaaaccaaactctgtgaaaggacccatgtaccagtatttatacctctaatgaagcacagagagaggacagagagctgcttaaactcacacaaccaatgaactcaaccacaacgctgaagagggaggta

SEQ ID NO: 495313 - DNA, 159 bp, Homo sapiens
  misc_feature (110)..(110): n is a, c, g, or t
gggctgggtgatctagaggaccttatatgctgctcacaagatatattgccatagagaaagttgtactttacagtggagaaatttgctgacaggattgtaaccatgtgatntaagttttatcaccagtaaagggacaagttgacaagtgtctcctggata

SEQ ID NO: 495314 - DNA, 749 bp, Homo sapiens
caaagaaatctaaaaggttcttccctcccttgtggcccgtggccattaaatccagaactccagaaattaattctgtttgttggcctaccacacacccctgagggcctccattgagggtccaagaagattttgacccacagaaaaggagccatggaacccaagttaagagttttgccggccaggtatggtggctcacgcctgtaatccacgcactttggaggctaaggtgggcggttcccctatgtcaggagtccaagacagccctggccagcatggtgaaaccccatctttactaaaaatacaaaaacctagccaggcgtggtggtgggcacctgtaatcccagctacttgggaggctgaggcaggagaatctcttgaacccaggagcgggaggttgcagtgagccgagatcgctccactgcactccagcccaggtgacagtgtgagactccatctcaaaaaaaaaaataagaggccgggtgcggtggctcaagcctgtaatcccagcactttgggaggccgaggcaggcagatcacgaggtcaggagatccagaccatcctggctaacacggtgaaaccccgtctctactaaaaatacaaaaaaattagtcgggcgtggtggcggacatcctgtattcacagctactcgggaggttgaggcaggagaatggggtgaacccgggaggaagagcttgcagtgagccgagatcgcgccactgcactccagcctgggtgacagagccagact

SEQ ID NO: 495315 - DNA, 697 bp, Homo sapiens
aaagtatctcggcttcccctggggcttttcggtgctggggtagaatgctggaggacgtgcctttgtgaaagatgtccctgtcttcgagaacccgatgggaaataacaatgaggcatggggtagggatttgaagctggcagactttgcgctgctgtgcctccatggcaaacggaagcctgtgactgaggctagaagctgccatcttccatggccccgaatcatcccgtggtgtctcggatggataaggtggaacgccttaaacaggggctgctccaccaacaggctaaatttgggagaaatggatttgcctgcccggccaagttttgcttattccagtttgaaaccaaaaaccttttgttcaatgacaacactgagggttgggccagactccatggcaaaacaacatatgaaaaatatttggggccccagtatgttgcgggcatttttaatttgaaaaaggggtcaacctcccccctcctggaagcctgtgaattcctcaggaagtaaaaccgaagaagaggggccgggtccccaagaaagcctcagccatttcctgcccccagcttttctccccaggggggttggggccttggcctcccctgctgaaggggggggttgcccatccatttggttacaattccctggggtggttttagcaaaaagtaaaatgagaaattttgttgattttttttcctta

SEQ ID NO: 495316 - DNA, 144 bp, Homo sapiens
  misc_feature (4)..(4): n is a, c, g, or t
ttgnaaatagagtgggacataattttctataccttgctcaagattccatgcagttgccatacagcctttgaggtatggtcaacctatagtaagtgagtaataataaggggaggaagaaatggaaaatttctgtgcccatttcaa

SEQ ID NO: 495317 - DNA, 580 bp, Homo sapiens
gatgtgaaagttcgggatttcgtgggatggtttcgagatcatatgcaaacgagctacggtcagaagatgggcagacaatggtgctcaaactcaaggactggcctccctgggggaagatttttccgacgcacatgatgccaaaccaggtttgaacgatctgatggagaaccttcctctgccagacaatatagccaaactgagaatggccaggctcacatcctggcctcctaggttacctagctacttaggtaagggcctggatcttgggccccaaggatgtacaacgcctaatggggttctgcatcaaccagccacgacggactaacgcaagaagtgggatacaacaaatcttcaccttcagcatgttgtcctggcatgctggtccaatcgtgcaccgcgcggctcatagctcagggcaattccccacaatccggcggcacaaggggtggcatccatggcactcgaacgaggcgtacgtccacacgcaaccaatacgcccgcacggtgaagattcgccgccatgaacgcgagaacgacaagcaggaacagaatcccatagaaatgggcacaaacagaagaa

SEQ ID NO: 495318 - DNA, 1088 bp, Homo sapiens
gctgaatctcctgttttctttatacaatgtggctgtgtagaacagctccaagaaatccgttattatcttctctgactcctccttgagtggtttgaagggtccccctcccattgcaccagtcatttagagatgaaggcatgcatgcttcctcaaatcattgcgacctgctgtcataatgtcagtttcagtggtatgtggtattagaatgatggaagagttttattcggcataggatagagcaggggtcagcaaactacagccagccacctatttttgaaagccttgcaagctgtttttacattttttatgttttacattttttaatagttaaaaaaattagaataagagtaatatttaataacatgaaaagcttatgaaattaaatttcagtgtaaaaggttcattggaagccaaacatacccattcatttacctttcttgtatggctgcttttgttctgcaacagtggacttgagtcattgctgcagagaccctctggtccacaaagccaaaaatatttaccatcttgattgcccttcacagaaaaacttgctgaccctagtatagtacaggatatgttggaaagaaaagaataaatctagaactgtgaggaatgtttccagaaaaacaaaggtggtgtcagtgtagtcattgatatgaaaggagagccgtgggaactgcattctagcacctaaaggaatgggtgaggagcatgagcaacagatgaataagtatggggaagaggccccagaatttagcaatggctgttctgtaacagggctcccacagttcacaggttagcaatgtgtgtgagtccgtgtttaatttgccctgttaaattctaacttctaggttttgatctttcattctagactactgacataattttgagttccaattctgtttgctgaattagctgtctttccatttggtctttaaaaatagactttcaggctatgtaataagtagttttttacttactgcacagtactttattgctttgaatgtcaggtgtggcaacagtaaacatttgtgtgtgcgatatgtgtttgagggccgttcatcctgagccagaatcaaaaaaaaaaa

SEQ ID NO: 495319 - DNA, 344 bp, Homo sapiens
gcggcgcccttttttttaaacttggtccttttctgtgccaactttatgtttgtctttgttcttgttattgtttgagatggagtctcgctctgttgcccaggctggagtgcggtggcgcgatctcagctcactccaacctctgcctcctgggttcaagtgattctcctgccttagcctcctgagtagctgggattacagatgtaagccaccgatcctggcccccccaaaaaaaaaggattttaagaaaaacttctctcgtgatccgcctgcctcgacctcccaaagttgctgggattacagatgtaagccaccgatcctggtccccccaaaaaaagggcgggcgc

SEQ ID NO: 495320 - DNA, 197 bp, Homo sapiens
agactgccggacccccacaagagacaacagagtattcagatcgccaatctgtagagggcagcagcagcctgcgcaggtgtttggcttagtatttgttatttttaaaaaataacagatcacgggtgtacgctgtgtttttcagctcattacactaagatgtgtatttccataacccaagaggggggtcgggctgtctg

SEQ ID NO: 495321 - DNA, 145 bp, Homo sapiens
gtatactcctatttcccagtggcatgtggttccatttcccagtacagtggctcatatttcccagtacagtggtcccatatcccaagaacagtgctctcattgcctaggcacgtgctcccatttcccagcgacggtgctcgagccg

SEQ ID NO: 495322 - DNA, 417 bp, Homo sapiens
gacatcgatacgactttttgtttgggatcttttttatttttagacacagatcaagattaacatcaacaacagacgaagattatagatcaaaaatacacacatgagtagtgctaataaacattcactaggaatgcaacaaatacccgtcataccataatcacacattcctcagagcacataataacacaattagcaggcatccaagaagagtctctacccagaaataaataatagtctctcacataaactaaccacgcagaattcacatgcctacagcacacaggacactaaaggtgagagaacagtagacacctcatctgtttcatctgcataatctgttcccgcatccacttcttcatctgcgtccacatccgtgtcttcatctgcgtcttgctctgtcccttctgtcgtcttctc

SEQ ID NO: 495323 - DNA, 223 bp, Homo sapiens
tcaatcgagctcggtaccgtcagacgctgaactatgtgaaagggggcgggacttgaggggcgtggctagtctgtgtgacgtgcggcgggggaggggcgcgccgttgctaaaggtgcgcgtgcgcttcattccactgccacaatggttcagctcccgctcagggaacgtcccgtcatgtcgcgcctttacctttggtccccactgcacatagttcagcgtctga

SEQ ID NO: 495324 - DNA, 370 bp, Homo sapiens
  misc_feature (345)..(345): n is a, c, g, or t
tttatcacccggaaaaaactcggcgtagatttcgttaatcgcggcgtaatttttccagtcggtaataaagatgctgttgaaggtcacatccgccatcgtgccacccgccgtctcgatcacttgcggatagtttccagaacgtggcgggtttgcgcctttgggtcatcggcaaacagcacgttattatgttgatcaaaagccagcgtaccggagacatacaccacgccatcagccagcgtgccgggaacgaagggggccagcggtgcctgctgccagcgggaataattacggattttggcatcgttaaactccttaagcgatatgagcaaaggacgtgggagaaangcgcgtcgcagaatgtttcgacgtc

SEQ ID NO: 495325 - DNA, 180 bp, Homo sapiens
ttgaggtatcccctttcgattgtggatccgagcagctgtgttggaggacattgctgttcagttcgtggacatggtgaaggggaaatctctcacgggggttgtgaatgcccagtgccccttaccatgtgccttactctccacacaccaatgccttggatttggtcgtggcagaatgctctg

SEQ ID NO: 495326 - DNA, 143 bp, Homo sapiens
  misc_feature (25)..(25): n is a, c, g, or t
  misc_feature (58)..(58): n is a, c, g, or t
  misc_feature (121)..(121): n is a, c, g, or t
cttcggcacagcagggcacccctanctgcactgacttccagatcatgggtctcccttnctccctgaggacaccaaattgatgagagcaagtttgagagaagaatgaatcaactgctatccnttcccctcacccccttcagccc

SEQ ID NO: 495327 - DNA, 1016 bp, Homo sapiens
acgcgtccagcttccggagaccggagggggccggcgtacgcagtcccccaggccgcacgtgaccatgctgtcccgacctcctgatacgaacaccaggccacgcagaatgaacgcaaggagctgcaggacaagaggaggcgagaggctatcactgcagggaacgtgcctgactaagaaagcttgtcggtggagtcaccgtcaagtgctgggattgggacctaggcctacatgtaaccagtagataagttcttgacctatgtaggtgaagacggcctacaaggtcctaggcatgtcctagatgttgtgcagtaggctaaggacagcgcgcgagctgtcatctggaatgtgtggtgagaacttcattcctgtgtaactcaaggaacacttggggcgataggtgtgatgaacttgcggtctcggagcgtcagaagcttggcactatgctgcacctagttgcgcacttgtgactttgcgaattatagtcttactaaaatgggcatgatcttgcagttcgttggcctctctctctagggccgctcattgctctgtctcgtcctggactaacttaccttatttccgcagttgcgtacgacttagacgcccttgattcgcgttgggcaaatggtatgcgtgcgttccttgattggcaccctcgctatgtacaattcagagaaatcgatccaaatgtctcatgctttcgttctaatgcatctttgattatttaatcgagttccaagcattttgaagtaaacaatttgtttcttggactaccctcaatacttccgataggtcgagctctaggcgcattcaatttgtcgcctatgagtggaaccctcctcgttggtacagtcgcttgtgactcgctcaattatgtgaaggtcactcggtgctccctcttggagcgttcgtctgagcatatcttcgcgtcccaggagggctctgggtttgctatgcacccaaaacgttcggaagcacatcgtggcactggtccaaattgttcatcttttggattctag

SEQ ID NO: 495328 - DNA, 964 bp, Homo sapiens
ggcaggctgggcgctgagatgccgaaaatgagtgccagaggacttgaactctgagactactggaccgtataccagtggactgaagttgccgtaagagaaccttgtgaaattcatgatctgcttcgcgtagagaggttccacttgtgtgacctaatggaactacaatgccgtagtcatccccattggacattggtccacccataaaataagaatatacccaggctcaaacacaatgactaacaaatggaactctctatatcgcatagcctgcagcaacatgaatctccaggggctctgagtgtgtgtcgtccggcctaagaaagtacactgagtgtcaagtctcaaggggcgagtgcctccagcgtgtcaacgttcgtatcctatgtgtcgtctatcaaatgccttcgaaatcgtcttcagctgggatgtatgtggagtgcagtaacttggatgaacgagctgagttgggagtgtcgaattgggagtgactctcatcttaaactggaccctccatacgaatgatactggcgagagatcaatggtggatcaggccaacttacctttgactgcgtgcgatagtaattgcaactctgcgatgttcacctcgttagaatgaggtagtggcatggttgctatcgagaatgcgcgcaaggggcttgatgttgatcctcttagttcgctctgggagacactggggaattcagacggtaatgcggaaaagattgcccagtaggatgacgaccgttggatggaaggaggacgaactcctatcaccaaccgttctttctgtgaaaagcttgggtgctggaaagaaacgacgtacccccgggcaggtgtatatgatgggatctggcagccctaccgggtcattgatgacgatccgaaaatggcccatagccgaccagctctttccacacccagaggcagtcatcactgggaaagaaggactgctgacaagaaaatg

SEQ ID NO: 495329 - DNA, 516 bp, Homo sapiens
  misc_feature (129)..(131): n is a, c, g, or t
aatcgcttgaacccggaatcagaggttgcaatgagctgagatcgcgccacactaccctgcggcctggaggacagagtgagatcccgtctcaaaaaaaagggaaaagaaaaagaaaaaaagaaaacttannnaaaactgcattaactgaaaatttaaaacataatcagtcacagctagattaaattatcattaatcccggttaaggaatcttatatcccaacagctaggtcttagcaatatgcaccatctctttttttttgggacggaatctgaccctgtcgcccaggctggagtacattggcgtgatcttggctcactgcaacctctgcctcccaggttcaagtgattctcctgccttagcctccctgtaatcactacttgggaggctgaagcaggagaatcgcttgaacccgggagtcagaggttgcaatgagctgagatcgcgccacactaccctgcagcctggaggacagagtgagattccgtctcaaaagagagaggaaagaaaaagaaaaa

SEQ ID NO: 495330 - DNA, 425 bp, Homo sapiens
  misc_feature (20)..(20): n is a, c, g, or t
  misc_feature (22)..(22): n is a, c, g, or t
  misc_feature (44)..(44): n is a, c, g, or t
  misc_feature (67)..(67): n is a, c, g, or t
  misc_feature (101)..(101): n is a, c, g, or t
  misc_feature (158)..(158): n is a, c, g, or t
  misc_feature (164)..(164): n is a, c, g, or t
  misc_feature (225)..(225): n is a, c, g, or t
  misc_feature (231)..(231): n is a, c, g, or t
  misc_feature (235)..(235): n is a, c, g, or t
  misc_feature (261)..(261): n is a, c, g, or t
  misc_feature (264)..(264): n is a, c, g, or t
  misc_feature (266)..(266): n is a, c, g, or t
  misc_feature (305)..(305): n is a, c, g, or t
  misc_feature (341)..(341): n is a, c, g, or t
ggcacgaggggtctgggganantttctggctatcacagcttatngaaggaggttgctactggcatcntagcaggcagagtgagtgctgctgttaaacccanccacaggacacagaacagtctcctgcaacaaagaattacccaaggcctggcgcggtngtcacncctgtaatcccagcactttgggaagccaaggcaagcggatcacttgagcccaggagttcanggtcancctnggtaacgtggtgaaacaccatctctncananaatacaaacattagccaggtgatgtgctgtgcacctgtngtcccagctactcgggaggttgaggtgggaggatcncctgagcctgggaggtctagactgcagtgagccatgatcatgccactgcattccagcctaggcaacagagcaagaccctatatc

SEQ ID NO: 495331 - DNA, 342 bp, Homo sapiens
  misc_feature (110)..(110): n is a, c, g, or t
  misc_feature (200)..(200): n is a, c, g, or t
  misc_feature (296)..(296): n is a, c, g, or t
  misc_feature (302)..(302): n is a, c, g, or t
ctagaggatcgcgcggagtgatggtgaaggatacaggattaggagctgcacacgccagctgatttttgggggggacgcagtttgtctttcggccaggctgagtgcagtgngcgatctcagtcactgggaactccgcttccaggttcaagcgattctcctgcatcagactcccgagtagctgggattacaggcgcctgcancacgcccgggtaatttttggtatttttaatagagacggggtttcaccatgtttggcaggatggtctcgaattcctgacctcaggtgatccacctgnctcagnttcccaaaatgctgggattacaggtgtgagccattgcact

SEQ ID NO: 495332 - DNA, 1093 bp, Homo sapiens
gcaccaaatggcggatgacgccggtgcagcggggtggtgcccgggggccctggtggccctggtgatgggggaaccgcggtggcttcctgcggagtgtttcggcagtgtgcatcctggtggccgtgggtctgcgtgccgtggacgtgggcctggggcctgagtgcccgctggagctcgcggaggcaaggcctgaggatcagtgagtggatagcccgtcaccaagttgggccgcttggtcaaggacattgaaggatcaaggtcccttgggaggagatctatcgtctttctccccttgccctattagagcgaatcaggagattcattgatttccttcctggtggtgccttctctcgaaggcatgaggctttcgaagcattatgccaagtgcagaatggcatggaccctgattgccaggccaggcgcacccagtgtttcaaggcactttcgttcgctactctgagggactacacatgggccaacggtcaggtacttggcgtgttacaagttgcatccaaatggacggtagagccaacggcacattcacaggttgggtgccaatcagtcacttgtgcacaaacgcaacattccaattcagttcgcgccagttagccgcgaaggatgtgcttaccttggggcggaaaccaaaggatcgggcaaaagacagcacaacaacttgttcgcctttggcaacggcgttcgacccctgtgcccagcttggccgggcttcttggtgcctttggttagcggcccttcaatttcgccctttgcaacccgcatgggggcccacattgggccatcttcgggttccttcccggcatacgcctgtggtcgcccttagcgggaagcagcagcctttgagcttcaactttggaagttggaggcattggagcataacttcgagacattgagaccgtttggcgttaagcaccgcccatttcaaagagcgcacccaggaggcaggcacatttggcaacattttgagtaccagaaccaccctatgtgcgcgccaaaacgattttccgagcccagaagaggaggcaccaacccatcttataggaatgtggaccccaagtatctgcgatagagggaaacc

SEQ ID NO: 495333 - DNA, 268 bp, Homo sapiens
cccccttacggattactcaacacaaagaggcacattgtaaaacatgggaagggcaggcgcgatggctcatgcctgtaatcctagcattttgggaagctgagtgcaggcaggttattgatgcccaggagtttgagaccagcctgggcaacacggcaagaccgtctacgaaaacatacaaaaatttacttggtgtggtggtgcgcatttgtagtcccagctactcaggaggctgaggtgggaagtcagggttttgggggaaattccctac

SEQ ID NO: 495334 - DNA, 167 bp, Homo sapiens
ttagtgattctgggtcatgacaccccaacgatcatatggctgagagtacatttgaacatgcaaggatgcatactaggattgcttttgtgtgtgtgttttagaacaatagaggtttgttgaccttttgtccttttttactcgctttataaaatatttcaacacggtat

SEQ ID NO: 495335 - DNA, 341 bp, Homo sapiens
taaaacaaagccaactgaaggcccaatttttttcctgttgagggccgtggatggcagatttaaagggaagaaccccaaaggcttgcaaagataggagagggtccctttttaatgcatgtagaagctcctttcgggggcccctcaaaagcatagcttggaagccccccttctgtgcggaattgggtcagggcaaatgtcacagcaggatttcccccacccaggtccctcttcccagacccaaaaagctgcaggggaggcctgccccctgtttttttgactttgccctcctttggcagcatagatccttaggggctcaataaaggtgtgctgtttttaactta

SEQ ID NO: 495336 - DNA, 644 bp, Homo sapiens
  misc_feature (511)..(511): n is a, c, g, or t
ttagcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcaaaaaaaaaaaaattaacttggcgtggtggtgggcgcctgtaatcccagctactcaggaggctgaggcaggagaatcactagaagctgngaggcagaggttgcagtgagctgagattgtgccagtgcccttctgggcaacaggagtgaaactctgtctcaaacataatataaattaagtgtctttatatgttcgctgatgaattttgtcagtccacctattt

SEQ ID NO: 495337 - DNA, 131 bp, Homo sapiens
gacgcgtgtgagagagcaaggagaccatggttactctttgaaatggatggtggaaaattacgcggaaaaatttaatcacagagattgcgccatggcactccagcctgggcgacagagccagactccgtctc

SEQ ID NO: 495338 - DNA, 716 bp, Homo sapiens
gccgggcgcggtggcgcgtgcctgtagtcccgagtggctgggactacgggcgcccgctgccgtgcccggctaattttttgtatttttttttttagtagagacggggtttcaccatgttagccaggatggtcttgatttcctgacctcatggtccgcccgcctcggcctcccaaagggctgggattgccggcgtgagccaccgcgcccagtcaaagatttctcttttgaaattgaggcatgacctggtggtcaaacgcctggtggtttcacgcatacttggggggctgagggcatagagagatcccttgtatccccgaggtatggcagacgtacttgctagaggtagaccagctgcattgtgcccacgtgtgaccctctcatggggtgtggatgtctacgcaggtgatgcagctctgctcctgagaatttcactaacccaaaatcaaacatagagtagggacgtaaatcgatcgcacttcattatttccggaaagcggtatcaaacaagggatctgtagttcttgcccattagggtgagatacccacacgaaaacattactccattattggtttcgcggacggtcttttaccgcccccctccatagcctcgcatatacaagggggaggggcccgtttttttgtaatcgaaacagtaagacgtacacgtgcgaaagtgcagcgggatgggaaaacagcggtgctgggaatgacaccag

SEQ ID NO: 495339 - DNA, 125 bp, Homo sapiens
tcctcgtgaatagctgggaatcaggtgtgtgccacacgatcggctatttttttttggttttttagtacgagactgggtgtcaccgtgttagccaggatagtcgtcgatctcctgacctcgttgat

SEQ ID NO: 495340 - DNA, 398 bp, Homo sapiens
ggtatgagtaggactgccagtggtcttgagttacgtagaagtagtagttctggcccctcgaggattagtggtgggaatcgggcgtcgcgtatcttcgggcttggaagggttaatcgttctgggtctccgacgtgacggttcgcgcggatcgcgggagtagtatttaagacttcggctatttcgacgatttatctcctctagagtcggacggatcggggtcggagtttacggaagagggcggaggtgagtagggcagcagtggcggtggcagcggcgagggagagggtcgtcaggaggtttaaggtggggttaaggtcctaagtctctacgatccggtcacggaggaggaggaagaaggtgagtctacttagcttagttccattcatagtcgtcgcttc

SEQ ID NO: 495341 - DNA, 760 bp, Homo sapiens
gcctccaggctccctcagtgccttagccccaccccattgttctcccgaccccccagtccctgagctgctcactggtgagtgggtgtcagtgaaactggggcctggagtggtgagtgagtgggtgacttagtgtggcattaatgtgtgatgtgccagtgccatgccctgtgtggcctgaaagcctgtgcagcctggcgtgtgagcctggcctgactgtgccctcaaatggtgggggacacgtggtggcttcaatggacaaatggaaatgtgtccccaatgaagaacccaccattggcatgcataatgtggtgagctggctgaatgtggtggtgctgagcccaaggatacaccccctcccgtgtgccccattctgaggaccattaaggtgcccccggtgagtagtcagaaagtctcgatcgtggcacgtaggagaaaatacaaccctacccggaacagcaatagctcccgcaagtgacattaccattggaaacccagacctacagccagagcagactgtgccatctgctccccgggacccagcctggacacagtactgccaaaaacaaggaggaggaacttggccccatagcagccataacttgcagctgaatattgaccctgattggggagcagctgaagtgctgaagcctggggagcccatacagcaaactggactgtgaacatgggttgtgcacatatcccggataaagacaatgcagtcgtcctaaaaccatctgacatggcgggcgaaaaaaaaaga

SEQ ID NO: 495342 - DNA, 1026 bp, Homo sapiens
ccacgcgtcgcggacggcgtgggtcgacccacgcgtcgggattggggtggatttggttttgttcccctcctccactctccccgacccctccccgccttgttttaaatggattatcttggatctccttaccctacctggttattttgatcaaatcttttttgctgccccttcgtcacagtcatcagatagcaccccatccaaccgggggaggacaagctgcgtagtggaccaacgccacacggccatgacaatttcatcaatgcatcaaccatactcgggacgcccacaacgagatgggcacaagcaaacggggtgtgatgcgtcgtcatccaaacaccaacaaatgcaaatagacggacaagacacaggcggactacatacctcattagtcaacacaccctaccgctatacctccacactgtcccccaccaggaactggagccactaacgagggacggacgacaataggccatccacaaccaatgggccacaccacactgacaaaaagtacacgcaccgtaacaacacaatagttgctaagttcacgataacattaggtgatccccaaacaaaacgacaacacaacggcgtgcagccttctcaaagaagcacctacacacagagagacacacacctatacagacacacacccagcactaacagcagcacaacacaagaaacacattaagctgacccacaacaatcagccagcacacgcagaaccccgaagcaaacacacggatgccgagccggaaccaacaaacgaacacaagcgcactcacatcgacaggacaccacacacacaacgcgtcaccaccggtgacacaccactcctcaacaacatcgaccgccccgacgccaatgaacacgtgaagggaactggcacaacacacctccatactggtgcattagcgactacaacccagacaaccccagcccagactaccaggacctatacaaccaccaccgacaaacgatgcatctaccaaacacacaacagacacccgccacccagccaacacaaca

SEQ ID NO: 495343 - DNA, 654 bp, Homo sapiens
  misc_feature (654)..(654): n is a, c, g, or t
tttgctagatgacatgatcacctagaaaatatgaaagaatgaccaaaaaaaaaaaaatcaatgaatccaggagctgattttttgaaaagatcagcaaaacagactgctagccagactaataaagaaaagggtattcaattaggaaaaggggaagtcaacttgtctgtttgcagatgacatgattgtatatttagataacccaattgtctcagcccaaaatctcctaacactgataaaaacttcagcaaagtctcaggagacaaaatcaatgtgccaaaatcacaagcattcctatacaccaataacagacagagggccaaatcatgagtgaactcctattcacaattgctacaaagagaataaaatacctaggaatacaacttacatgggatgtgaaggaccttttcaaggataactacaaaccactgctcaaggaaataagagaggacacaaatggaaaaacattccatgctcacggataggaagaatcgatatcgtgaaaatggccatactgcccaaagtaactgatagattcaatgctattcccatcaagctaccattgactctcttcacagaattagccaagacaatcctaagcgaacagaacaaagctggaggttatcatgttacctggcttctaactatactacaagn

SEQ ID NO: 495344 - DNA, 438 bp, Homo sapiens
cggggacacggaaggggcttcgatcgtacagggccggacgtagaccgacccgagacggcgaggacatatcgccgccgaggccaccatgcacagcagggacactatcctgcacagccaacctagcgttggaggtctcctgagaactcagaataccctcagacctcgcactatactgaggctccaccctattcctgagagccatctgcctactgataggtgtatcgagcgagctttgtagacccagagattgccacagtatttaccagggcagccgtatatcctggagcggccctgtatgttgccatgtgccactcagtggctagcaggccctataggttacacaatacccagggctaattatccaaccggttccacatatccacctggatgcacaattcttgcggaaggcaggttttgtgctggtgccaattttggctg

SEQ ID NO: 495345 - DNA, 346 bp, Homo sapiens
aaaaaaaaccaattctgaagacccagtccaattttattatctcatgagattttaattcttgacaagtcaagaattggatgtctctatttttagaaagctaagggtattctctagactcggattctgtgttagcagtatcaaaccaacttagaattttacaattatgaaagcagtttccacccatgtggtcccaggagccctctgggcccaggcagaaatatggaagggttaagggttacagttaaagggctagaggtgagtctataatccactaattcaaaagtttagttaaatgaactcaaagtatctatagagtttccctagtgaccctgccttcgtaaagctg

SEQ ID NO: 495346 - DNA, 404 bp, Homo sapiens
  misc_feature (12)..(12): n is a, c, g, or t
  misc_feature (28)..(28): n is a, c, g, or t
  misc_feature (221)..(221): n is a, c, g, or t
  misc_feature (391)..(391): n is a, c, g, or t
  misc_feature (394)..(394): n is a, c, g, or t
aaactcttagangaaaacaagggcaaanccttcaagacattggatttggccagtgatttcctcagatatgacacccaaaagccacagacaaaacaagtagatcaattggacttcatcaaaatttaaaacttctggcccaggcacccgtggctcacaccctgtaatccccagcactttgggaggccgaggcatgtgaatcacccaagttaggagtttgaganccagccctggcccaacgtggtgaaacaacacaaaaattggccgggcatggtggcgggaacctgtagtcccagctactcgggaggctgaggcaggagaattgcttgaacctgggaggcggagattgcagtgagccgagattggccactgcactccaccccgggcaacagantangactccatct

SEQ ID NO: 495347 - DNA, 666 bp, Homo sapiens
agccccttgatggaccagttgtgtcccccaggaaggatgagaatagctactgaagtcgcttaagagccagccttactcagagcccttggcacaaacggcagttagaccagaaagctggaagttgaaatggtggagtcccagcttgccccgggaccagcttaatgggttctcgctcctggttatcgtgttttagtcccactggagtcgaccttgcattggggctaaacgcgcacccctgtaggaagcacgctctccctcgctcataacctctctgtcgaaggtatgcgacgacctcggcttgatctaaccacctgtgctcggaggcacaggtgtgttacacagtaattgtcctacacgccagctcacgacatgtctatgacctgtgaggacattgtcatgtgcagacctcgttatcctccaacttagggtctctcttaatgagccccctgccagccgcagcacgccagctctcactggcattgtaaagggtccttgcctcaccctcagtctagcacccccgtggcctttgatagcttaatacagcctccacttttgggctcaagtgatcctcatcctccccgtggtctttgttgctgcctgatggagtttcccggcacaagaagatttaaccaggtctcccattttaataaaattttgcaatcccca

SEQ ID NO: 495348 - DNA, 936 bp, Homo sapiens
ggcggtgtccactaatacgataccttccggaccagggggatggaccgggaagatcggagagacgggaaaacgtgcacctcagctcctgggtagagaaaaacaggggattctactccgtgcctcctgactatggtctggctaagagattcgcctgtaaatgctcccggtgcccatggagagggacccagcataggcaagccacaatactcagccttggatagggtggagagcactgagggactcactggagggcaccaagccagccacacagccagggaagtggcgaggggggcggaaacccatgcctccacagctgagcactgggaatgtcagcccagtaagtattggccagtcaggcgcctcgtggtcagagcagagccaccaggtcccactgccccgagcccatgcacagccactccctcctgccatgggtgggggaggctggaggtcattgcgagaggctggactgcttgccaccccgggtgctcccgctactagccatagcactgatcagtgacaatttacaggaatgtagcagcgatggtaattacctggaacagttttttgtttttgtttttgtttttgtttttgtagggggggggcaactaaacaaacacaaagtattctgtgtcaggtattgggctggacagggcagttgtgctgttggggtggtttttttctctatttttttgctagtgtttactatgtgttgtctaataatgatttaacgatctgccatcaatcatctctgtgctaagtatataaaagatttaaccaccttcccagtccgtcgtcccctcccccctactcaggcccttgaggctaccataggagatgctgtgaagactccacgaaatcccgagtccaagtcagacttgcacataataatattatattcagaataagatacatctcaggattataatgagccccccc

SEQ ID NO: 495349 - DNA, 936 bp, Homo sapiens
  misc_feature (1)..(1): n is a, c, g, or t
nccaggtgagcggccgagggggcggggacacgcaggcttggtggtataaatttgccacgtgcctccttacggacattacgccattgtggccgacatttcttgtatcgcgtgtcacatttgggtgtttcccgcccccgcattggggcttttatgaccagcggcttctccatcttctgtgatccgccacctacattaggatacattatcggggctgcataaaactactctacgctgggcccaatcttacacccaatctggcgacctcggtcggggagtcaggatctgacggcgggtgtttcgcttcatcccccggagaggttttgtgagggcgaatcctcaagcccaagtgcggctttccaattgtgccgccgtctctccccctggagaagacaatttcggcggcggaacgacccccgtttgcttaccttaatgggcgggcggggcccaaaaaaacataggatgggggtgagatatcaggcagtacacaccattaggtggagggaggaattcaatatgggcattgttttcataacacagaggaatataacgcactttctgtgcgtgcacccaacttgagtctagtacgttgctctctacgaagaattctcgctctgtccgccggagatccttctcaaaactcctccgcgcacatccccttgttaacaatactggccttaccatcaatctaagattatgagtagcgacacttgcactcccacctcctcttatgttagcaacccccccttccatatcactccactgaagcgacaggtttttcgcggctcggcgctagataggccacaatgctccgcaataacttggtttccctcgttggactttcgcagcggcgccaaactaacaacacgagaaccttgctgttgtgctacgaagacttccgccgcgcccaagaaaaaaataaaacaaacaaacatgcac

SEQ ID NO: 495350 - DNA, 989 bp, Homo sapiens
  misc_feature (90)..(90): n is a, c, g, or t
tggaaacggggttcttggcttcttggcccgggcgggagttacagatagtgtgcaattcacagcgtgacgtgcagccttgaccttccgggncctcagggattcctcgcgtgccttcagttcctcccaacataaggtgggacatacgggcacgttgccacaattactcagcttttttgggtgtgggttttagagacaagagatgtctcggtttttggttggccacggggcgtgggtcttgagaattcccggggggctacaaggcaattttctttccaacctacaggcctcccaaaagtgtggctgagagagatatacctggggtttggaggccaatgtggggaccaaaacccttcaagaaatctaatttttaatagtgggtgcttctggtctcctgagatgtggattttggaaggggaattgggtgacatgtttcacagttgggctgagatattattttcccaggttattattttgagaatcttcgggggatccttttgatatttccctcttatttttgggggtgttcctcctaaactattaattctattataaaaagggtcggggcttcataattattacagaggggtttcgtggggggaagattagtttggggtgcatatttatttgaaattccatttagagattgggttgcccactatagtcaatttaagggtctatatttcagaggtaaaaaaccccattttttttgtgggcccaaaatttttcttaaacagcgggttttttaacctttccaggaaggtggaggggcatgcgaaagaaggttttattaaagggaaaaagatccatattaaagagggggcaaattgggggtaattgggaaaggtatgggtggataattaaaggcccaaggttatggggggagtattaacgcgggggtttgtcgacttggagtctgtggtgcttggagttgtgaggcattttattatatagtttaaaagggggaaacgggttcttgtgaccatttatta

SEQ ID NO: 495351 - DNA, 1177 bp, Homo sapiens
agcggggtcgtctggttctctggctccggaagctgcgctccttcaccctcctcgtttggtgtcctgtcaccatggcgctggctgtcttgctgggtcctgcgtagccctttcctgacctgagatcaccccccgttcgtgcatgtgctgcttgccacccggtggtgccctgtggccggcggcggagctggggctggtgctggtcctgaggccttgcatggtgatgagcccggcatgggccggcgctgctggtggcatgaccatggaggggccggactgcgtggcaccgaagagcagggtccccgggacctgcctgcaagctacttggattagccgctgcagctgcatgcggcatcctggcactgggtgctcctggggcgctggtgtgcggtggctggctggcggtgctgtgcgtgcccccgtgcggctagcgttgggcacgttgcttgtgcacctcgtcttggcgggcctggggctcgtgacctgcgaagtcgggcctgattgcctggattgatggtctgctggaagtagaccgctcccgagtttcccgggactcgccggtggtgcttggactgacgcgggcggcgttgctagggggctgcttggtgccccgaggggacatcgggctggcttgtggacttggcgtcgtcacgctgggcggggcgcagaacgtgttgatccgagaagctctggtgggacccgtcgagtctgggccccccagcccccagacgcagtagtggtgtcctccattttggcgggttactggccacagtgcgtgcgaactcccggcgggagttcctagtggaaggcggactttgggaagaattccaccctagaggagggtagaagccaggaagcactgtactccggaagtgcaccgttgaggcatccctttccagcggtggcggacatggggccgaatgtgtgtttcgaccccgcgtgtcccgaggaagtttctgttcgtagcaccgcctattcaagcgaacagtgcaaacatttgagctgagagtgtggaagagagtcctatacaaaacttccgtgtgtgggaaacctctctggtgatctgaacctgtggaacccccgtgctctgtgcagcgattatacaatcgaacccccgtcggtagcggagcctgacgcttgtcccttggcgatttggggatagaaactctggatgataccc

SEQ ID NO: 495352 - DNA, 213 bp, Homo sapiens
gggggtttggccctggttttggattccagaaaagagggggcttgcctttttttgcccctttggggcccattgggtcctttggccccgggtttttttgggggacccctggggggggggttttttttccggttttttaggggcttttttttttttgccccggggtgggccaggggtgggtgggttttgtttttggaaacccacccccccccccca

SEQ ID NO: 495353 - DNA, 115 bp, Homo sapiens
tgatccaacttccatgaatcaaagcgtattccgttttcattcctgcattatccacttggttccctcccgcaggctgagcaagtctgtaaactgattctgggagaaaccaagctgc

SEQ ID NO: 495354 - DNA, 626 bp, Homo sapiens
  misc_feature (21)..(21): n is a, c, g, or t
  misc_feature (41)..(41): n is a, c, g, or t
  misc_feature (73)..(74): n is a, c, g, or t
  misc_feature (97)..(97): n is a, c, g, or t
  misc_feature (208)..(208): n is a, c, g, or t
  misc_feature (222)..(222): n is a, c, g, or t
  misc_feature (240)..(240): n is a, c, g, or t
  misc_feature (244)..(244): n is a, c, g, or t
  misc_feature (249)..(250): n is a, c, g, or t
  misc_feature (277)..(277): n is a, c, g, or t
  misc_feature (280)..(280): n is a, c, g, or t
  misc_feature (307)..(308): n is a, c, g, or t
  misc_feature (310)..(310): n is a, c, g, or t
  misc_feature (316)..(317): n is a, c, g, or t
  misc_feature (323)..(323): n is a, c, g, or t
  misc_feature (347)..(347): n is a, c, g, or t
  misc_feature (377)..(378): n is a, c, g, or t
  misc_feature (382)..(382): n is a, c, g, or t
  misc_feature (388)..(388): n is a, c, g, or t
  misc_feature (399)..(400): n is a, c, g, or t
  misc_feature (410)..(410): n is a, c, g, or t
  misc_feature (416)..(416): n is a, c, g, or t
  misc_feature (423)..(423): n is a, c, g, or t
  misc_feature (431)..(431): n is a, c, g, or t
  misc_feature (448)..(448): n is a, c, g, or t
  misc_feature (456)..(456): n is a, c, g, or t
  misc_feature (475)..(475): n is a, c, g, or t
tctggctaccgggactaaaanggaagcgttttgggggtcgnggcccggacttggggcggggggtccggccccnnggacagtttttaccgcatttccnctccactctcccgatttcctttcagtggatctccgggcgttcgtgcacttttacagaggctccaatctcacgcggacccagaaaccccagtgggtgaccgggaccctcagntccttcggggttanaagttctcagaggggcgngagngtggnnagatatgtgccgacaaaacatgtgtgnggngatctcctatagcggggcctcctgtgnngncctcgnnttctcncgacaaaacatctcttctctgcgncatatatatgtggcgaggtctcaaaacaanncagngtaccncatgtggctgnnggggtgcccnctgtgnggggcgnaaatatangcgccgtgaatttctcncaagtatnttgtgagagcgcaaaaggngtctctctgcgcgccccaaaagattggggggtgaggactgtggagaggtgagaggggagagcagcctctcgtggggggagaagagatttgggcgcaccaccagcgcgataaataagggctccctataaaagagggcgtaattttccaattg

SEQ ID NO: 495355 - DNA, 168 bp, Homo sapiens
cacatgtgagcctgttctcgtaaaatcagaatagctggtgtgggggtgggtgctataatccccaggttcttgggaggctgaggcaggagaattgttgggaccggggagcggaggttggcagtgaggccaagatcacaccaactgcactcccatgcctgggccgaaaag

SEQ ID NO: 495356 - DNA, 376 bp, Homo sapiens
ctcagctgcgtaggcgtttatacctaccagtattttgtcaaagccacaggtcgactcatggatgatgcctctatagctgctgcatgatgttcaaagaaccggcccttgcttgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagt

SEQ ID NO: 495357 - DNA, 373 bp, Homo sapiens
  misc_feature (35)..(35): n is a, c, g, or t
  misc_feature (277)..(277): n is a, c, g, or t
  misc_feature (317)..(317): n is a, c, g, or t
aaaggtaagtctgagtggaatgactacctattttnccctggttgtcctgggtggtcagtgacgattgttatatcagctcaactcacagcttccaaagacttcttgagaagggctgtcttttttcaacatgctgcttggtgaaatgcaaagtgaatttgataagcttattacccttattcagaaagaaagggcttgaacaagctgaaacctttatgtgtgtgtgtgcgcgcgtatatacgtgtacttctttttaattaacagtatcgtcctctaaatngtaggagaacttatgctttcttatttattcatttttagtnaaaactaggttcatgttcctcatccagtgtatggaatatacccacatttttgtttt

SEQ ID NO: 495358 - DNA, 157 bp, Homo sapiens
tcacatctgctggaaggtggagagcagaggcaggatagagcccccgatccagatctgagatacttccgtctctggggagagcaaataatctctgatctgtcatgggtgcgtgcgggtccagggcctgctcatctccattcttgcatcctgatatgca

SEQ ID NO: 495359 - DNA, 384 bp, Homo sapiens
aataattgtcgtgtgatgcagactgctattgggtgataggaatgctggacccgttggcgggactcttcggtgaattatgtagcttgtgggtgatagcataaacttgtaatctatcaatgtattctagtatagagtcagaggactgcattcacagcaacataatcctgcggttggtattgcaaacattcacgaggatcatgatctacagacatggctctctgcctcagcgtggtttcatgcgcgagatttgctgtattgccacagagctgatttgtgcagtcctgtttcggacgggctgtgatgttcgtgattggatccccttttcgcggctttaggggctcgggcaagcttttgaggtctgtaacttgttgaagacttgtggac

SEQ ID NO: 495360 - DNA, 273 bp, Homo sapiens
actgactacgcggcgtcttacacattgctatgactcttcgcgaagtcccacaataaccagtgtccgcgaccagcacttcaatctggcctctcacagtatccctgaggccacacctgacccccatgactggatctctctgatccacctgctattcaccccatttccctgtatttccttctttcctattcctcaccctgagcacgcttgatttattgatggcagttccaccaggcctaatcgccacataccagcaaatgcaggctatgctatagg

SEQ ID NO: 495361 - DNA, 121 bp, Homo sapiens
ttaccatagcatgtcttttttcttccgcttcctacttttcagggtttattatcttttttcttctaaaagtatgtttttatcttctaatttccctatcttctctgctattgaaacttctaaa

SEQ ID NO: 495362 - DNA, 478 bp, Homo sapiens
ggatcactttgtctgatactgtgatgctcaggtggacctgcccatggctgcagtggaggctataaacatagaccagctgggcgtgaatgatgtgatgctggagaagcctacgtgtggaaggccaggcgctggtgtgtgaactgtgctatgacaggaaagtagagaagaggtgtcagacctgcaaagccaacctctgccacttctgctgccaggctcataggcggcagaagaaaacgacttaccacaccatggttggccctaacaaggacttgaaaggctacagccggaattgggaaaggccaatcctgtgtcctgttcaccctgcagagggaactgaggctgtactgagagtactgtgaccggcccgtgtgccaggcattggagtgatgggggagcatcgggaacacccctgtgacttcaccatgcaatgtcatccactagcatggggacttctgtgttaggcatctcctcaaaaggt

SEQ ID NO: 495363 - DNA, 108 bp, Homo sapiens
ccgtgatttatgtagtatttccatttcttattatcaacaacttgtggttcttcccaatgagataaaatgaactcagaagtgacatacgtcacaaagaagattcctgta

SEQ ID NO: 495364 - DNA, 111 bp, Homo sapiens
cacgagggtaaagaacaagccaccattggggcctgaaactctcttgtacggttgagagtgcacacttttttctgattacacctagaggtggaaggagagatacattgtgtt

SEQ ID NO: 495365 - DNA, 1191 bp, Homo sapiens
agcgggggtgagagagaggagcgagagagtgtagagcgagaaagaataaaaggaaagaagatatctactatgtatataaagataggccacgtatagcaaacggacaggctgacaacgcaagcctcagtaccaacgggctacggcagcagcccgtatcagaagtcattgctgcggagaatcgtgatgagtctgcaaggtgagatgatcccgatgcaatctaggtccaaaaagaatcgcgaagtgcagacaaggctgaaacatgaagacaaacgttgtgcatgaaatcaaggatgagtaaagagagccatgaattgcctgcacgaattgaataagtgagtagacgagaggactaactactcagacataagacgatgggataacaatttatcacatggtcgatagttacgagaagacaatggggctagcctacagtccaacgaacaattacgttaagaaaacaagtggtcgatgaagaagctccagaaagctgcgctgaatggcagaatgctagtgaaaagagcgactatctccggatagacaagaggctctggatgctagactcgttgttataatatgcctaatcatggagcattgcgtaaataagtgccaaattggattagaatgagaattcaggcccgagcgaccgggaggtgtcgtcctttggcagtggaaaacaaaaaaatcagcgagaactaggaaaatcagaaattcggcgaactaaaagtctaattagtaccctatagggtaccggagcgcaaatcatccgggcgcaaagtgccgaatatcgccactttaaggaaacgcacgatcaagggaaaggggaaggcgaaccgaaactcaagtcacagaacttccgatgaatttggttggaaaccatagtgatgggacagggctactgctgaaagatgaacaaaacgaaacgacccgaactcgcggatcatccctaattctattcccccggtgagccctattcggatgctataggagtctgtcaaatacatcgatggcgaaattccgaaaattcaggaggcccagtaacaaatcccggcttttacccaatcgccgaatgggaggggtcaacatactacgattgccaataacaaccgcatttggcatgagggacacgccattcgaagaatctagtctcagattagcctcgtgcgaacaatttccatatccccaacaggaggc

SEQ ID NO: 495366 - DNA, 1255 bp, Homo sapiens
  misc_feature (629)..(629): n is a, c, g, or t
agcggacaggactcctactctgccacgccccgtcgtagctcgtgtctgctcgacgcttcgtgggagatatcgctatcggacttatatatcctccaatagttggtgatagaaggatactgtacaagtcgtaccaacattacttccacgaggcacctggagtcccctggaaggagcctggagaaccaaatcactaagatttttactaaccgaaattagatctacccttgttcaatggcacgatggtgatggacgcgttgacagacaagtgattgtgattgtagacggagattggggtgtgtgttgccatagtaacagatacacaaggagggcctcggggagaggacgaagagggagagaacgccttgcgccgtacctatgtcagcgagccctcaggaaacgggaggtgagtcggacctcgactaggacgacgggaggtgactaaagagtaaagggtcctcccggaaagacgcgaaaagcaagtgcaccgcgttaaggggctcccgcatggcatagtatatacaggaccacgttcccttagtacatgggcagcgtagggtaaatctcgtctgaatggaggatgaaccgttaacctgctttaaaggctccctagagggccacgttgaaatgcnccgtatacgcagtacaccccatgtgtggaacccacatgcgaactcgcgtaagaactggggcaccccagttcgtaccctcggggcggcaccgcacaaattacaccatgggtaaccgtccgtgatgcctcgaaattcagaaacgttcccatcgcggggaacatcgccatgtggtgggaccgccccaggaacaacgctctggtggaacaccccactgggcagatctccgtgtaacaaggaaaccctggtatgggtgaaccttcggtgcgttaccctgtgggtggacctctgtgtcgccatcaaaaatcaccgctatgcaacgctaggggggaaagacatcgctttaggttacgcgtagttccacctccccaacagggcataaggtgctaaccagagaccatttcgcgatgaggaagccgagccctaggccgaaaattcccattgggaatccggaccttatacctctggaaaattggcaacgcgagagagttgtttgtcccaatggaggaaattccggtcgcacttaaattccgtaggggttaccgattggacaccccacatgtgggaaaaacccgcgacacgaaatcgcggttggtgaaaccttccctaaacccccgaagtggaaaccg

SEQ ID NO: 495367 - DNA, 257 bp, Homo sapiens
tcaggaggttccgtccgaataacgttaggtggtagtgttactggccttggacagctgtgcatatgtttgaatgagctagatccaaacgtggtcgtgcttaaatcaaaaatgggataatttttaatattgatgtattaatcacacagtgtgctctctgaagttctcttaagccttcagtttatactcttaattttctttctgagctggggaactgactttgcacttgggttacacagaacattggtttccaatttagt

SEQ ID NO: 495368 - DNA, 247 bp, Homo sapiens
ccatggtttgctgtttgttactcatattaatgctgtcataggcaatagggaacttggtattcacttataagaagtaacagcaggtgcagggcatggtggtgtgtacctgtagtcccaggcgcctagagaggctggggcaggagggtcacttgagctcaggagatcgaggctgcagcaagctgttaccttgccactgcactctgcctgggacacacagtgagaccctgtttgaggggaaaagaccctg

SEQ ID NO: 495369 - DNA, 489 bp, Homo sapiens
  misc_feature (36)..(36): n is a, c, g, or t
  misc_feature (41)..(41): n is a, c, g, or t
  misc_feature (484)..(484): n is a, c, g, or t
catattttttatcactggagcacgcgccggttccgncccgnaaaaaagcaagtagcgccccccccaatagagccgcgaggtcactcctttaagctccccgggcttatcatttgtagaatcgggatcgtaaacggtgttgcaacggtgaagcagattacactttctctcagggaatagtttagcccatgatagggatttaaggccccctcgccaagggaatgtggccctggagggcaagcattcggcacaagggatggattctccttggattatatatggaaggcctggtgggctttggtagggggttacataagccctactgaggccttaaaaaaaaccatcctctcccttcctacaaaatgaggacaagatccccttacaagggaggaggggtgccctttcccatggtgtccgcccccctgtgatgtgaatataaaccgcccaaggtagggaataaacctggccctcggtcttgtggtttgtntgcct

SEQ ID NO: 495370 - DNA, 153 bp, Homo sapiens
tgatcgcgggcacagcgatctctagcgatagtcagtagaattagaattgtgaacgatataagtgtagagggaaggttaactgtttgatattgctatggtggcgcttccaattcggtgcattattcggtagcccgcaatcaagcctggaaaggc

SEQ ID NO: 495371 - DNA, 1497 bp, Homo sapiens
gacgtgggcgtcgttaagccaagtggtgccacccggtcatccgggcacgcgtcccgggtcatcagtgacactggatgcggtgcgccgagattctgtctgagtatgcgcggcgccttatcctgtacgggtgcacagtgtagccacctttcaatgtgcgagccccgtcggccgaccggaccccgattggggagacttagttccccgtccttcgcttgctcactggcctgcgggaccgtctcagtgtgctggcttgggttgtgtgggctcgatctagccgcgcttgatggcgttctttctgattcgatgttgcttgacttcaatggtcggtcccttaggtgcgaaaggctgttcgcaggacccttggcccgcggataacgtcatccggttgagcctcagtcagttgcattgacgcggcccccgaatgggttggtgccggcgttttcattcttttcacaacggcttgaggttccaggttgggggccaactctttttacggcgccctggctcggtcgttagctttgggtccctgtgtagtatggatacagctttggcggccgagttcgctgtgggttggctatgtgacccgccaacggcgctcgcgttagaccgggctcaccgggagcctggtgtgcttatggaggcttcgccattggattggacttagttggggtaccctggcccgttttaccatgccgaccatcgggggtttggttgccaggttaggcgagcaagcggctcacagtttggactccagcggcaaggtggcacccttagggacactttgggagcttaacaccaactcttggggattggcaccctttggcccgttgatgagaagcacgcaacattatggcttacagaacgtaactttgggctgtgcaaaggattcccgcgtcaaaagttgccgcatagcttcaaccgttaggagggttagagagagagggtctaggcgcccaaagagcaattttgccgttggtcactttgagacacgcgcagaccgcgcctagcgcgggagatttgtgcccggcccatactcccaaagggcgacgctgcgaaatagtggactttcccgatctggcggttatgattcgcccgcttttggttcgcgctgggaccccactttgtctttggtaacggcggctacagaggggggcgttaggaccattagttcgccttgagaggggtgtattagcggggggggactcagtttgagtgttgtgtcgcccacagccccgctttagaagtgggtgcgcggccgagcatgaggcgattgtgacctgagaccccaaagctgtctggtgcggtcaacgccccggactgtgtgtttcgcgacggctggtcatttcgtttgagacagcttctgcccccctgtttgtgaccaggttgctcctgtaggaccgcccctttatagttgccctttgggtctctccatacgcccatgtggcactgtcgtgtgcgtatggccgcacgacgtcacagcgtgcggcaactccaggg

SEQ ID NO: 495372 - DNA, 160 bp, Homo sapiens
gagtgtgatcgggcgtcgagtagaatgggggaagaatggaagacagggagacgggataagagtctggagccctgtatgctaggagctctgtgatcttaaggtgaaatatttaacatgtgaaagcatctgtaaaatatgtctaataaatacccactgtctt

SEQ ID NO: 495373 - DNA, 392 bp, Homo sapiens
gctcggcctgttgtagcacaatcttggctcactacagatctctgcctcaggctcaaaggatccttccatctcagactcaggattagctgggacaacaggcacataccatcatgcccaggtaaattttgtattttattggtagagatgggatttcatcatgttgcctaggctggtctctaatttctaggctccagcgatccaccctcctcagcctcccagagtgctgggattacaagtgtgagccaccatgtgtggcctgaaattatattcttagtaactattgtcatcctacagtgatatagaaaactagaacttcttattcttatctagctgtaattttataacctttaacaaatctctccttatccatcccttctccctatcattcccag

SEQ ID NO: 495374 - DNA, 756 bp, Homo sapiens
  misc_feature (454)..(454): n is a, c, g, or t
  misc_feature (466)..(466): n is a, c, g, or t
  misc_feature (485)..(485): n is a, c, g, or t
  misc_feature (498)..(498): n is a, c, g, or t
  misc_feature (528)..(528): n is a, c, g, or t
  misc_feature (540)..(540): n is a, c, g, or t
  misc_feature (559)..(559): n is a, c, g, or t
  misc_feature (592)..(592): n is a, c, g, or t
  misc_feature (600)..(600): n is a, c, g, or t
  misc_feature (604)..(604): n is a, c, g, or t
  misc_feature (606)..(606): n is a, c, g, or t
  misc_feature (608)..(608): n is a, c, g, or t
  misc_feature (631)..(631): n is a, c, g, or t
  misc_feature (633)..(633): n is a, c, g, or t
  misc_feature (641)..(641): n is a, c, g, or t
gacacggctgtgcccacaggaacaatggacgaataccagttcgtgctgtgcccaagcacagacgctgcaagatcttcaacctcgtatcgcggcaaggaaagaacatctgtgggtctgacagcgacttcgtcatctgggatcaagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagtggttcactgacttctagtctgtgaaaatatgcattttatagtaatatgtatagacttatgttacttagaagatggcagacgtgcatgccgtcccaaggggcatgtacgatgggcctgtgtttgacctgaccaccacccccaaaggtggcacccccgcaggctntgctcggggctntcctactcggccgaacccncctgtgaggaatnttcatcagtcgggatttagcctgtcaggcncccaagtggatnagggggttcgctcagccancaagcgcatcgtggcgcccccaggcggccgttntaatatcncatntntnagttaagcaagccttcctcaaananaggggcanaagcaaaaaaagattgtttttaagccaaaatggtccccccatatttaaaaaggaaagaccaagatcataaatattaatggtgaaaaccctgtagtaataaactttcatatgccca

SEQ ID NO: 495375 - DNA, 96 bp, Homo sapiens
agcgacatcatggtattccccttactaaaaaaagtgtgtatctcggcggaggagcgtggaataaaagaggaaagaaggaaaaaaaaaagaattaaa

SEQ ID NO: 495376 - DNA, 115 bp, Homo sapiens
  misc_feature (20)..(20): n is a, c, g, or t
  misc_feature (66)..(66): n is a, c, g, or t
  misc_feature (82)..(82): n is a, c, g, or t
ccctttttacccaagcagcngcggtgtggagaagtaggtacattccgtttcctgtgacttaacganggaacattccacaacnccttcctttccattcattgcatccacaagggag

SEQ ID NO: 495377 - DNA, 166 bp, Homo sapiens
ttttttttatttaacttttttaatgggttttaaaattcttttacaaatttttggtcaagttgtttccattaaaaaggactgattttaaaactaataacttaaaactgccacacggaaaatggggaaccaaagtggtccacaagacattctcctttccttctgaggg

SEQ ID NO: 495378 - DNA, 140 bp, Homo sapiens
gtgtatacacagacacccgggttattaaaagaaaatgagattgtgagttctgttatggctcagtgggctaaggacctgatatagtgtccgtgaggatgagggtttaatccgtggcctcaggttaaggagtctcacggaga

SEQ ID NO: 495379 - DNA, 358 bp, Homo sapiens
catttcctctcctgtgtattgcctactcataaatctttccattttttttcttttttgtaattggggttgctctatttttctgctctattattggggttgatatgcaggacttccttttctttcctaggtcagggaccaggaagctatggccccctagatcaattctggcctgcctcctgtttctataaatcaagttgtattacagcacaatcacacccagccgggctcagtggttcatgcctgtaatcccagcactttgggaggctgaggcaggagactcacttgaacccaggaggtggaggttgcagtaagctgagatcacaccactgcactctagcctgggtgacagagtgagact

SEQ ID NO: 495380 - DNA, 1279 bp, Homo sapiens
tggggattctcaaatgctggctttattcttacacaatcctggtgacaaaattaatataaaaaaggtgagcatggctccagtcttttccctcttatctacaatacaaaagggtttggtctggaacaagtctgggtgttttttctctttttacaaatggtcccttagctggcgatcaacgggagtaacgatgggagaaaaagtctcaccatttacacaaaataatatttaggggagaaataaacaccgtttaaggcatctctctctccgccagttaaacggggggggtgaagtcccaaggtgcgggaagcttccttggggcgctcccttatttgtgcccacagagaaacttgtgcaggcggggccccccgggcggggcctctgggcgtgggcgccagtgggcaagaggggcgcgagctcccggcctccgggggccggctcagggtcctgagagggtattgggggtcagtaggctggaggttctcttccccggcgccccgggggcgagaggctgtaatacccgggacagactctggggtgagtcccccgaggggagccggcgcagaaaacgggggcgggtctgtggggacacacatggcctttagaaaaaaatctgcgcggggagggccgggggccaaaggtcccccccggggtagaacctgggtgtccccagcggcggcgggggtcgccacgctatcccacgttagcttcacgcgcagagaaggtgtcccacccaaaaccttttcgtggggggggatcctccccgggggggttggcgcccgtttgtagggcctttggtcccaggggcctcctttggcgcccccggggcgaatgtttttgtgagcacgccactcgcgccagaattacggggaacccggggaaaaaacaccgaggcaccggggccccccttattggcgggaggaccatttaacccccgaggaggggggccaagacagacgagagaacatgcctggagaaacatcacggagaggccaccgcgaaagtggccgaagatagactaagccactggagccggcataaaaaaatacccctagggggccccaaggttaagcgggaccccccttctttgtcaacaggggccccaaaggaggcgccaaaaaagcaggcgcgcgcccgtaaaacagctggcggggaaacacccgcgggcacttcggagagcacccgcgtgggcaacatgaaaccaccagagatgtccgggcaacacaaaaacgaaagtaggaaccaatgcggaagttagtacaaactacaaatagtactacaa

SEQ ID NO: 495381 - DNA, 966 bp, Homo sapiens
  misc_feature (1)..(1): n is a, c, g, or t
  misc_feature (120)..(120): n is a, c, g, or t
  misc_feature (122)..(123): n is a, c, g, or t
  misc_feature (125)..(126): n is a, c, g, or t
  misc_feature (128)..(130): n is a, c, g, or t
  misc_feature (132)..(132): n is a, c, g, or t
  misc_feature (135)..(135): n is a, c, g, or t
  misc_feature (137)..(138): n is a, c, g, or t
  misc_feature (141)..(141): n is a, c, g, or t
  misc_feature (143)..(144): n is a, c, g, or t
  misc_feature (148)..(148): n is a, c, g, or t
  misc_feature (159)..(159): n is a, c, g, or t
  misc_feature (165)..(165): n is a, c, g, or t
  misc_feature (180)..(180): n is a, c, g, or t
  misc_feature (189)..(189): n is a, c, g, or t
  misc_feature (191)..(191): n is a, c, g, or t
  misc_feature (203)..(203): n is a, c, g, or t
  misc_feature (212)..(213): n is a, c, g, or t
  misc_feature (215)..(215): n is a, c, g, or t
  misc_feature (219)..(219): n is a, c, g, or t
  misc_feature (233)..(233): n is a, c, g, or t
  misc_feature (250)..(250): n is a, c, g, or t
  misc_feature (259)..(259): n is a, c, g, or t
  misc_feature (284)..(284): n is a, c, g, or t
  misc_feature (311)..(311): n is a, c, g, or t
  misc_feature (314)..(314): n is a, c, g, or t
  misc_feature (318)..(318): n is a, c, g, or t
  misc_feature (321)..(323): n is a, c, g, or t
  misc_feature (333)..(333): n is a, c, g, or t
  misc_feature (338)..(338): n is a, c, g, or t
  misc_feature (348)..(348): n is a, c, g, or t
  misc_feature (359)..(360): n is a, c, g, or t
  misc_feature (363)..(363): n is a, c, g, or t
  misc_feature (368)..(368): n is a, c, g, or t
  misc_feature (373)..(374): n is a, c, g, or t
  misc_feature (376)..(376): n is a, c, g, or t
  misc_feature (383)..(384): n is a, c, g, or t
  misc_feature (429)..(429): n is a, c, g, or t
  misc_feature (434)..(434): n is a, c, g, or t
  misc_feature (467)..(467): n is a, c, g, or t
  misc_feature (535)..(535): n is a, c, g, or t
  misc_feature (581)..(581): n is a, c, g, or t
  misc_feature (679)..(679): n is a, c, g, or t
  misc_feature (694)..(694): n is a, c, g, or t
  misc_feature (696)..(697): n is a, c, g, or t
  misc_feature (782)..(782): n is a, c, g, or t
  misc_feature (788)..(788): n is a, c, g, or t
  misc_feature (790)..(790): n is a, c, g, or t
  misc_feature (792)..(795): n is a, c, g, or t
  misc_feature (798)..(798): n is a, c, g, or t
  misc_feature (800)..(800): n is a, c, g, or t
  misc_feature (873)..(873): n is a, c, g, or t
  misc_feature (920)..(920): n is a, c, g, or t
naattcccgggatcgctcatatagcggctcccgggggcgcagggaccgtgctccgccgtctccgccgcatcttccaccctcgccgccgccgcagctccccgcgctcgtgccaccgccgcngnntnnannntnaangnnaangnnatgngggaaaaagtnaaaatnaaggaaggaaaatgnggaaaaaananaggggaaaagtnttgggaggnnanaaanaaaaaaaatggaanaaaaaaaaaaggaaaanaaaatgggnaaagtaaaataaaaatggaaagganaaaagtgaaaaaaaaaaaggaaaaaanagnaaanaannnaaaaaaaaangtganggtaaaaatngaaaaaggaannatngaatntgtanntnatggaannttaggtaaaatatttaggaaggaaaaattagtgtttggccaatanggagnaggaaaaaactgcggcaaaggcgcgcactacanggagggcgcagagctggtggcacgctgtcctggacgtagtcggaaggaggccgagagctgcgactgcnttcagggcttccagctgacccactcgctgggggggtggcacggggnccggaatgggcacgctgctcatcagtaagatccgcgaggagttcccagaccgcatcatgaacaccttcagcgtggtgccctcgcccaaagtgtcaganacggggggggggggngnnaacgccacgctgtctgtgcaccagctggtggagaatacggatgagacatactgcatcgacaacgaggcactctacgacatctgtntccgcncncnnnngcngnccacccccacctacggggactcaaccacctggtgtcggccacatgagcggggtcacacctgcctgcgcttccngggcagctgaacgccgactgcgcaactggcccgtcaacatggttccntttctcgcctgcacttcttcatgcccggcttcgcaccctgaacagc

SEQ ID NO: 495382 - DNA, 370 bp, Homo sapiens
ttttattaattctttaaaaatcaccctattacttatagagattaattatcctcattctcgattaccctcatacatgtcttatgtttgattctgtatattaaattctgtgaatcattatttaatcaaatctactaaagattagaaaaaattctagcaagacttataatcattgaaatacagaattaaaagtttatacctacctaaaagtcctatggcctattatttagctgtgaattagacacgtcaggagttataaatctgcacttttagaactgtatattaaatatgctaattgcaggaagcgaaatagtgaaggaatactggggttagtaaaagattaatttaatatataaaatttatggaaaaagga

SEQ ID NO: 495383 - DNA, 310 bp, Homo sapiens
tcgtttatactggggtctcactctgtcgccgagccgggagtgcagtagcgtggttatagcttactgccatcacaccatccagctaaatcttcggctttaagggtgtgtattctaatagaattttactggttcttcggaattggacttacataccctaatttccacttatgcttctcctttcttggcctcctaaaagtgagtagcatgattttagcttacaattagttgattcgtacggttctcagctaatttggatgttatgatcagccaggcatggtggttcacacctgtagtcctagcactgtgctcg

SEQ ID NO: 495384 - DNA, 209 bp, Homo sapiens
cggcgcccagccctatctctgcatcttcaagtattttttgcaagtagtatagttcaacactacccaggggtagggtataaatgataaaaatatactcactatatgaacatacactgtatatcaagaattcatacataatatcaggggctggtattctatacatttatcccttaaaatatttcacaggtcatgcacattaatgcaaagcc

SEQ ID NO: 495385 - DNA, 867 bp, Homo sapiens
gggtttttccccccaccacgctttttgacccaccgcacagaaaccattggcgcccctctgcgtcgtggttgaaccctcctgcgggcgggatgtttttacagacctcactgcacctgcgttcgtggggacccacaacaagcctcatgctggttcgccgttcttgtggtttatttctttgtagtcgccagacgcacgccaatgacacccgctgcaggtgggtacaggaccacctttttgtctgcaccacaacgcaccgccgaggtggtgtgattcccggcggggccagcacatttgttttccaattcgctgcccccgcgcgtttgatcaattcctcctcttatgagtttgttcgtccgtcgcgagctaccctactttgcttggtgagtgctctcttctccacccgtggctcgactagtatagtactctctcttcttcgatgaggagttcgccattctgtttgttgtctactacacactaaatatgattttttgagttgagttctttttacaaaaccacctcttaatatactgtgctgctgacccccacctccttctatactccatcctggtggaaaaaatctttcgtctgctgtatgaaaacaacaaggctgtttcttgctacaacaaataacaattctctcctcctactaccagccgcgggccaacataatctttttcaccacaccccataatcactcttcttaaaaagtttgtaccaccacaccaacacaatgcgggggttcctccccccccccccccctcacaacaacccctttttccccgaccacaccccctttttttaccctccctttcccccttttccttcttttcccccccccccccaacttttccgggtttttttttttta

SEQ ID NO: 495386 - DNA, 786 bp, Homo sapiens
  misc_feature (419)..(419): n is a, c, g, or t
ggggggccacgtttgcgtccgcgccatcaggcccgagatagcggggaggtccgtttttcagtgtatggttttccctgccaaacggttctagtcttggtgccatcctatggagggcgtgcagcatgaggatcttttcctagccggcacttggcttgccgagcctgagaccagaatggctgcatggctagttgcgatcggattcagcccgaggagaaggcagcgcattgggcacagttcgtctttgcccgggactgctataggctaggcaattggctggtctgtctgatgataaggaagattatgttgcgggacgcaaagattggaaatatacccattggaactcactatttccgtgttggcgataacgaactagcagaagagggatagaagcccgagtgtcttgcaaatatggatctcantcggaatccttacccgaatgttcaagcttgtatacatctctcagtcaacggaggactatagcatgtgcgttgcgtgcgtggaatccgtggagctgcaatgttggagacttgactatatttgaagactagttgaccaggtcgtggttcaattccagaattctttcatattagtgaccacagaaagtgtagcaagcgaagaatgggaaacacaagtcagaagctttaaggatgagtggactcggtggatatgttcatacggaattgggcactttgagggaaggcttcctaataagcccattggtgtaggccctagggatttgcattagagcggtttgaaatgtgatctatctccattaaacttgggtta

SEQ ID NO: 495387 - DNA, 351 bp, Homo sapiens
gaagggatgaacgtctaaggcagaatagggaattaggataaccacgggttaaggcacaagcataagaacagcaggggcagccacttctaggcaacattaggcagcatccaggccacatcctccctcctataataacaagacagaagtttccacttcagcctctgattggtcatgggctgtctccacttcagcctctgattggtcctgggctgtctccacttcagcctctgattggtcacagggccacccttcatagggtgtagccaattagaggcctctaaagggcacctgaggtgttgccaaattattctagcttaataaaaacctcagttggggtgctcttgaccactt

SEQ ID NO: 495388 - DNA, 266 bp, Homo sapiens
  misc_feature (15)..(15): n is a, c, g, or t
  misc_feature (46)..(46): n is a, c, g, or t
  misc_feature (106)..(106): n is a, c, g, or t
  misc_feature (121)..(121): n is a, c, g, or t
  misc_feature (129)..(129): n is a, c, g, or t
  misc_feature (183)..(183): n is a, c, g, or t
  misc_feature (245)..(245): n is a, c, g, or t
gattgcaggcatganccactgcgcccagtcgagtggtaatatgttnaaaggaaacctttttctgagcaggtctcaaaagagaggttaaaatactgagtagaccatnctgtaaacagatgtnctgttatncgggctttcatattccatttataaagcacaggcagagctcagagtagatttaangtaactctgaagggcactaggattttcagaatggtaaataagcattggcttcaccttaaatncaaatctgcattgggcttgta

SEQ ID NO: 495389 - DNA, 133 bp, Homo sapiens
  misc_feature (44)..(44): n is a, c, g, or t
tactttccacagggtctgagaaggcacacagtcgtttcttcccnttctgtcagacataattcctcggtttggccttctgacctctatatagtctgataatggaccggccttcattagtcaggtcacgtaagca

SEQ ID NO: 495390 - DNA, 387 bp, Homo sapiens
tcccgacagaccaacagccatagttagggtcaattttacacccaaggccagcaggaagtagttggaggataagacccctgccctagtgccaaaaacttgtcattgttgttttgtcaaaggggaaaaggggagtttaaggaaggattcccaggtgggggagggtcccctgtggggagaaacaataaccagttttttttaaaaaagggctaatcacaaacaacccatggtcacagtgcccttgttccacaaatagccccctccagcatgaccctataaattttccctccagtccctcattttttggcaaaaagccccttttttattgtactgtttgttgtaaccttgcaatgtatttaaaactttttttagtaaatctcccttgcttta

SEQ ID NO: 495391 - DNA, 1000 bp, Homo sapiens
  misc_feature (296)..(296): n is a, c, g, or t
  misc_feature (391)..(391): n is a, c, g, or t
  misc_feature (840)..(840): n is a, c, g, or t
gctgatgcaggcgctcttagctcggagcgggccgatggagaatccggtggaggaacgcgccggcgatgctaccatcatgtcctgggcacttacaggaaggcttcggctgcttgttcaccaaccgattcgatgcagttatttgacgtacgaatcaggaccccgttcgaggtgcgtgaaggctagtcagagaacacatgaaaataagatagcccggcaggaggagcggcgttgaggggccacttggagagccttagatgagcagctaggctctaggccgatggggcctatacctatgnttcctaatcgctggctagtgtcaaatacatgcatgcagcgaacggaagtcccgaaaaaggaccgggagagtaacccgagtgtgccagcgcattgngcgtttggacagctgtgttgatctagatgcaaaggagcgaggaccgacatactcgagcacgtgaggcagcgttaccagagagacgaacgcgtacactaaggaacgtagctctggaaaggaacgtaccgtgtatcggacatgggtgtctagcgggatgcacatggggggagaagacttaccttgtggaactacgcattcgcatcacgaggcactaatgggagacttgcatcacaatcgtctcgtccacgcagttgtatagtggcgcaccaaaagttccccacgtttgtacaggtagaccattcgtgctagagatgcaagggcagacagttgggtccggcatttagaaagtacggaaaggggaattgatattggggaaaaaggaaccttaatctcggtgggggttccaataggggctggaggtggatgtgcgaagagcaagaggatgggangaggaggaacacggttgagaacggatgggtgtattttagggttaaagacagaggaagaggcattgggagattcataggattttctccgaagtggcataaaaatagttgacaagatagttggcataggagaaaataaggtgtgtgtacaagtgttcgagtt

SEQ ID NO: 495392 - DNA, 251 bp, Homo sapiens
aaaatttttcaggggggggcccccccaaagccaaaccttggggtgggttttttccctttaaaaaatttggataaaactggaagggggggggggggggcctgggggccccttttattaaaaaaaagccttttattgttaaaaaaggggaggttaattttcccttatggttgggggggaaaggtttaagctgggatttttttttaaaatggtaaacccttaattttttataaaaaactattttgggtttttga

SEQ ID NO: 495393 - DNA, 222 bp, Homo sapiens
atcttgctcgtcgcccaagctggtagtgcactgccacgatggcggctcatggcaactcagccaacccctcaagtgatcctcctgcctcagcctcctgagtagctgggagtgcaggtgtgcgccaccattcccagctaattaaaaatttttttttggtagagagagggtctccctatgttgctcaggctggtctcaaactcctgggctcaagtgatcctcctg

SEQ ID NO: 495394 - DNA, 238 bp, Homo sapiens
tttggggggggggggggggggggggtgggtcccccccccccaaaatggtttttggccatcgggggggttgtttaaaaaccattaagggtttcctttcccagaacttttttttttttcctttttttcccggaaaaagtttatgaattttttcgtcccaacccaagattttgggaaaagggaaaaaaaaaaagtttattaattttttttgggcctttttttaaaaatttaggggtttcca

SEQ ID NO: 495395 - DNA, 640 bp, Homo sapiens
  misc_feature (436)..(436): n is a, c, g, or t
gaccttagctgctgaatcagctttctggttactatgggcaacagccttgttttctttttgatgtcctttgcagtggatcacagctacctgctgagccactcccctgcttctcaccttgaacacagatggcagctcttcccatcattccaaaccttggggattgtccagccaaattttcttcagacaccatagcttcacccgccctcttcagggagaagatgcaagggcagctgagatctttggaagcccaaatctggcctctctttggggtggactgagagtgggaactcgactctcttttccaagtgtcatgtttatcttgttcatcgttatattacctccagtgcctggcacatagtaggcactacagactggcacatcgtaggtgctattagtgtctgtataatgggactcttgaggttgaagcaattagcanaaacctgccaagcaaaaggatggaaaactgaccaccaagaaagaaagaaagaaagaaagaaagcaattgtggctttgagctctaaacgcataaggcaagggccccagtttgggcaattttaatacaacagccattttgctccaaacaaactggcactggaaacttcctctgcctcttgacaaccggttctctttctctgtgggc

SEQ ID NO: 495396 - DNA, 483 bp, Homo sapiens
gaactgggactaccactctttgcagttcccaatgttttccatgaatgatgcaattcatgtacaagttgttaggtaaaacatcggtgagtttgcaaattaggtactattaccttatttctgtattatgtagaaaatcaggagccatgccctctagttcctttcagcttaggctacactgcaaatgatactgatgacttcaacaatgatgatgaaaaatgaagacagtgggtccagaagaaaacaacaaagaacattaaaaggaatcacttttccttcctgtatgttttcatgaagatatgagagcactgaagaatagcaattgcagagtgactgaggatggtggattcagttggggcaagataaagtttgtaacacttctattgattcttcatcggtgacttgttaacagacaaatggaaaatgtcttcttattagatagggacctggaagggtccataaataaataatttgtctttgaaacgc

SEQ ID NO: 495397 - DNA, 965 bp, Homo sapiens
agaagaactacggctaagagagtctgggtttcatcggagaggcatgagccagctgtttacacctgcctgtgctggtagttggagtgccgggagagtggtcctgtagcctgtgccgccctgccccgccatggggctcctgtcggaccctggttcgccggcgcgcgctctgcccggcctagtgctgcgcctcaactgcgccgttgtgctgtgctgagctacgtggctgggcatcagcctggtacttggctgctggttttaccctgcctgctgacccagctgcacttacattgtcggagaacgccatgggctccaccatggtggagtgatgcagttatgcgggcgggagaccgtgcccgggcttttgccctgtggacttcgccgcccaccgcaagaatgtcggtgggctctgccagtgtgcctggcttgaacgtgacgatgcgtgtcatatagggctgggaggtctacacgcagagattatctcccggaaactgcccttcccagaatgagacccacgagctgctatatggtgtcgtggcaccaaacgtgtacggcaatcctgcggggcccggcgatgctgccagcaccgagtcgcttgtgcataaccgatgccctgtggctctgactctaccaacagccaggctgtggggctgctgctggcactggctgaccacttccgggggcagatatattgggccaaaagatatcgtcttccatggtaacagacaccatgaccgtactgggcactgaggcttggttgaagcctacaaagaatgtcatgtcactggcattgcaagtcgtatcctctagctggcgagctgaggcattcaggaagccgttgacctgactgagcttagattgtcacaacccaaagtgcggggggttacggaagctcacatgcggatatatacaacttcaagtgtgttgcacatgagccagcgagaaatgtgcgcaggaaaattacattg

SEQ ID NO: 495398 - DNA, 955 bp, Homo sapiens
  misc_feature (8)..(8): n is a, c, g, or t
  misc_feature (45)..(45): n is a, c, g, or t
  misc_feature (55)..(55): n is a, c, g, or t
  misc_feature (193)..(193): n is a, c, g, or t
  misc_feature (244)..(244): n is a, c, g, or t
  misc_feature (255)..(255): n is a, c, g, or t
  misc_feature (270)..(270): n is a, c, g, or t
  misc_feature (273)..(273): n is a, c, g, or t
  misc_feature (288)..(288): n is a, c, g, or t
  misc_feature (290)..(290): n is a, c, g, or t
  misc_feature (335)..(335): n is a, c, g, or t
  misc_feature (343)..(343): n is a, c, g, or t
  misc_feature (357)..(357): n is a, c, g, or t
  misc_feature (372)..(372): n is a, c, g, or t
  misc_feature (382)..(383): n is a, c, g, or t
  misc_feature (401)..(401): n is a, c, g, or t
  misc_feature (422)..(423): n is a, c, g, or t
  misc_feature (486)..(486): n is a, c, g, or t
  misc_feature (491)..(491): n is a, c, g, or t
  misc_feature (503)..(503): n is a, c, g, or t
  misc_feature (508)..(508): n is a, c, g, or t
  misc_feature (535)..(535): n is a, c, g, or t
  misc_feature (556)..(556): n is a, c, g, or t
  misc_feature (559)..(559): n is a, c, g, or t
  misc_feature (561)..(561): n is a, c, g, or t
  misc_feature (566)..(566): n is a, c, g, or t
  misc_feature (572)..(572): n is a, c, g, or t
  misc_feature (576)..(576): n is a, c, g, or t
  misc_feature (579)..(579): n is a, c, g, or t
  misc_feature (597)..(597): n is a, c, g, or t
  misc_feature (603)..(603): n is a, c, g, or t
  misc_feature (605)..(605): n is a, c, g, or t
  misc_feature (612)..(612): n is a, c, g, or t
  misc_feature (622)..(622): n is a, c, g, or t
  misc_feature (632)..(633): n is a, c, g, or t
  misc_feature (638)..(638): n is a, c, g, or t
  misc_feature (651)..(651): n is a, c, g, or t
  misc_feature (654)..(655): n is a, c, g, or t
  misc_feature (665)..(665): n is a, c, g, or t
  misc_feature (675)..(675): n is a, c, g, or t
  misc_feature (678)..(678): n is a, c, g, or t
  misc_feature (696)..(696): n is a, c, g, or t
  misc_feature (805)..(805): n is a, c, g, or t
  misc_feature (810)..(810): n is a, c, g, or t
  misc_feature (817)..(817): n is a, c, g, or t
  misc_feature (822)..(822): n is a, c, g, or t
  misc_feature (862)..(862): n is a, c, g, or t
  misc_feature (876)..(876): n is a, c, g, or t
  misc_feature (933)..(933): n is a, c, g, or t
agcctgangccccagcccacaccttcaccagggcccaggagccancatgtggcantgtccactggggctactgctgttgctgccgctggctggccacttggctctgggtgcccagcagggtcgtgggcgccgggagctagcaccgggtctgcacctgcggggcatccgggacgcgggaggccggtactgccangagcaggacctgtgctgccgcggccgtgccgacgactgtgccctgccctanttgggcgccanatgttactgtgaccnctnctgcaaccgcacggncnccgactgctgccctgacttctgggacttctgcctcggcgtgccancccctttncccccgatccaagnatgtatgcatggagntcgtatctannccagtattgggaacgtanatgggacaactgtaaccgttnnacctgccaggagaacaggcagtggcagtgtgaccaagaaccatgccttggttgggttcccagnacatngatacaatagcncatcnaactcaggggcaacttattggctcggncaggcttggggaaccaacagncgncnttttngggggncatnganccccgggatggaggggcntttcgntnaccggcntggggcaccnacccgccctnntttcnttcggttctaagnaannagctatgtanttttatacantgntgaacccaggggaggtgnttcccacagccttcgaggcctctgagaagtggcccaacctgattcatgagcctcttgaccaaggcaactgtgcaggctcctgggccttctccacagcagctgtggcatncgatngtgtctnaatcnattctctggacacaataacgcctttcctttgccccagaanccttctgtcttgtnacacccaccagcagcagggctgccgcggtgggcgtctcgatggtgcctggtggttcntgcgtcgcgaagggtggtgtct

SEQ ID NO: 495399 - DNA, 370 bp, Homo sapiens
  misc_feature (2)..(2): n is a, c, g, or t
gnttccgtcaaaagaccaagacgaccccggccaacacagcgaaaccccgtctccaccaaatacacaaaaaagcagccggacatggtgggggggtgcccgcagtcccagccacccggtaggccgaggcaggagaatggcacgaacccgggaggcagaacttgcagtgagccgaaaccacaccactgcactctgcactccagcctgggcgacagagcgagaccccgtcccaaaaaaaaaaaaaggcctatcctccctaagcttcaagccgtggtttttcccacattaatagacaaacccaggaaaaggagctgttccccctcgggcttttgatgggcctcaataagacctgccaaaagccggggcggcattg

SEQ ID NO: 495400 - DNA, 914 bp, Homo sapiens
  misc_feature (8)..(8): n is a, c, g, or t
  misc_feature (45)..(45): n is a, c, g, or t
  misc_feature (55)..(55): n is a, c, g, or t
  misc_feature (193)..(193): n is a, c, g, or t
  misc_feature (244)..(244): n is a, c, g, or t
  misc_feature (255)..(255): n is a, c, g, or t
  misc_feature (270)..(270): n is a, c, g, or t
  misc_feature (273)..(273): n is a, c, g, or t
  misc_feature (288)..(288): n is a, c, g, or t
  misc_feature (290)..(290): n is a, c, g, or t
  misc_feature (335)..(335): n is a, c, g, or t
  misc_feature (343)..(343): n is a, c, g, or t
  misc_feature (357)..(357): n is a, c, g, or t
  misc_feature (372)..(372): n is a, c, g, or t
  misc_feature (382)..(383): n is a, c, g, or t
  misc_feature (401)..(401): n is a, c, g, or t
  misc_feature (422)..(423): n is a, c, g, or t
  misc_feature (483)..(483): n is a, c, g, or t
  misc_feature (488)..(488): n is a, c, g, or t
  misc_feature (495)..(495): n is a, c, g, or t
  misc_feature (498)..(498): n is a, c, g, or t
  misc_feature (520)..(520): n is a, c, g, or t
  misc_feature (534)..(534): n is a, c, g, or t
  misc_feature (554)..(554): n is a, c, g, or t
  misc_feature (587)..(587): n is a, c, g, or t
  misc_feature (634)..(634): n is a, c, g, or t
  misc_feature (637)..(637): n is a, c, g, or t
  misc_feature (655)..(655): n is a, c, g, or t
  misc_feature (764)..(764): n is a, c, g, or t
  misc_feature (769)..(769): n is a, c, g, or t
  misc_feature (776)..(776): n is a, c, g, or t
  misc_feature (781)..(781): n is a, c, g, or t
  misc_feature (821)..(821): n is a, c, g, or t
  misc_feature (835)..(835): n is a, c, g, or t
  misc_feature (892)..(892): n is a, c, g, or t
agcctgangccccagcccacaccttcaccagggcccaggagccancatgtggcantgtccactggggctactgctgttgctgccgctggctggccacttggctctgggtgcccagcagggtcgtgggcgccgggagctagcaccgggtctgcacctgcggggcatccgggacgcgggaggccggtactgccangagcaggacctgtgctgccgcggccgtgccgacgactgtgccctgccctanttgggcgccanatgttactgtgaccnctnctgcaaccgcacggncnccgactgctgccctgacttctgggacttctgcctcggcgtgccancccctttncccccgatccaagnatgtatgcatggagntcgtatctannccagtattgggaacgtanatgggacaactgtaaccgttnnacctgccaggagaacaggcagtggcagtgtgaccaagaaccatgcctggtggatccaganatganaaaaganatnaacaagggaaactatagctggnaggctgggaaccanagcgccttctggggcatgancctgaatgagggcattcgctaccgcctgggcancatccgcccatcttcctcggtcatgaacatgcatgaaatttatacantgntgaacccaggggaggtgnttcccacagccttcgaggcctctgagaagtggcccaacctgattcatgagcctcttgaccaaggcaactgtgcaggctcctgggccttctccacagcagctgtggcatncgatngtgtctnaatcnattctctggacacaataacgcctttcctttgccccagaanccttctgtcttgtnacacccaccagcagcagggctgccgcggtgggcgtctcgatggtgcctggtggttcntgcgtcgcgaagggtggtgtct

SEQ ID NO: 495401 - DNA, 194 bp, Homo sapiens
ctgacaccaaaataggagattactgctgtataccttacaaaaccaaatgtaattacattatcttggtaaattaattagaagtatggaaagtacgataaggccttctgtaagacaacacaaaattaatattcaggaagctgtttgaatcatgagcgttgctgtcttgaaaatgaacacccttctgtcgtcttctc

SEQ ID NO: 495402 - DNA, 225 bp, Homo sapiens
  misc_feature (162)..(162): n is a, c, g, or t
cgctgggtgatctagaggatccgactgatctgtgctctagagtctaatttcctttatttttttttgagaagtgtttgtctgtactcaagcagtggatgatgaggcttgactcctgggtcaagcaatcgtccatgttagctgggacacaggtatgcgccacgnatctggttaatttttaaatgttttctgtagagatggggtctcggcagagggacagattggagt

SEQ ID NO: 495403 - DNA, 223 bp, Homo sapiens
gtaaatcatttaccttatcttagaaattaccaggttggataattactatatgagttcgtgtcttggttggaataaccatttgcttatattaagtaaaagttcagctgaagtgacaatcaacctttaatcttgtcaagcttctgtgtgagatattttctatctctaacatgcctaacatgcatattatactgagtttgtttgcatgcgagttctgtgccccttt

SEQ ID NO: 495404 - DNA, 231 bp, Homo sapiens
gggtcatccagaggttacttatcgtgttgcaccgcgagcttctatcacaaactggaggtacttcttcaaggtccacccgtgctggccagctgtccagaagggggatcgctgaggaggcagatggagaatgagcccccagttccaggtggccatcatatgcaggctttccggaacagtccttttcttccaggcccggagatccaaccttttttaaacacaaatctccttctt

SEQ ID NO: 495405 - DNA, 93 bp, Homo sapiens
agccccaaccagacctctctgtacttctgtgccagctctggactaggcaacaatgagcagttcttcgggccagggacacggctcaccgtgcta

SEQ ID NO: 495406 - DNA, 120 bp, Homo sapiens
caggagatggcagtctcactctggtccacccagtgctggagttaggctggcacgcatcttgactcgctgcaacctcctactcccaggtacaagcgatactcctgcctcagcctcccaagt

SEQ ID NO: 495407 - DNA, 386 bp, Homo sapiens
agctcccctgtatatgtatggatctgagtttatatatcacagtgagaattctattatggaccatgtcacgaacaatgccacagggatacaatattatggagaagtagtctagcttatagaagcttagggagagctgggttgtttgggttgtgactcagtgtcagttcgagataataacttcttggtctacggcacataatacttgttgtggggaagagactgataaataacaggtggatgcgacaaatggattctcccatcatgcggggtctgagtttaatattgttagggttaacgagggtggctaaggatggcggggaattagggaagctcagggttagggtggtcatagtactgtgcatggttatggataggccgcatctatt

SEQ ID NO: 495408 - DNA, 760 bp, Homo sapiens
cttagatggtgctctggttctggaggtcgatgagagggaccaagatgacgaggaagccaggcgtgagatggcaaggattctgaaggaacttaagcagaagcctaagtcagcagcaaaagagccgagcattttaccgaattcaagctactcgcctgatgactggagctggtaacattttgaagaggcatgcagctgaccaagcgaggaaggctgtcagcatgcatgaagtcaacatggatgtggttgaaaatgacccagtcagtaaggtcttctttgagcaagggacataccagtgtctagaaaactgtggtactgtggccctcaccattattcgaagagggggtgacttgaccaacactgtgtttgttgacttcaggacggaagatggcacagccaatgctgggtctgattatgagttcacggaagggactgtgattttcaaacctggggagacccagaaggaaatcagagttggcatcattgatgatgatatctttgaagaagatgaaaactttcttgtgcatcttagcaacgtcagggtctcttcagaagtctcggaagatggcatactagactccaatcacgtgtctcggattgcttgtctcgggtcacccaacactgccaccataaccatttttgatgatgaccacgcgggcatctttactttcgaggaacccgtgactcacgtgagcgagagcattggcatcatggaggtgaaggtgctgagaacctcaggagctcgaggaaatgttatcgttcc

SEQ ID NO: 495409 - DNA, 458 bp, Homo sapiens
aaccccatgaaagcggaaactctctggttgtttactactgactgagtctctggaacctagaacagtgcttggcatatagtaggtattcagtgaatttttattgatagacagtttgagtgaaatggatggcaataggactgttttatttatttctatttaaacatggtttgtaggagcatcatcaggaaatattagggtcaaattttccattggtttattataattacaaagatttataactttgtcataatggaaaaatttataaactactatgttccttacagtatttaaataagctattacctaaactttttgttacttatgcacctacatcattaaaatcagaataatgtttttgaaaatacatattttaaaatacagcagctcacaaaaatctgatgtggttatggttatatagctttatgtttagatctcaaactgttaataattcacaatga

SEQ ID NO: 495410 - DNA, 421 bp, Homo sapiens
ggccgggggcgaggctgggggaaacggggcccaaatacggaacccgggagttacaggggccgacgggaggtcgcttctctggggcccagctcccttcctgggctgagacaagctctgggggtggcgggggcccccacacgcggctcccgctccaccctgcccggggggctgctctgggcccgcgggcagagccctggtgggggaggatgtggcccccctgagacccggaggagacgggcgtctgcctgggtttgcggagagccgcttatgggtgtgggccggccagacaccttgtttcaagggggaagggcgtgagcgggccaacaaagcaaccccaccgctgagcaagaactttttcttgtttttaaaccaccacgtcctcatttcacattggaataaagtgagtttttgaaacctgcga

SEQ ID NO: 495411 - DNA, 480 bp, Homo sapiens
tggtaatactatgactcttaccaaagtgtgcagctggctgcagtctgcattctggcttcacaagtgtggctgagatttaactctagactaggtagtcagccacatatacagctttatcgatcttaaataatcagtgaacagcattgccatatattacaataaatgtaatcagcgcacacttatgtgtaatatttcaagtgccctaaaagtcaggctttgcctccagcgaaggggctacctcatgctggaatcaaaatttggcccaggcaggtacaatcctactgtagtgtcaggtagctatgccgtcagatcgtttgagtttgacactaggggctgtgatgaactctggggtaagattatatgatgtatgtgtagaatttgaacgttcaattactacaccaaatgtctgaacctgcggatcttctcgtactgagcaggattaccatggcaaaaacacatcatcagtagggtaaactaacc

SEQ ID NO: 495412 - DNA, 548 bp, Homo sapiens
caaaaaggaggaagtgatctagtagtaaagatttgctaaggaactatatctaataaaaaacaaaacaagccagacagaaaatactgaaataaataactaattcttcaatgcaaatactagaataaataactaatccttcagtgcaaaaaccatgacctttccaaagagacagagcaacaattcagtcactagccttaagtgatgatttgtaagatctgtgacctagcattcaaaatggcaattttaaggaaactcagtgatcaccatcataacaaagaagagcaattcagaaatttatcagagaagtttagcaaagattgaaataacaaaaaattaaatggaaattttagaactaaagaatacctttcctgaacagaagacttcattaaaggctctcaacagtagaatggactaaacagaggaaaaaaaaaatcagtgagttcaaagactgtctgaaaatacacagagaagtctgggtgtggtggctcatgcctgtaatcccagcactttaggaggccaaggtgggtggatcacttgaggtcaggagt

SEQ ID NO: 495413 - DNA, 121 bp, Homo sapiens
ggagcccgccctcaagaactccccagtcgggatcagccccacagccaaagcgcacccaaagcacatcaccatagcccagcacgcagctggtcttcctagagggccgcaagaagcagctcct

SEQ ID NO: 495414 - DNA, 109 bp, Homo sapiens
atgatgagggggcccctaaacccagtagctcacccctattcatgcattgacctcttcaactgcattgcagcgagtagagatggtgaaaggtcacgggaggtttagaaga

SEQ ID NO: 495415 - DNA, 844 bp, Homo sapiens
agcatacatcattattctcgcacggactacaaccacgacaatgatatgaaaaaccatcgttgtatttcaactacaagaacaccaatgaccccaatacgcaaaattaaccccctaataaaattaattaaccgctcattcatcgacctccccaccccatccaacatctccgcatgatgaaacttcggctcactccttggcgcctgctgatcctccaaatcaccacaggactattcctagccatgcactactcatcagacggccgtcaaccgccgttctctatcaattcgtcgacatacactcgagcacgtacgttatggctggctgatctcgaccacgttccacttcacgccaatggcgccatcaattattctgtatctgcctcttcctacacactcgggcgaggcctatatacggatcatttctctactcagaaacctgaaacatcggcatgatcctcctgctgcaactatagcaccagcctccataggctatgtcctcccgtgaggcaaatatcatccctgagggcaccagtaatcacaaacttactatccgcatcccatacatggggcagacctaagctcaatgaatctgaggagggcactcacatagaccagcccacccttaacaagaattcttagccttccacttcatactgggccttaattacctggagcctagaagaactcacctcataattttgacgaagggatcaaaaaccctaggaattcacctcccttagaaaaatccttcacctatacaaacaaaagcccggtaaaaccactcctcctaggaacactattacagctaggacacacatacccacaactaaccccatcccagatta

SEQ ID NO: 495416 - DNA, 126 bp, Homo sapiens
tcgttacaccgctaggcaacacctgctagtgtaacacccctgctactggaacaccccgctacggaacacctgtacggtgggcaagtctctgatcgagcacccgtgacgttaggcggagcgcccgcg

SEQ ID NO: 495417 - DNA, 305 bp, Homo sapiens
  misc_feature (22)..(22): n is a, c, g, or t
  misc_feature (39)..(39): n is a, c, g, or t
  misc_feature (53)..(53): n is a, c, g, or t
  misc_feature (82)..(82): n is a, c, g, or t
  misc_feature (182)..(182): n is a, c, g, or t
  misc_feature (191)..(191): n is a, c, g, or t
  misc_feature (195)..(195): n is a, c, g, or t
  misc_feature (211)..(211): n is a, c, g, or t
  misc_feature (227)..(227): n is a, c, g, or t
  misc_feature (235)..(235): n is a, c, g, or t
  misc_feature (237)..(237): n is a, c, g, or t
  misc_feature (256)..(256): n is a, c, g, or t
  misc_feature (262)..(262): n is a, c, g, or t
  misc_feature (294)..(294): n is a, c, g, or t
tgaacccgatttttccaaaaancagcctccaatttgtgncccccccaaaatgngccctgatggcagctgaagtttgattcanatgggccctttttttccccttcccggcctagtttccttttgttccttggggccccgcagaattccattttttggtcagcagacaggcttaagctaaagtnttgcctttntttngtaaagttttggacanagttcccaagcttttncagggggngntttttgctcttgtcctganaaaaancagggctgttttaaaaaacatttgaaataaancccgcccccca

SEQ ID NO: 495418 - DNA, 197 bp, Homo sapiens
agcctctatggccttttcctgctatctatactcctctatttcctatcatttatatatatcaccatgcgaggcctctggaataaaacatacaggtagtctgtctctgctatgcgaatgccccatggggtcatctactagtgtacttatatgtttaacggtttcctacaaagctgtagatttttctagaagcacaatca

SEQ ID NO: 495419 - DNA, 111 bp, Homo sapiens
ggtgcttactgaggcagctttctgcacacgaggcatactgttgaggtttatttcacagagcagtgtacattcttgtcttccagggcagcaccaactccctgcacaggatga

SEQ ID NO: 495420 - DNA, 184 bp, Homo sapiens
ccattccattccattccattccataccattccattccattccattctattcaggttgattccagtccattcctttctattccattccattccattcaattccattccattccattccattccgttccattccattccattatattcctcctgagttgtttccattgcatcccattccattccat

SEQ ID NO: 495421 - DNA, 262 bp, Homo sapiens
ctagaggatccccgccataaggtgtgccagagttacattatgtccatataaaattctagcccagaagtctcatctggggtagacttttgggccttcagaaagaccaattgggtgatgtctgggagacatgtggggttgtcaaaactggggtggggaacaaggttgctactgtgcaatgcataattaattttattacgggggttaattttggcgtattgggggtcagtgggcacacatttactggacggggtacctgagctcg

SEQ ID NO: 495422 - DNA, 360 bp, Homo sapiens
gcgagccctgacactcggtatcccaaaaacctcagctgagacatctacagggcagcttcactgttgctcccgagcctgggtattgtagccgactggaggagcaggtagtccctaatgtactcccatgttcttcacatccgccagaatcccatctatgcttgtctccagcaaatggaggtggcccctctgctgccgtgccctctcctccagctctgacatcatgggccgcagtaggctgttgatctgggtcttgtgctcgggaaagcttctgctccagtaagaccagcccctcttcatctacactgggaggctggtccatcagatgcaggaggccgtctcatgtgttgcagtgtgcttccg

SEQ ID NO: 495423 - DNA, 134 bp, Homo sapiens
agagcagaaagaaggccaagctcagaatcttcctggtcctcgaagagggaactagaatttctgctgtaggaggtacttatgcagtaatctcgttgggaggcgagcacggagttggagtcttaagagttgtgttt

SEQ ID NO: 495424 - DNA, 276 bp, Homo sapiens
gcagcggctttctggtacggttcagcattttacacatttctagggtcacgctggagaagtttacaaaataagctgatcttaagacaaagtgaaatgccttttaatcagttctgtgagacctgtcatgttcaacgcctcgggagcatggatgggaaataaagaactcagggagggctgaggggatgaaggtgtctggcctgccacttgggagctcctgaaaatcaaactcccacttagttgtttggggtctttggtatgtcacgtctctgtaaaaaa

SEQ ID NO: 495425 - DNA, 719 bp, Homo sapiens
  misc_feature (6)..(6): n is a, c, g, or t
  misc_feature (131)..(131): n is a, c, g, or t
  misc_feature (141)..(141): n is a, c, g, or t
  misc_feature (164)..(164): n is a, c, g, or t
  misc_feature (168)..(168): n is a, c, g, or t
  misc_feature (174)..(174): n is a, c, g, or t
  misc_feature (180)..(180): n is a, c, g, or t
  misc_feature (187)..(187): n is a, c, g, or t
  misc_feature (189)..(189): n is a, c, g, or t
  misc_feature (218)..(218): n is a, c, g, or t
  misc_feature (311)..(311): n is a, c, g, or t
  misc_feature (314)..(314): n is a, c, g, or t
  misc_feature (321)..(321): n is a, c, g, or t
  misc_feature (368)..(368): n is a, c, g, or t
  misc_feature (415)..(415): n is a, c, g, or t
  misc_feature (458)..(458): n is a, c, g, or t
  misc_feature (495)..(495): n is a, c, g, or t
  misc_feature (525)..(525): n is a, c, g, or t
  misc_feature (530)..(530): n is a, c, g, or t
  misc_feature (610)..(610): n is a, c, g, or t
  misc_feature (623)..(623): n is a, c, g, or t
  misc_feature (632)..(632): n is a, c, g, or t
  misc_feature (649)..(649): n is a, c, g, or t
  misc_feature (688)..(688): n is a, c, g, or t
cttccnccgcgccgccgccaccctcccagagagcactggccaccgctccaccatcacttacccaaaatttggaccaccgcccgccgccaccagcccagagagcatcggcccctgtctgctgctcgcgcctngagatttcanaggtccccgttaactcgcgtctngctngtactnctcctnctgactntncaggtcggcgtgacagccggcgctccgtngcagttcgcgccctgctccgccgaaaagctcgcgctctgcccgccggtgtccgcctcgttctcggaggtcacccggtccgccggctgcggctnttncccgatnttcgccctgcctcttggcgccgcgtgcggcgttgcgactgcacgctncgcccggggactcattttccgcgcgcttccgggggatcagcaacctntgcacgccctcacccgcggccaaggcgccttctttcatgattnttacgcctccgctccccattcttcagaggcagggagncctgaaagcccagagagcacggagataacngaggnggagctcctggataatttccatctgatggccccttctgaagaggatcattccatcctttgggacgccatcagtacctatnatggctcgaaggntctccatgncaccaacatcaaaaaanggaaggagccctgccgaatagaactctacagagtcgtanagagtttagccaaggcacaggagacatcagg

SEQ ID NO: 495426 - DNA, 253 bp, Homo sapiens
aaggatcccgcattgagattcgcatctgcatgaaatgcctggtgtaatacctgcacatatgactcctcctttacttcatcatgacttgaagactcagaatatcttattgggccatggatttccatgtaacgattgcagattttggtttatcaaagtggcgcatgatgtccctctcacagtcacgaagtagcaaatcttgcagcagaaggagggacccttatctatatgccacctgaaaactatgaacctggac

SEQ ID NO: 495427 - DNA, 241 bp, Homo sapiens
ttttattttaaaaaaatttttttcttttccccggaaacagggtggttttttaagaaggggggtttttaaaaaaaaaaaagcccaaagggttttttaaaaaaagccccccccccccccggggttgggaaaaaggccgcttttttgggggcccatggtttgttttttcccaagaaaaggggaaaattcgggttcagggggggggttagcgggccctttcccaaaaaaatgggggaagcttcca

SEQ ID NO: 495428 - DNA, 4310 bp, Homo sapiens
agcggactcgtcactgcgcagccaatcggcaggcgggaagcactccggcccgaacgtgcgggcggggcagggtggcggccccgcacggtaggggagcagagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggccggtgctgctgtcgctgctgctgcccgcgcgggttgtggatgttgtcggctccgtgttgtgatgacaggagaatgtgtgtgtgtcccgggcccagacgaattggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttggtcccaggcagtcagtgaaagactcttttattatattgctggctctttggtaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctgagccagaggtaacttaccaccgattaaggccacaggataagtttctggtgttggctactgatgggttgtgggagactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaattaggatgacctggcaaataagatcttgaataggccaaaagcaagtatcttgctgtgtgtagtctcttggttaaagtgaagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccacccgatttcctaatgtaattgaaagattttctattttgccacacacttggagacaataagggtttttagttttatctactcttctattgaagttaaagaaagaaaaaaagatttttttatttgtattaatgaaaagctttagtttaaaataaggagatccagaataaaaagaagagactgatctcttcaattattgtcatctgtagccaccagcacatcactcttatgtaatccccaaaggcttggcatgccgtaagtgtgtggtgggtagactgctgccggggaatcgtacttcttatttagtaatgataagacttttcattatttttggaattttaaagatgacataaataagtttaaatatcaatttggggagtaaggtttaatattgccatcgggtattgagacaggaggaagtttctgtttttctccatttagacataggtcaattaaaatatttgggtttaaaatgactaaatgctttaaacatattgtagcttaagatatatgtgttaagatatatacatgagaaactttaaaaggtaactactgtgcatgcctgatgcttaatagaatacttagtggcatcaaatgtttgcagcagtctccataattatattcagtcccttctaatactgtatcaatgtaaatgaaataaatatattcaaattggctttttgatatgcatcaagtggcattttgttcctgtgtttaatagtgatctgtatacagctgtgcacatattgtcatcacttattctagcatcactgttaaggctgtgattatgtttgatattcacctggattttaatacaagccaatatcagcttcccattgtgtaataacttgggtgtttaggagtcttttcacattttttggggatatgaactagatgttcaagaactccttctggactgtggatactgaatcagtgtactattggctgcagaatttgtttcaattgaaaatagactcaggaagattgctgctcagaatatcatataatgtttattttttgaggtgtttttgtttttatttgtgtgtttttttttttttaagtcagcttggaacttttttcctgggtagtatttgggagagggaaaggctgtactatatatttatttctaaatgttttgactgggcatttttcttttaatgaaatatgtggactgctctagcaaaccctattttcagctactatttgaatattcttgaacaccaccactgaagagtttcatatacaccaaataatgtctcatctctatagtacagggaatataaaattggtttcctgtggtcatgatcaagatagtagtattattacacaagaaacttggtctgcagtctggaagcttgtctgctctatagaaatgaaaatgcgcatgaagttgacatgtgtggaccatcgaacagtaacttgggtattcagaaatctgaaagtcagtgtcatctaaaagcaatggtggatttccatggtaatgggtgtgtcccctgttggacgggggtctcagaattcaaggaattccgtgtaactttcatggtatttaagctttcttaacatttttttaaaatttaaatttctaactatgtttcacgtctgtttcacattaacagggtcagttattaaaaacgctaatagtatggcagtgggcgcagagtcacactgggagaaaggctttacaattttttgagacacagttggcacacagggg

SEQ ID NO: 495429 - DNA, 224 bp, Homo sapiens
acgcaccatgagcgattttatgtctgtttgtcgtaagcatatgagcttgttataattatgcctcatagggcatataccaggcaatgggtaggctatgtgttagtcaggggttgcataatgagtgtgagtgagggttttatgttgttacatgtggtgattgaatagaccccattgtgttgtggtaaatatgtagagggagtatagggctgtgactagtatgttga

SEQ ID NO: 495430 - DNA, 856 bp, Homo sapiens
agcggactcgtcactgcgcagccaatcggcaggcgggaagcactccggcccgaacgtgcgggcggggcagggtggcggccccgcacggtaggggagcagagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttggtcccaggcagtcagtgaaagactcttttattatattgctggctctttggtaccccatgagactttgctagagattgatgattcttttgtaggagggtcccaatgggctttaaacttggggcttcctggg

SEQ ID NO: 495431 - DNA, 147 bp, Homo sapiens
agctcgccgcgcagcggcctgctatttgtcggcctgctgccgaactaggccgcttggggcactccagctctaccctggccgcagccgcacggggcagaaaatctcgcaaccagttggagcgccactcgttaacctggcatcccagca

SEQ ID NO: 495432 - DNA, 333 bp, Homo sapiens
gtgtccatgaacagtttttaaatctttataagttaaagcaaataggccaggtgggtggctcatgcctgtaaatcccagcactttgggaggtggaggtggggagatcgcttgagctcaggagtttgagcttagcctaagcaacatagccaatccccgtctctacaaaaattaaccaggcgcatggtgtgtgcatacctgtggtcctagctaccggaccaggagtgagatgggcaggatatgcttgagacccaggaggtataaggcatctagtgagcctagattccacccgcactccagacctagtgtatcaatagagaaaatccttgtctttat

SEQ ID NO: 495433 - DNA, 4205 bp, Homo sapiens
agcggactcgtcactgcgcagccaatcggcaggcgggaagcactccggcccgaacgtgcgggcggggcagggtggcggccccgcacggtaggggagcagagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttggtcccaggcagtcagtgaaagactcttttattatattgctggctctttggtaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctgagccagaggtaacttaccaccgattaaggccacaggataagtttctggtgttggctactgatgggttgtgggagactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaattaggatgacctggcaaataagatcttgaataggccaaaagcaagtatcttgctgtgtgtagtctcttggttaaagtgaagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccacccgatttcctaatgtaattgaaagattttctattttgccacacacttggagacaataagggtttttagttttatctactcttctattgaagttaaagaaagaaaaaaagatttttttatttgtattaatgaaaagctttagtttaaaataaggagatccagaataaaaagaagagactgatctcttcaattattgtcatctgtagccaccagcacatcactcttatgtaatccccaaaggcttggcatgccgtaagtgtgtggtgggtagactgctgccggggaatcgtacttcttatttagtaatgataagacttttcattatttttggaattttaaagatgacataaataagtttaaatatcaatttggggagtaaggtttaatattgccatcgggtattgagacaggaggaagtttctgtttttctccatttagacataggtcaattaaaatatttgggtttaaaatgactaaatgctttaaacatattgtagcttaagatatatgtgttaagatatatacatgagaaactttaaaaggtaactactgtgcatgcctgatgcttaatagaatacttagtggcatcaaatgtttgcagcagtctccataattatattcagtcccttctaatactgtatcaatgtaaatgaaataaatatattcaaattggctttttgatatgcatcaagtggcattttgttcctgtgtttaatagtgatctgtatacagctgtgcacatattgtcatcacttattctagcatcactgttaaggctgtgattatgtttgatattcacctggattttaatacaagccaatatcagcttcccattgtgtaataacttgggtgtttaggagtcttttcacattttttggggatatgaactagatgttcaagaactccttctggactgtggatactgaatcagtgtactattggctgcagaatttgtttcaattgaaaatagactcaggaagattgctgctcagaatatcatataatgtttattttttgaggtgtttttgtttttatttgtgtgtttttttttttttaagtcagcttggaacttttttcctgggtagtatttgggagagggaaaggctgtactatatatttatttctaaatgttttgactgggcatttttcttttaatgaaatatgtggactgctctagcaaaccctattttcagctactatttgaatattcttgaacaccaccactgaagagtttcatatacaccaaataatgtctcatctctatagtacagggaatataaaattggtttcctgtggtcatgatcaagatagtagtattattacacaagaaacttggtctgcagtctggaagcttgtctgctctatagaaatgaaaatgcgcatgaagttgacatgtgtggaccatcgaacagtaacttgggtattcagaaatctgaaagtcagtgtcatctaaaagcaatggtggatttccatggtaatgggtgtgtcccctgttggacgggggtctcagaattcaaggaattccgtgtaactttcatggtatttaagctttcttaacatttttttaaaatttaaatttctaactatgtttcacgtctgtttcacattaacagggtcagttattaaaaacgctaatagtatggcagtgggcgcagagtcacactgggagaaaggctttacaattttttgagacacagttggcacacagggg

SEQ ID NO: 495434 - DNA, 944 bp, Homo sapiens
  misc_feature (944)..(944): n is a, c, g, or t
gggacagcattgtaacaggaacaggtctctttgggcagaccaactactgcattgggtgctgtgggttcgaccctgtttgcagtaacaagcttactacattttgcaagcagcaccacccagtgccaccttcattgggtgtgggcacaaataccagtgggaatagtatttaggaagtaaaccagacacctgtgactctttggaactggggcttgtacgcaggcattcggaccagagacccgagttctctcgtttgccaggtggaagtacaatgggtgtgatctcagctcatgccaaactccgcctcctgggtccaagtggatcctcttgcctcagcctcccatgtagctggagattgcagtgcatgtgccactgcaacccggcataacctgtagtattcataagtcacagatggggtttacaccattgttgggccaagggctgtgatcagacttcctgacctaaagtgagtccaccaagactcggactccaaaatgtgctggggatacacagacgtgaccttttgtgccgggccttttaaatcaattgatcaatacttcatgtattgagcgagctgcttcaatagggatagccaaaggagggactgggcactgcgcgggtacaaccacgggccccacgagcaagccccgaacaccgtgattatgcccatttattcatttctcaagccctccaggaagcttggaattatgggcagcaacggtaccgtgaatagatgtaattaagaacaaaggggttcactgtaaacctggtgggtcactcctgcacttagttcacccgctgagccccagtgggatcagcggtaaacacgccgggcatttaatgtaagactcgggtgggcacctggacaatgagatgagaacatttccaacggttgtatctccgattgtcaccaaaaaatgcggttggcgagtatgtgcaactccaan

SEQ ID NO: 495435 - DNA, 471 bp, Homo sapiens
ctcctgcgtcacacatacatcagaatttgctgttggattatttgtgtgtttgtgagaattataaaggcattaatgaatgtcttatatacttgatttgttatatcattatctcatttctttgtaagcaatgggttttctttgaaatcacctgtgtgattttgctaatttcagcagagcaggctgacttttgttaaaagtggggaatcctccacagatcatctcacattcttcttttgccacccaaataagacatatttgtcttactgctactgtattttattactactaatagtttttcttcctataagcatatgaatgatatcagtaagcgcaatttggttttaaaaatcaacattctacgtgtgggtttctctagtaatttgttagtttattttagtttcgctttcctggtttcacttaccacaatttcacttaccagaagtcagctgcggtctgaaaatatgaaatgga

SEQ ID NO: 495436 - DNA, 4150 bp, Homo sapiens
agcggactcgtcactgcgcagccaatcggcaggcgggaagcactccggcccgaacgtgcgggcggggcagggtggcggccccgcacggtaggggagcagagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttggtcccaggcagtcagtgaaagactcttttattatattgctggctctttggtaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctgagccagaggtaacttaccaccgattaaggccacaggataagtttctggtgttggctactgatgggttgtgggagactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttattgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaattaggatgacctggcaaataagatcttgaataggccaaaagcaagtatcttgctgtgtgtagtctcttggttaaagtgaagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccacccgatttcctaatgtaattgaaagattttctattttgccacacacttggagacaataagggtttttagttttatctactcttctattgaagttaaagaaagaaaaaaagatttttttatttgtattaatgaaaagctttagtttaaaataaggagatccagaataaaaagaagagactgatctcttcaattattgtcatctgtagccaccagcacatcactcttatgtaatccccaaaggcttggcatgccgtaagtgtgtggtgggtagactgctgccggggaatcgtacttcttatttagtaatgataagacttttcattatttttggaattttaaagatgacataaataagtttaaatatcaatttggggagtaaggtttaatattgccatcgggtattgagacaggaggaagtttctgtttttctccatttagacataggtcaattaaaatatttgggtttaaaatgactaaatgctttaaacatattgtagcttaagatatatgtgttaagatatatacatgagaaactttaaaaggtaactactgtgcatgcctgatgcttaatagaatacttagtggcatcaaatgtttgcagcagtctccataattatattcagtcccttctaatactgtatcaatgtaaatgaaataaatatattcaaattggctttttgatatgcatcaagtggcattttgttcctgtgtttaatagtgatctgtatacagctgtgcacatattgtcatcacttattctagcatcactgttaaggctgtgattatgtttgatattcacctggattttaatacaagccaatatcagcttcccattgtgtaataacttgggtgtttaggagtcttttcacattttttggggatatgaactagatgttcaagaactccttctggactgtggatactgaatcagtgtactattggctgcagaatttgtttcaattgaaaatagactcaggaagattgctgctcagaatatcatataatgtttattttttgaggtgtttttgtttttatttgtgtgtttttttttttttaagtcagcttggaacttttttcctgggtagtatttgggagagggaaaggctgtactatatatttatttctaaatgttttgactgggcatttttcttttaatgaaatatgtggactgctctagcaaaccctattttcagctactatttgaatattcttgaacaccaccactgaagagtttcatatacaccaaataatgtctcatctctatagtacagggaatataaaattggtttcctgtggtcatgatcaagatagtagtattattacacaagaaacttggtctgcagtctggaagcttgtctgctctatagaaatgaaaatgcgcatgaagttgacatgtgtggaccatcgaacagtaacttgggtattcagaaatctgaaagtcagtgtcatctaaaagcaatggtggatttccatggtaatgggtgtgtcccctgttggacgggggtctcagaattcaaggaattccgtgtaactttcatggtatttaagctttcttaacatttttttaaaatttaaatttctaactatgtttcacgtctgtttcacattaacagggtcagttattaaaaacgctaatagtatggcagtgggcgcagagtcacactgggagaaaggctttacaattttttgagacacagttggcacacagggg

SEQ ID NO: 495437 - DNA, 548 bp, Homo sapiens
  misc_feature (121)..(121): n is a, c, g, or t
  misc_feature (381)..(382): n is a, c, g, or t
  misc_feature (393)..(394): n is a, c, g, or t
  misc_feature (413)..(414): n is a, c, g, or t
  misc_feature (457)..(457): n is a, c, g, or t
tgctgtaatctatcagtggctgagttatggatgaacagacctaaacccctctatatgttttagtgatttgggggataaagcacacttgtgctgattgctggaacttcccatcaatcagccnagaatgctctgccagtgggtgagagtctgtgaggcaggagagattggggaattcccctgtatggtaataggtgtatgaggaagaaatggtgggggcatccaggccatctggagcaaagagaataaagtcacaggtgacattgtcagagggaagggaaaatcctggtctgtggaagggccacagtgaccctgtgagccaagtcgcaacactgaagtcccagccaaatccccgctgtgttcactgatctggagcctgagacnntcacctgtttnncccatcacaagctgtggannctgagtctcccatgacaggagcagcctcttttctcctattgtngatcaagcctagcctactctggtttgcctggggcagaaaatcatggccaggtttgatgtctagggtatgctctgatagggatcctctagga

SEQ ID NO: 495438 - DNA, 1320 bp, Homo sapiens
  misc_feature (1)..(1): n is a, c, g, or t
nagtggttcgtctggtgagtgatagagtgatggttaggttaggtctgagtatgtctgtagtgtgttggtttgtgtgtgttttgagtcgtgtgtgtgtgtatgtgaggagtggggtatgtcgtggttggagggacggtgtgggagtttgttgtaagtgcgatcgtcgcgtgtcggtgtgggaaaacatgcgtttttggccgcctgagttctccggagcgcccaccccgcggtggcggcgccccaatagaaaccccgggccgtatacgccttccgggttttagtatatgcccgcggggccgtgtatcacagtggtacaccccggggaaccgcctttgtcccccttagtcccttttttggggcccagctttgaggagaagagtgttgcccacggagacccgagggtgggttgccggttcggggattttccccggggatttttggtgggacgccccaggggttccgggggtttttcccacggcacgccaactggggagattgtgagggacgggggcaagagcttgcctttccctcgagatgggggtcccggggagacccctggaggcccccggggccaaggcctaaacctgggggagggacaaccccccccccacaacacggggggcaaacacctgacacccctcaaccacacgggctggggggaacccccacaccaggaccctggcaactctgaaggggtcccctgtgctcgttaaaaagggggaagacttgaccaacccggaaagggagcattccccccccccctgagccactcctcgtattttccccacttcactcccaaagagccccacaaggtgagattaaaacccccccaagattgggggaaaaaccacggaaccacggaaaaactgggggaaacttctgaaaaaagcacgaggcgcctccttcctccctccacaaggggaacccacgtttcctcacccacgccaccaggacccaaagctcggagtggagagaacggagcttttgaccgaggctcgaggagataagaaaggcttcacgagcgagtccacattaactttgaggctacccggagggacacttccacacccaaggccaaagagaagttggaaaactttgagaaaaaattttatagagaagagaatgtattataactatgagaataacccatacaagagaagtgcttaaaggagctgatggagctggaaacccaggctcgagaactatagtgaagaatgccagaagccttccggagccgatagcgatccaactggaagaaaagggtgatccagcgatggaaggtgaagtgaatgaaatgaagtgagaagagaagtttagaga

SEQ ID NO: 495439 - DNA, 1445 bp, Homo sapiens
agcggactcgtcactgcgcagccaatcggcaggcgggaagcactccggcccgaacgtgcgggcggggcagggtggcggccccgcacggtaggggagcagagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttggtcccaggcagtcagtgaaagactcttttattatattgctggctctttggtaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccactacccgggcgccagggaccacagcactggtgtggaccgttctcttcatcgt

SEQ ID NO: 495440 - DNA, 126 bp, Homo sapiens
catcagtgcttacatatattcacaaggttgtgcaatcaccacgtatcatctaattccagaacatattttatcataccctaaaagaaaccttaaaaccattagcagacacccgattatttccgtcct

SEQ ID NO: 495441 - DNA, 819 bp, Homo sapiens
actagtaaacaaacggtgtattgtcatcatgtgagttgaaaaaaaagttaaggtataccctggcacctggcggaagagcaggctgtccacatgcatgacccccggctgataccactaaaaaccatgacgtctgacattttaaagatgcagctttacgtggaagagcgcgctcataaaggcagctgatggggcactcgcaccccactgatgcccaaactgtcagactttgggggatccacgcctagggcagtgctgcatggctgccctgattccaagagctcttactcgctctgagtgtggatcgtccgccccaacagggatctcgttcacgtctgctttgatggatgcctcccccaagacggcattgagggatgccgcatcctaaaaagcacaagattctggggatccgcccactaaaactgtatgtataaaacactgcgctgcaaatagcaacaacaacggggtcccaacggaaaaataatattttatcgggccacgctgacccaagcgagggatactcttgtggcagctccatttagtgaggcactcatctcatgaaactatataacgaatatcaagatacatatgtgatacaaaaatgagaaaaataaatcataatacctacacggtggtaatagtaccttacaacaaattcaccgggaaaaccacctgacatactcttcgatctctctgcccactggtagcctaaaaacgtaagaatcacacgtcgactaccattcacctactcaatttaccgcgtggaggcagcctaatcttacctaacgatttatttcctcctcattatgattaatcaaatat

SEQ ID NO: 495442 - DNA, 99 bp, Homo sapiens
tattcccagcccacttgccatccttgttccttttcattagctgggactttcacctgatcctatcacgggcggtgttcacgagtgtcgttactggttttt

SEQ ID NO: 495443 - DNA, 294 bp, Homo sapiens
aacgcaagtcccaggtcatgagagaatgggaagaggcagacacgtcaagcaaagaacatggcctaaagctgataagaaggcagatatccagacattacaggagaaagtggacgtcttggaacaggaagcaagccaacgagagacagcagagggtggagacacacatggccagagatggaagccatgctcaatgaccgccgccgccaggcccgggagaactacatcaccgctcagcaggctgttcctcctcggcctcgtcaagtgttcaatatgctaaagaagtatgtccgcgca

SEQ ID NO: 495444 - DNA, 410 bp, Homo sapiens
  misc_feature (22)..(22): n is a, c, g, or t
  misc_feature (146)..(146): n is a, c, g, or t
  misc_feature (151)..(151): n is a, c, g, or t
  misc_feature (180)..(180): n is a, c, g, or t
  misc_feature (194)..(194): n is a, c, g, or t
  misc_feature (210)..(210): n is a, c, g, or t
  misc_feature (242)..(242): n is a, c, g, or t
  misc_feature (247)..(247): n is a, c, g, or t
  misc_feature (261)..(261): n is a, c, g, or t
  misc_feature (270)..(270): n is a, c, g, or t
  misc_feature (274)..(274): n is a, c, g, or t
  misc_feature (279)..(279): n is a, c, g, or t
  misc_feature (296)..(296): n is a, c, g, or t
  misc_feature (299)..(299): n is a, c, g, or t
  misc_feature (333)..(333): n is a, c, g, or t
  misc_feature (340)..(340): n is a, c, g, or t
  misc_feature (373)..(373): n is a, c, g, or t
catgtccccaaagcccctaganggtgttctctgaagaacccacagggccaaatcctaccaaaatgtcttgaagctggattctcccttctgcctgcccccactctgaggtcccggggggtccagggggggcccgtcgtcaatggctnctganaagggtggcacagacgcacctcacctgcnaaggaccaccctgnaaaagtctgtggccanagctccttgaccacttgtcaccccttcctcanatggnagggtggaggcatnggactcaanctancaacngaagcaaacctggatcnttnccagtactctctgtaaggatctggaacttccatncagtcanactccatgccgtaaatagggaggaaggttgtgntggacgaagacactcatcaacctgctcataaccatgg

SEQ ID NO: 495445 - DNA, 649 bp, Homo sapiens
ccggggtcacccgggattcgtggccagggtccctggggattcctggctcccctgtgtccccccaggcccagttccttgtgttttataggttgcccccccgttttttaccctggtgtggcctgtcctttctgatggcctaaattcacgtttctcggattggaggggcccacctaaatttcagattaagccccagggtttgttcaacccttggattggttcccagccgtgatcccattcccacgggagtttaagggttggagttcttcgcttctgttcaccccagggccttggagttgccaggtggcgcccattcttcggcttcactgccaagcttctcccttcccgggtttcacgcccatttctccttcccattcttcttctggaacttcacgtccagttaggtttttccttttccagccaatcccttggaaataacctttcttttatttatttaattttatttaattttatttatttaatatttatttgtagtctgctgccacccagttgccgccacccatgcccacgcctctccccgtgggaagaccggacacatctatttaatttattaatttattttgggtcctcccctgtggaagccggaaacatctattttatttatttatttatttggagaccctggttcttt

SEQ ID NO: 495446 - DNA, 509 bp, Homo sapiens
agcggagcggacaccagctgctccccgcgccgggcgccgcgcgccgctgctccgccgctcggcccctcggctgctgctccgccggcgctgcctccctcgccccgcaggctcccccttgcaacttggcgggcctccatcccttatagtccggcccggcccggccgccgccaccccccgatgcccggagccagagctcccggggtctcctgggccggctgtcggtgcctggcagggacgcggagggggctgtggggcccgcggctcgtcacaccccgacggatagagccgccgacaggaacggggcgcgggacggaacgatggaactccacaatcctggagacaccggctgcaagattgccagacatcgccaaggagaagtatcccgctgttcagctaacggctgatcaagacttgccttccctgtcctccaagaccagatgatgattattctccaccgtctaagagaccaaaggccaatgagctaccggaagccgccagtcccggaaccg

SEQ ID NO: 495447 - DNA, 110 bp, Homo sapiens
atctccaccatcctctttggcgctgcgtacacctgcttggaggctggacatcactggagaggaaacccactcaacaggctccggtgaagattgaaccaggcgttgacccg

SEQ ID NO: 495448 - DNA, 206 bp, Homo sapiens
aggctcctgtatgttttgcttgtcttgtgggcgttatgtgaggaggtgtgcggtagaacaacgctagctcgcatgtgcaccatgtgccgcttcccacgctgacctgtgctccctccccaatcatctttcctgttccagagaggtggggctgaggtgtctccatctctgcctcaacttcatggtgcactgagctgtacctcaccgta

SEQ ID NO: 495449 - DNA, 1057 bp, Homo sapiens
  misc_feature (424)..(424): n is a, c, g, or t
ggagccagcgaggcctctccattcactctccgcgcccgttctccgagctgtcctcccgttccggcatgtgcgaccatgcacagcgatgacaggaacaggccatctccattcgccaaagacttctttgggcggaggcatcgccggcggcatctccaagacggccggggctccgatcgagcgggtcaaagctgcgtgctgcaggatccagtcaagtccagacaagtcagattctgccgtgcgaccaagcatgtatcacagggcagtcgttggagcgtgcatttgatcctgcagtcccacaaggacgcaggggactgtgcttgtccattcgtggacgggcgcaacgcgtgtggccaacggtgcagtctcgcctacattaccaccagtcataggcctttcaagcattctgaccattcaagggtataangtagcaagagcagattcgttcctggcgcgggcgtggaacgaggagctacgacgctagattcgtggtaggatacgtttgacgggcataccatggacctcgcgagcggttgccggtccggtggacgagcgtccgctcgtgcgttcggtgtaccccgcttaggagtttcagccagaatcccgcgctggcgagcgagacgctggcgcaaagtcatggcacacgagcgcgagttcctgagggccctggggagactggcgctggtgaacgaatcaccaagatccagaacggcatccggggccctggtaccagggcttcaagttgtctccgtgcagggcatcatcatctaacgggccggctactttcggcgtgtacgatacaggcaaagggccatgctccccgaacccgaaagaaacacgcacaatcggggaggaggctgggatggatcgggcaaaacccggtgaacgggccgtgcggcctgtccgttggttgttccttaaccccgtttcgacaacaggtagccgcacgggcgcattgatgattccggtccgcgcggcaaaagaaggtgaacctccatgtacaccgggccccggacatcgctggagcgacgaacttccaaaataaggcgcgccaggccat

SEQ ID NO: 495450 - DNA, 655 bp, Homo sapiens
  misc_feature (655)..(655): n is a, c, g, or t
atttaacaaaggctactggttccacttatgaatgtgcttactgaaacagtaaacaacaacaaaattcagtgattctaataaataccaccctgtgatgtaacacacctttgtcatgtcctgtgaggtgaattggaaaatactcataaatacactccctggctgaattatgaacaacatgatagtggcttcagggaaaagctcttgggtgtagagagtggcaagctgagcctacacacttactgttccacagattcacaccatttttaccttgaccagaccatttttaacaacactgattcatcagcctaggtagtcagggagccatgtttcttgaaacactgcagctttgtcactttcaacgaccacacttccacagtatttggtggccacatgcattaataatccaggcttttcttaattcacaaaaattagatctttcgtggaacactctttgtacattgctaaccatgaagtttgacacaaaattctttccctgtagagcatggctgctgattatcatcaacatgtggtttcctgcatattgtataactgcactggggcccactattgaacagatcttgcatagttcagtgaggccaggatttccacattgaccaagcatgttatataagctcattttggacaacactctggn

SEQ ID NO: 495451 - DNA, 992 bp, Homo sapiens
taacccctccttagttttttgcgctcaaaaaccaaataaaacccccccccccttgtaacgggggggcggggaaaaaacacaaaaacgcatcaaacccggctcgtgaagaccccctagttttctcttgccccctcgccattttattccgccctggtattggagtttttggtttctcactcgtgctcctcgtgcaggcatggggtgagagtgaggggggtggacgccctcctggggtggtgcactgggccatcatagacgcccccttgtggttcggatgtctcagagaggggagattaggggatgaaggtgcgccatctttgctccgtggccttcggcttctttggggtgcacctgttgttgtggggctccccaagaatgctccttgaggtggctgggaggtgggcggtggatgtgggcagggggctcttcctcacaggggggtgtcagcggaggtggcttgctcgagaggcgccccagtgagaggtggtgcggctccttgggtggtgcgccatgagggggttgcctcgtgagggggtgacagtggtgtgccaatcctggtgtgttgtttgtacacccgagaggggggtgtcacccaatcagtggcttggggtgagcaggggggagggcgccagccatctccagcactctttggtttgagaagcgccgtactcccctatgatcctcctctggggtgacacttctgtggtccctgtgccccgtttaatgaacaccctgtgtgtcctattcggctctccccgagggggagagctcgccagaagcgactcctagtgggggggcaccccttcctctgggtgggggcccagtgtgctagggtgtgttagtagctcccggtgcgaactaatagaggaggcgtctacggcgggtggtctgatgatcccctactaggttcagtgcaactacttgtcctgggttctgtcgccgtccctggacctgtgttgttttgttcctccggatacccccggtgttgtttt

SEQ ID NO: 495452 - DNA, 510 bp, Homo sapiens
ctggttggcacatgtgttatctagagagattttacataaatgtacatttccttgcttctcttgaagagtggaagcttggcctggtgcagggctcactcctgtagtcccagcactttgggaagccgaggcgggcagatcacctgagctcaagagctcgagaccagcctggccaatatgatgaaactttgtctccatggaaaatacaaaaaattagccaggcatggtggcatgcacctgtagtcccagctactcaggaggcagaggcacgagaattgcttgaacctgggaggtggaggtggcagtgagccgagattgtgccattgcactccagcctgggtgacaagaggaaaactctgtctcaaaaaaaaaaaaaaaaaaaaaaggggggaaactcacgcttgctaagactttgattggcttacaaacaacccctgtggtcggggttcggccccaaaaagaccttgatttgtttcccattcctttctttgggacccaggcaaccccggggga

SEQ ID NO: 495453 - DNA, 135 bp, Homo sapiens
gacacacgccgagtctccatacgcggtaataacgacatcataatggacgaagttgttgcgcaacaacttcgtccatactgacctgaccttaagaagtgtgttggaccttcggacgtgtgggagtaccgatgctcg

SEQ ID NO: 495454 - DNA, 1069 bp, Homo sapiens
cattctagtaggaaaggacaataagatttttctatcaaacatgtgtcatgccagtaagagatgttatattctttatctcatttcattccccacccaaaacataagctaccatatagcttataagtctcaaatttttgccttttactaaacatgtgattgtttctattcacttgtgtactgcttcatcaccgtactattaggcaacttccattatttttcccttgctgctaaggtaaagatttaatctaaataatttctggcctctcatagttttctctactctttacacagagacataaatacgagggccaggtgctggtggctcacgcctgtgatcccagcactttgggaggccaagcacgggcggatcatgaggtcaagcacatcaagatcatcctggacaacatggtgaaaaccctgtctctactcaccacatacacaaaatgagctgggcatgcgtgagggcgtgccctgctagctcccactgtactttgggaggctgacggcaggaaacattctcgacacccaggacacggaagctagcagtgagctgagatcacaccatgcactccacgccggtgacagagcacgacatccggctcttaaaaacaaaacaaacccaaacaaagggacaccgcccacaaacaaccacccaagggaacccaccgcataacagcacacaaccacactaggcccacaatgcgccacacacccagaagaacgacacagaaaggcccaccccgtccgaatcaacaaaacgtacggaaaggtaaataagtacatggcaacaagaccaagaacaactaaatagcgggactacaacccaggaagcaaaccaaaaacaaataacagctccaggctacctctacggaagagaacggcggaccacaacgccaacataaaccgagcgctcaacaaccggctgcacagtcactcacaaaaggacaaaggcgacaacagacccacccacgacccagcgccacagcgcacaagaggtgcacgctactgaccaccacgcacaggcatcacccgaccaaaacgccagacacaacccgaccagaaacttgag

SEQ ID NO: 495455 - DNA, 137 bp, Homo sapiens
gatgggactgttgtcatctctgagctcttctttatttctgactgtgatttatttggagtggaggcttgtttttaagaaatgcatgtcttgttggttgtctacgaataacatgcatttaacatctccgtgcactcgtg

SEQ ID NO: 495456 - DNA, 1728 bp, Homo sapiens
attcagtgtttctgtgtagttgtgtattctgtgtttgtgtgtttgttcattagttgattgctgagcatagtttgatcgtgtttttccaccatttgtgtctgttatcaatcacgaatcgatgagaaaaacaaaaaagcatgcataaaagtgagacgcaaaagaagaagaaggtgtgatcgtacacttatcatcatttgtagtctatctctgagtttgttcagcctatcgttgttggctctctgttggttggtagtgcttctacgtgtgtctttgtgttggttctcttgttgcgttgctagctagtatggtctcggcggcttgtgggtagctagcttggtgttttgggggtagtgttcttgtggactgtgctggtgtctaactcttgtgttgtggctgctctgtagtaatctagcccccctgtggttgttgttacgccaacgagcccgttggttgttttttgcgcacgcgctgctgtttgtttcgcttttggtggggtcccccctccctctcgcgaagtggtgggttctgctcatcgtggtcgcggcagtgatacttgtgtggggtgcttgcccggcatgcactatcttccgggtggggcgtgcgactcaactagatgttgtgtagtgtatggattggtcgtgtagtcagcgcagctaggtttccgctcgacagcgtttgtctccgcgccagcagtagtattaaagacgccggtgtcggtgtgcgctcgtgtttgtctctgtttttttgtatagggcggtgtgaccacagaccgtaatttagctcgtcgtgtctgtatgagacagagcgttcttgttttgtctcgctgaggagcagccacgaactgttgtgggggcacagaaacgttggtgtggcgcacaatagttgggtggtgtgcgcgcccacaccacttgttgaatcatttgtttgcctggtgttcccccccacaagacaagatgttctgtgcgctgtcgatatactcttccgtttcggggcggcgctcttaatagaacggcggaagagtagaatgtgcgtgtgtgtgttataatataacatgttgtttgcatacatcgggagaaccaccctctcgtcgggtagttgagacccccacgcatcgtggtagtagtgttctctcccgcccaccatcatgttactgttgtttaatataaaagacaagaggtctgttttccgcgacagcagacacgtcgactcctgttataatacggtgtgggcgccgcacgaggtggtgccgcgcgcctcgtgttaataggacccacggccctgtgttgcgacgccgccagcagatattatatgatcacgacagcatcatttgcccaacgaagtatatatctgttgtgtggtgggaagaaatccgcccgacagatatctcgcgcgagtgtatgctctctctatagtaggagatctctcttttggcacaaaagatcgtggcgaataacagaggcgatggggtcgcgatattctcccgcgcgcgagcatctcgctctctctatgattagaccccccccacggctctgttgtgtgaaacagtccctctctttcgtggtttagatcttcaaagctgtctacggcccttggcccgcccctttacgagtcagtcgtgaggagatgagaccatggcgcgccttctagatatctgctccgtcagactatgacgaacacgtacacgacacaatataggcaggtgtaacagccccacaatagacagagaag

SEQ ID NO: 495457 - DNA, 431 bp, Homo sapiens
gtacgaaccgagctcgtacccctaattggttcttcgatgacgcaatgcatcccgattgaatgcagtggattgtatgcagcatggcccaaagcatcccgattgaatgcagtggattccatgcattttgattgaatgcagtgtactccatgcagcgtgggaacatgcatcccgattgaatgtagtggattccatgcagcgtgatggaatgcagtggattccatgcagtgtgaagaaattgaaccctattgtaagaagtggattatatgcagcatgattgaatgcagtcgattccatgcagcgtcattgaatgcagtggattttctgcagcatggcccaaagcatcccgattgaatgcattggatccatccattgtgattgaatgcagtgtactccgtcatcgaagaaccaattagccttctacgtctcatcac

SEQ ID NO: 495458 - DNA, 249 bp, Homo sapiens
tacaatcgatgctctgtaccgcattcagacacatgacgttgatgctcatcactaagtgtgccatcagagaaatgcaaatcaaaaccacaatgagataccatctcacaccagttagaatggcgatcattcgaaaagtcaggaaacaacaggtgctggagaggatgtggagaaataggaacacttttacactgtttgtggaggtagcactggggattctctaaaagtccgaactggcagggaattcaagct

SEQ ID NO: 495459 - DNA, 577 bp, Homo sapiens
  misc_feature (178)..(178): n is a, c, g, or t
cgctagcggcattaagtgaacgcatcccgattgaatgcagtggattttctgcagcatggcccaaagcatcccgattgaatgcagtggattccatgcagcgtcattgaatgcagaggattccatgcattgtggcgcaatggatcccgattgtatgcactggagtccatgcagcgaagcncaatgcatcccgattgaatgcagtggattgtatgcagcatggcccaaagcatcccgattgaatgcagtggattccatgcattttgattgaatgcagtgtactccatgcagcgtgggaacatgcatcccgattgaatgtagtggattccatgcagcgtgatggaatgcagtggattccatgcagtgtgaagaaattgaaccctattgtaagaagtggattatatgcagcatgattgaatgcagtcgattccatgcagcgtcattgaatgcagtggattttctgcagcatggcccaaagcatcccgattgaatgcattggatccatccattgtgattgaatgcagaggattccatgcattgtggtgcaatggatcccgactgtatgcactgcactcccatg

SEQ ID NO: 495460 - DNA, 217 bp, Homo sapiens
gacaatcccattgtgctacgttgtatactaggtgaagctcattacagactctagtgttcagtgttctcattgtggagctggtcacctcatccttcttgcctaacacatatcataatctgactcccagaaggaaagcagattttgggcataacccacattgtttgtaccaacagttcaggcacagtgagccactcttatcatttagggagtaatgaga

SEQ ID NO: 495461 - DNA, 357 bp, Homo sapiens
taaatgtatccgacccattcagcgaggcccaatgcatcccgattgaatgcagtggattgtatgcagcatggcccaaagcatcccgattgaatgcagtggattccatgcattttgattgaatgcagtgtactccatgcagcgtgggaacatgcatcccgattgaatgtagtggattccatgcagcgtgatggaatgcagtggattccatgcagtgtgaagaaatggaaccctattgaatgcagtggattttatgcagcatgattgaatgcagtggattccatgcaacatgatttcatgcagtggattttatgcagtatggcctcgactaattttccggatcctctagatcacatgcag

SEQ ID NO: 495462 - DNA, 205 bp, Homo sapiens
acgactggtcccaattattgacgcccaccagagcctcagtcaggcgcaggccacactagccactgttctctgtcgtctctgggagagggcttggtgcatcaaactcccagtgcttgcgatgaggctcatccaggcccctagtgttcctccctgcagtcgttaacgtcctcagttgacggcaggaaggcgagatagtgcatacttg

SEQ ID NO: 495463 - DNA, 313 bp, Homo sapiens
  misc_feature (178)..(178): n is a, c, g, or t
cgctagcggcattaagtgaacgcatcccgattgaatgcagtggattttctgcagcatggcccaaagcatcccgattgaatgcagtggattccatgcagcgtcattgaatgcagaggattccatgcattgtggcgcaatggatcccgattgtatgcactggagtccatgcagcgaagcnggccaaatgcatcctaattgaatgcagtggattttaagcagcatggctcaaaacatcccgattgaatgcagtggattccctgcagcatgacgttcactatgccgctagcgcgggatcctctaagtcacctcagca

SEQ ID NO: 495464 - DNA, 178 bp, Homo sapiens
cccccaatatggacatggactgtttgcgaccgagccgtttctgcccgagcatcttgcggtggtgcgtgccttgcaatccggcaatctcgaaggcgcgcaagcggcactggcccaccatctgcagatttcacaggaacgggcactgttgcgcgttcaaaccattgcgcgcggcatcgaa

SEQ ID NO: 495465 - DNA, 669 bp, Homo sapiens
  misc_feature (178)..(178): n is a, c, g, or t
  misc_feature (265)..(265): n is a, c, g, or t
  misc_feature (284)..(284): n is a, c, g, or t
  misc_feature (328)..(328): n is a, c, g, or t
  misc_feature (336)..(336): n is a, c, g, or t
  misc_feature (456)..(456): n is a, c, g, or t
cgctagcggcattaagtgaacgcatcccgattgaatgcagtggattttctgcagcatggcccaaagcatcccgattgaatgcagtggattccatgcagcgtcattgaatgcagaggattccatgcattgtggcgcaatggatcccgattgtatgcactggagtccatgcagcgaagcncaatgcatcccgattgaatgcagtggattgtatgcagcatggcccaaagcatcccgattgaatgcagtggattccatgcagcgtggnccaatggatctcgattgantgcagtggattccatgcagtgtggtgcagtggattctgattgantgcagtgnattccatgcatcgtggcacaatggatcccaattgaatgcagtggattccatgcagcgtggtccaatggatctcgattgaatgcagtggattccatgcagcgtgtttgaatgcagtgtatnccatgcagcgtgaagaaatgaaccctattgtaagaagtggattatatgcagcatgattgaatgcagtcgattccatgcagcgtcattgaatgcagtggattttctgcagcatggcccaaagcatcccgattgaatgcattggatccatccattgtgattgaatgcagtgtactccgtcatcgaagaaccaattagccttctacgtctcatcac

SEQ ID NO: 495466 - DNA, 831 bp, Homo sapiens
  misc_feature (178)..(178): n is a, c, g, or t
  misc_feature (265)..(265): n is a, c, g, or t
  misc_feature (284)..(284): n is a, c, g, or t
  misc_feature (328)..(328): n is a, c, g, or t
  misc_feature (336)..(336): n is a, c, g, or t
  misc_feature (456)..(456): n is a, c, g, or t
cgctagcggcattaagtgaacgcatcccgattgaatgcagtggattttctgcagcatggcccaaagcatcccgattgaatgcagtggattccatgcagcgtcattgaatgcagaggattccatgcattgtggcgcaatggatcccgattgtatgcactggagtccatgcagcgaagcncaatgcatcccgattgaatgcagtggattgtatgcagcatggcccaaagcatcccgattgaatgcagtggattccatgcagcgtggnccaatggatctcgattgantgcagtggattccatgcagtgtggtgcagtggattctgattgantgcagtgnattccatgcatcgtggcacaatggatcccaattgaatgcagtggattccatgcagcgtggtccaatggatctcgattgaatgcagtggattccatgcagcgtgtttgaatgcagtgtatnccatgcagcgtgaagaaaggaaccctattgaatgcagtggattttatgcagcatggattgaatgcagtcgattccatgcagcgtcattgaatgcagtggattttctgcagcatggcccaaagcatcccgattgaatgcattggatccatccattgtgattgaatgcagtcaatgacatacagcttagtaaaatgaatcccgattaaattccatggattacatgtagcgtgattaaatgcagtggattccatgcagtgatgtaaatgcttcccgattgaatgcagtgaattctatgcattgccattcaatgcagtgtaatatatgcagcgtggtaaatgcatcccgattgaatgcagtgattccagtacttcgtgg

SEQ ID NO: 495467 - DNA, 120 bp, Homo sapiens
agtaataggataatttcaggatgaccatcagtatgatcatttacagctgtctgaaggaagaaaggaaaattctggaaaacgcccagagatttaatcaggctcagtcggggaatattcaga

SEQ ID NO: 495468 - DNA, 562 bp, Homo sapiens
  misc_feature (63)..(63): n is a, c, g, or t
  misc_feature (135)..(135): n is a, c, g, or t
gggggccgacggggcattgtattagcaaattctcactaagacatgggattacacgacacgtantagggtgagggtcacttccactaggtccttacaatgggagcggtatttgccatcataggagggttcattccntgatttcccctattttcagggtacaccctagaccaaacctacgccaaaatccatttcactatcaaatttatggggggaaatttaacttttttcccccaacactttttgggcctatccggaaggccccgaggttactgggactaccccgagggataccccacatgaaacatcctatcattgggggggtcattcatttttttaacagcaggaaaattaataattttcatgatttgagaagccttggctttgaagggaaaagtcctaatagtagaagaaccccccataaacctgggggggttatatggaggcccccccccctcccacccatttgaagaacccggataaataaaatttagacaaaaaaggaaggaatggaaccccccaaagggggtttcaagccaaccccagggcccccatgactttttta

SEQ ID NO: 495469 - DNA, 557 bp, Homo sapiens
tccgccccgatccccccatcccgtttccctccaggtgttgttgagggcatatggcttcctctgctgcatccccttccagctccctcccctgctcagaatctgataccaaagatgacagggccctgggcccaggcagagagcgaccagcaggctcctcatgccctctcttgccaaaaatgcacaagagtgtttgagtgctgatgcatggtgcagtgccccctgtgtggagtgggccagagattttctatgaatctattatttcttcagacttgagtgcctttatggtagtcatgtgagccccctgcatgtctgtcatgacctcccatagactgtcattgccaaccatgctgccccacaatcctcctaccatttcttatgcattgtatgcaatcaacacgtgtgtgacctcacacacctctgccccttgggcctcccactcccatggctctgtggcggtccagaatgtgagcaggccctgggcctccacctctgtgcatgtggcacagaaggctggggtggggggacggagttgattcctccccagcctgtcccaggcg

SEQ ID NO: 495470 - DNA, 539 bp, Homo sapiens
  misc_feature (4)..(4): n is a, c, g, or t
  misc_feature (182)..(182): n is a, c, g, or t
  misc_feature (203)..(203): n is a, c, g, or t
  misc_feature (213)..(213): n is a, c, g, or t
  misc_feature (220)..(220): n is a, c, g, or t
  misc_feature (368)..(368): n is a, c, g, or t
  misc_feature (395)..(395): n is a, c, g, or t
  misc_feature (406)..(406): n is a, c, g, or t
  misc_feature (453)..(453): n is a, c, g, or t
  misc_feature (455)..(455): n is a, c, g, or t
  misc_feature (539)..(539): n is a, c, g, or t
acgnctgggggaggggtgctgcgtactgttcaatgagagccataatgtggctgtaactgtcttcctcatattgcaagagcactgctggcagatccagctcctcatatagcgccttcacccgggccactttctcagcctccttctgcccgtaattttccttcaggatctggtactgttctggngtggcccgttgcagacactgnaccaccagcnagctgcntttgttgtcctggatgtcagtgccaattttgccggtcacactggggtccccaaagaggtcaaggtaatcatcctgaatctgaaagagctcccccatctccagcaggatcttcttggcattggcgtgctccttctcgccatcaattccngccatgtacatggctgcagctataggngggtaggaggngtagaaaggctgtcttgtacttgacaatagatttgtacctggggttntngggggagaagagaaacttctcagtgagggggcaatggcgacatcgctgggcccgtccctcggctggtccaagacatgggttcgn

SEQ ID NO: 495471 - DNA, 292 bp, Homo sapiens
taccttaacctcatgtttgagatccagaacagaaaatgggttgtggaggtgttgcgggggaggtatcgaggataggagagtatatgggtttggcaccatgggggtggataggcaaaacaattttggtttgataagtgtgcaggatcctggaacttaacctgttaagacttgtctctgttttttgggacagtgtaaaaatggggggaattgtaaagtgagatgtttatatgtgctttaaaatgtgccatgcttgtaacatggcaatgttgataacatgtgctttatttccctt

SEQ ID NO: 495472 - DNA, 149 bp, Homo sapiens
gatagctggaccgcccgaaaatggatggcgctgaagcgcgcgacctatactcgaccgtcgaggcaattgccaggcttcgatgagtaggaggacgcgggggtcgttgagaaaccttgggcgtgagcctgggtggacctggcccccggtgc

SEQ ID NO: 495473 - DNA, 166 bp, Homo sapiens
gtgctctagagacccggcatactgaccttctggcatacctgaccttctggcatacctgaccttctggaggctcaagcaacaaggaggtgcaggtaagggtgcagtgcagccactgagggacagctgggaactagattgctgtagttctccagaatgtccaggtatg

SEQ ID NO: 495474 - DNA, 487 bp, Homo sapiens
acggagaaacctcccaggtttgtagacagtattagcgtacaaacaccttgatcttggtttttaagcccttctcccatcagtcctagattaggccgctgttcagccatgcaggggtgttggtttatgcctgctgcagcagtgggcataatgaatataatttacccagtggacaaaggtgtgtaccaagtgaatttaaataattggtgtggattggccagtagctaagaagtgggctcttaaagagtattgaagattgaaagggtttttctttcttttttaaaaaagaaaaacaaactattgattgtagataatgaaaagctagggtttgccctcttcatgtctactctccttccaaatagttatatccaaaactgtttttccctctcccctaccttgtcccccctaataaaatagaaacagggattgattaatgtcccgctcctgaatacatgtaaaatttgtacaaaaatatcttctatgaaaatga

SEQ ID NO: 495475 - DNA, 206 bp, Homo sapiens
  misc_feature (31)..(32): n is a, c, g, or t
  misc_feature (35)..(35): n is a, c, g, or t
  misc_feature (46)..(46): n is a, c, g, or t
  misc_feature (81)..(81): n is a, c, g, or t
  misc_feature (120)..(120): n is a, c, g, or t
  misc_feature (192)..(192): n is a, c, g, or t
ggaattgtggttaggggttccttgaaatcannctncatattaaggncaaaccaagggaaaattgtaaccaccaaaggaaantaaaccaataattgaaataataaattgctattctgtaangacatacagtctgtgtaagatgtatcttatttacagagacatttttgaaaattaaaatattaaatacttttngttatatagagaca

SEQ ID NO: 495476 - DNA, 163 bp, Homo sapiens
gtattgtcgcccagcctgttctatgagcgtccacggctcaactgagtcctcctgctttggcctcccaaagtgctgagattacaggacgccaccatgcccaggcacccagtttcaatatccttgtctctgttccccacccccaaagagatagattgaagttgcc

SEQ ID NO: 495477 - DNA, 1278 bp, Homo sapiens
tctgttgttttctgttttgttgttgttctaaggtaaccgagagaaagagaagaaggacaagaaaacagacagagagggagaaacagatcacaagtgaggttcgtattgaatgtgcatgtatgattattttatctcgtcgtcgctcgcttctgatatgagaggacttgtactttatctctttttcgatatcgcttcagtggttatgaattcaccctttgtttggggagcacaacaatgtggtgccacacgaatgaagatagtgcggctttctccttcgcgggagactgtgttttttgtgagagggcagacaccaccctggtgggcgctagccctctttctcggggcgctccctggggtgacatccccccggctggtttgggatttccttccctatattcccggggaaattgggcttttgtgtgtccaccccaggggggcctctttttttgtgagttttcgggaaccatttggctgcgcccacataaaggggtccaccagcttggcgtgcccacgtgcgtgggtgccgcgttggcgccccacatggtgaagagcaccttgggtcgccgcgccggaaccactggtttcgggcccctgagagagacccccctgtgttcccgctctttaggtattccccccgctgtaaatgttcccaggggccaccactggaatctctgaagtgatgtgcaacttgatcaagactggaggacacaagtgggagccagcgaaccaccgctgctgaacatgcgtcaacatgtcccccttgctcctttggctggtcaacccaacaaggtgttcgaccatggcagcatttaccaccctgaagtgcttgatatccccgaggaaactctgcattctcgcttcctggagggtgtccgccaaagttgcccagtgtctgtctgccagattggctaccccactgttgcatccagtgacccccattctatcatccacgggtaccaaacgagtcctggccttgtctgtggagagcggattacacccttcccaccttgctgaaaaaggtcaaggcctttcttggctgaatccactctgcctttgtggctgctgcccctgtggctgctgccacccaccacagctgctcctgctgctgctgcacgccccacgctataaggttgaaacccaggaagaatcggaggagtcggacgaggatatgggatttggtctctttgactaatcacccaaaagccacccacttagcccgttttatttgccaaaaccaggaaataaaggcttacttcctttaaaaaaaagaaaaaataa

SEQ ID NO: 495478 - DNA, 1093 bp, Homo sapiens
catcccagcacttatgggaggctgacgtgagtggatcacttgaggttgggagtatgagaccagccaggtcaccatgatagaaaccccatcttgggccgggtgcagtggctcacacctgtaatcccagcactttgggaggccaaggcgggtggatcacgaggtcaagagatcaagaccattctggccaacatgtatgacaccccatactccactaaaaaatacaaaaaattagcctgggcatggcgcgcgggtgccatgtagatcccagactacttgggcaggctgaggcagagagacgggcatagaacccgagcaagacagagctagcaaagtgagccgagatcatgccactgcacctccagactatgaggacaacagagacgagactccataccacaaaacaacaacacacgacatggcacccacaaaaagacaagacctgagagacagacgaaaaacggcagcaaaaaaacacctcgaacacaaacagacagtcacgagacaccacgaagacacacaactaggcaccagcaaaatgcacagacaaagactatcctggcgcaactcaaaccatccaggacaccccacacgtccctgacacaacacgaacaacgacaaggagaaacaggtaccactcgaggacacatcacaagacgaacacaacgataaatgtaaccgcaaaaccaaatgattaccagaaccaaagatatacaaatggccaaaggatgaacacaaacgaagacttcacaacgcaaagaccaaaccaaccaaaacgcacacaccaagctagaaagcaaaacaaacccaacaaaaacaaccacaacacaaaaacaaccgggacaaaatcccgcagaccacaccggatcacgagaggaacaaatgacgacgaaaacaccaaaaaaaaaagcaaaagccacaaagataccaacacaacaagagcacagaagaaaaaccaaagaagacgaacaaccagatgccacaggcacaacaaacaaaaaacaagaaagaagaaaaaaggagaaccccaaactgaaaacacaaaaacaaacaaaaccaaacaccacgcctcaccacacagcaccacaaaaacaca

SEQ ID NO: 495479 - DNA, 896 bp, Homo sapiens
aaaaattagctgggcatggtggcgggcgcctgtagtcccagatgctcaggaggctgaggcaggagaatcgcttgaacctgggaggcagaagattacagtaagccaagatcgccccactgcactccagcctggcgacagagtgagactccgtctcaaaataaaaaaaaaaataagaggtaaaacagaaagtaaagtctatagcccattaagaggtcttctaatatcagtggggatggtctggctcctacttaaaaaaaatattttacgctggatgtttaattatcccctttcagcaaagttgggatcagaacattttacaagtatgtgacaaagatcaggtcacctgtgaattttccacacaaatctcaagacactgaatagcaagaaaagtaactttacacggtagtgataggatattccttagacttggcgggctcttgggtcttagggtaccttgtcaagagtggtggaagcctttcctttcatgggccctgtgcaaggtaccggtttctgcctcctcttcagctggaagcgtagtggtagtatgggcccgaatatttgtccctgccgatgctgaccatgcctcccaggtcctggctctgggttccttgacctagggacaagatgggttgaggcgatcttggagcccagttgactttgacatgcgcgccgactttattcgtccactacccgggctaggaatttacctctcttttcattagcttacaattcattgagcatcggtgcctagggttccctcccgctattaagactggggttcccgggttttttctaactacccgtccgagtgtggcctttccaacaaatcgggcaccggcgagcacggcgccatcccccgtgctgtggggcctccccccccgggaaagggcgccgct

SEQ ID NO: 495480 - DNA, 211 bp, Homo sapiens
cctggctctgaacttaggggtgcagttcctggcaaagatggtgaaaccccatctttactaaaaatacaaaaattagccagatgtggtggtgcgcgcctatagtcccagctactcaggaagctgcaataggagaatcgcttgaacctgggaggcagaggttgcagtgagccaaggtcgcaccactgtactccagcctaagttcagagccagg

SEQ ID NO: 495481 - DNA, 387 bp, Homo sapiens
tgctgtcgtgggcatgcagttaaccttggcaagataaactttctaaactgattgagatttgtctcagatacttcgttcacaaactatttttaaagtcccagcgtaatttattttagcagctaaaagaaaaatcttggctggcacgttggctcatgcctgtaatcccagcaccttgggaggccaaggcggttggatcacaaggtcaggagttcaagatcatcctggccaacatggtgaaaccttgtctctactacaaatacaaaaattagtgggcatcttggcatgtgcctgtaatccccgctacctcagaggctgaggctggagaatcgcttgatccagggagtcatgggttgcagtgagccgagattgtgccacttcactctagcc

SEQ ID NO: 495482 - DNA, 879 bp, Homo sapiens
gagtgaccggaggcgcgggggagcggttccttgtgggctagaagaatcctgcaaaatgtctctctatccatctctcgaagactggaaggtacgaccaacgtacttcaggctcacactgctttttctgcaaaccctgccaatccagcaattttgtcagaagcttctgtcctatccctcacgatggaaatctctatcccagatgtatccagagctctctcaatacatggggctgagtttacaatgcaagaagaaatacgtgcaaatgtgcgccgtggtttctggtgcaccacttcaggggttgggtagcaagaccttccagtataaactatatggtgctcctgtaactggtacatgatgtgggaatcgtagagcagaaattaagcaagggatctcgtgaagtccatttctgtgtaaaggatccagatggacaaccattttgactcaggctttacaatcactacgatacatggtatatctgtcagctagtccaggctaattctccagcctcattggttggtctgagattgtgggaccaagtactttcagaatcactggtgaaaactggtgcaggatggagcttctgataaaagcgcaccaggttgctcaacacaggctttggagaggaagattaccatgaccattcgtgacagtgcctttgaaggacgattacatgctaaggatagccgtgcacatgtgcgttatcttaaaatggaataaactcctagtgaaggtagttgaaccgaatgtcttccgggatacgtgtggacatgcacagttttggtgaagccccgtgcgacaggaactgggggacatacaaggctggtaacaatacgcggcgataggtggccccgcgaagcagaggagccctgctttttccaa

SEQ ID NO: 495483 - DNA, 680 bp, Homo sapiens
ttcggcacgagaacattttatcattatgttaatactttactttgaaaggtatcattattttcaagacgtatcatttaactggtctactttatctagttacccacacctatgacttccataagtgaaatggctttatcagggaaaacaaaactagcctggataaatggggttggattggagacctaaaccaaaagctttttttgggctggccaagttggggcctggccacaggggccttcaagatcacctggatgggaagggaaatccaacctggtctttcctttaacaagttggttaacttggcacgggctgtattagcctggaggacaagctggcttttccaagggggtctgccataatggctgaaattttgtgatcattactgggtgaagcagaatggaattttttacctttgtagtgggcgttttatttattacaattaaaagaggaaagatggcccattaaagggagagtatccaaagcttaagggctcacagtttaattggtaaaggcaaacccttatggggaggttgtgtaaggccctcaaacttataggcctggtggcttttgctaaaatcccttttcttgggactccctttaagggctaggggttaaaaaccggccttcttggttcacacaaccctttcaggggttcgtgttacaccactttggttttggct

SEQ ID NO: 495484 - DNA, 149 bp, Homo sapiens
atcatcctgttgcgccgttttttaagcccgtcagaaaagcacagtattcgggtgggagtgacccgattctccaggtgccgtctgtcaccccttatactttagattaggacaaggtaactccctgtacccctatgcgccttccccgagac

SEQ ID NO: 495485 - DNA, 344 bp, Homo sapiens
tggcatttgatgagtaatgcattaaacctctaggtcattttgtagagaaataattatattattgagtctggccattcatacatgtattctagctaccaatttatttagttcttttttacttcactcaattttaatgttttaatttttattttgtggagaggtcttgtgtgcaatttaatcctaggcatttcatcatttttattgctatcctaaatgatatctttaaaaattttaggctgggcatacatggtggctcacaactataatcccagcactttgggaggcagaggtgggaggatcagtagaggccagggagtttgagaccagccttggcagaacagcaa

SEQ ID NO: 495486 - DNA, 469 bp, Homo sapiens
gcggtaccggtgtatatcgatgcactcttcaacttcatcctccttcgcttcgcgcttcttccaggagggcacaatcttggcatgtgtattctggcataggctccgcggccatgtgctcctggctcttatatctcgctccacctgctctgtctctccgcgctcctcctatagcccgcagtgcagccataccggtcagcctctaggcgctcggcctcctcctgtgcccgcttcctctcctcctccagatgcagggccctctgaatctgctccgatagctctctctctgccttctttgtcttctccacgcatctcaacccattgataggcaagtgccgtcttcatcatgtcctacgctcggccccctcaagttctgggagcggcgattacaacactacacgtgtgggatcattccaacacccgccttgtccacacagctggacaaggaaccctggggctgaatgacacaacc

SEQ ID NO: 495487 - DNA, 612 bp, Homo sapiens
tacccattgtttgaaggagtggagttggtcagaggagacacctaagtgtgagactcggaaacagcagaagagtggaatggggtctgatcacagggtcaccaggatgcccaggggcatcaccagacacaggactaggatgaggaagtctttgaattcaaacaggaagcttgtctcaggtgatcaataatccatttcttgtagaaactaacttctgtgtaaactccagggtatcctttgcgaccgcagccaatgccccagctcacaatccccacctggacccatgtgccatttaattcacagaccaggggccccccagaatctccctggaaaaagaaagacagtcactgtaggaaagaaataggatccacatcagagcaggctaattgcactgcaatgcgctacagagctaagcactaagggggcttccccaggaacccctaagaccctcctagccttaggtatctgtcaatatgagatctgagaattgacaatttccaataaaccaaaatcatgtacctactaaaaaggcgtgttccaaaaaacggaatatacctcatgaaattgtgcctactctgagacaataatgagtcaagtgctaacctgagtacactg

SEQ ID NO: 495488 - DNA, 118 bp, Homo sapiens
tagcttgtacgccagaagcggcggattacgacattaccaatgttttggaagggatcgggctaatcgagaaaaaagtccaagaacagcatccagtggaagggtgtggggcctggctgca

SEQ ID NO: 495489 - DNA, 130 bp, Homo sapiens
agccagacagaaaagcaataaagaaatagcagacgtgaacaacatgttaggccaaagggacggaacagggcatatacagagcattccatgggaacaggaagcagaatatacactcgtttgaaggggcaca

SEQ ID NO: 495490 - DNA, 337 bp, Homo sapiens
catgctagagggccttgacaaaaccattattgccgctttttaattgttattaaccacaaataagaaatcattttaggccgggtgtgatggctcatgcctgtaatcccaacactttgggaggccaaggtggtcagatcacctgaggtcaggagttcaagaccagcctggccaacatggtgaaaccccatctctaccaaaaatacaaaaattagctgggtgtggtggtgcatgcctgcaatcccaactactcgggaggctgaggcaggagaatcaactgaacctgtgagatgaaggttgcagtgagccaaggtcgtgccactgcactccagcctgggtg

SEQ ID NO: 495491 - DNA, 736 bp, Homo sapiens
ggcccatcgatttaaccacccctgtctgaaattattaggagggtctcgttcgcttcgttccttcattctgctctcactgtgtggtcgacacccctggagaccccattttcataaagttacaaggacacacttcttgtgcgctcttacattactctcgcctcaaaagtagcctcagaaggaacagccaattgcgctctaccttctacccaccctccaacgccgcttcatattgaaacgggtaggatccaagccctccgcttaggatctctgaaagcggatttgtggctgcatgctgcaagtgggcgccgagaccacattacctccctacccgtcagccgcgcgcatcggaccaacgcattaccacaacccagctgtcccttctcccccgccacgaaaacttcgcctacgctctcgtagaccggttgcaccgttcaagcaatagttgcgcgtgtcgggtgcttcttcataatcttgcccaacatgacagactttaggatgcccctccatcaagggagctcctcaggaaaacccctcggtggtgcccagtacggatacggataatgagcagtacaatccttcctcgagggtcaactgtctcaggcttggggaggcccccaaaaaccagcacacgtcggactcgcacagacattcttccaaattttccctcccctaggttcccacgactacacctggggctcacaatcggctcctatccacaaaccccctggccttcaac

SEQ ID NO: 495492 - DNA, 176 bp, Homo sapiens
tgatctaaaggatccccgtaatcgatgacgtaaaggctcctctagaagggatataaagcaccgccaggtccttggagtttaaagctggtggctcgtagtggttcgggcgagcagtttgtgtggattaaactggtgaaggttaagggtctaagcatagtgggggtatctaatcccag

SEQ ID NO: 495493 - DNA, 342 bp, Homo sapiens
  misc_feature (15)..(15): n is a, c, g, or t
  misc_feature (46)..(46): n is a, c, g, or t
  misc_feature (232)..(232): n is a, c, g, or t
  misc_feature (234)..(234): n is a, c, g, or t
gcctttcctcctttnatccaccattaaaaaaattaccaccctttgnaagagttcaggattgaaaatgaggaagagaggccaggtgcaagttgtcgcgcctgtaatctcagcactttgggaggccgaggcgggcagatgacagggtcaggagtttgagaccagcctgaccaacatggtgaaaccccatctctactaaaaatgcgagaattggccgggtgtggtggcacacgcntnataatcctagctactcaggaggctgaggtgggagaatcacttgaacctgggaggcggaggttgcagtgagccaagatcatgccattgcactccagtctgggtgacaga

SEQ ID NO: 495494 - DNA, 204 bp, Homo sapiens
  misc_feature (171)..(171): n is a, c, g, or t
tgcgacgaaagggtggaagactcaggtggagaaggagttggaccagtcaacatctctgttgtcacaagcagtgtttcctctggatatggcagtggcaatggctatggcggtggcctcggtggaggtcttggctggcggcctcgtgtggaggtcttgcccggaggtagcagntgggagctactactccagctgttggggtcgcag

SEQ ID NO: 495495 - DNA, 945 bp, Homo sapiens
  misc_feature (231)..(231): n is a, c, g, or t
  misc_feature (341)..(341): n is a, c, g, or t
  misc_feature (362)..(362): n is a, c, g, or t
  misc_feature (474)..(474): n is a, c, g, or t
  misc_feature (536)..(536): n is a, c, g, or t
  misc_feature (553)..(553): n is a, c, g, or t
  misc_feature (581)..(581): n is a, c, g, or t
  misc_feature (882)..(882): n is a, c, g, or t
agcgcgctgctgcggctgctgcgcacgggtgccccgatccgctgtgtgcctgcggtaggggaccagtgcagggaccgggtcgcgccgtgcctatggacctgtatccacatctggagggagcgcggtgcagccgctgactcgcagaagttaccggccgtcgttcgtgttaagaagtgtaacgtgggtcacgtacattgtcccccgtttcatgatagttccatcatggaaggntagaactcgtaacaggaggaacaactggcattctctatgaagcaaagtcacgaaactgcatgcagtactgacgcaatctggtaaacactatgcagttggtatgaagatancgctcggatggatcaaactgnctaatatatggagacttggccagccaagggcagccaactgaaaattcccatttaaagaccaacttattgttacacagggatggacacaggctatcggcataatgtggtggcncgaaaatagttcttttccctgtaacaagggggcttactactaatgggacatctaatggatanccactgcgcctcagtancattgcgggacacggagtccctcagtgnagaaacaggagtaacgaaaggcacgaagacgtgcttgtatgggaggcactagagtagagttccctatttgtcactggttatatggccgaaagaagttacagggcgtgcgaagagggaattatcgtgtatcctagtgggtagggacggaacaagggttattgtcaagtggctggaaagggaattcgcatttggggaatattttcgggccatcgtatactttgacgtggaacgggtgtaataccagtacttgggacagagttcaagttggcatgattcaaagttgcgaaactgacatccatgnaatgtccctacagagagggtattcactggaattagtatgaattgacatggattgaacggaaag

SEQ ID NO: 495496 - DNA, 246 bp, Homo sapiens
gcgccattactgtccttactagaatgagtacaatttaaaataatcccatcagtgggcatattaaataaagtttcgggttaccccattagtttttaattgagcgtaattttcactttttacttcgacgttttaaaaattatccagtaacatccaggccttttcctccctcttccctgaaactacagggctggcagtggtgtgtctgctttccaagtcactggagcacactctgatcgcaatgccagc

SEQ ID NO: 495497 - DNA, 1311 bp, Homo sapiens
  misc_feature (983)..(983): n is a, c, g, or t
ggggttccaatataagaggggggttttttctttataaatatttttctccacgcgctcccaacatatttggggataataaccccgctgttatttttcttgttctcacagggggaaataagcccctttgtttgtaggaaatggcctcaaaactttgaaggaggcttggtgtataatgatcccctttcggtgggggggaaatgaatcgattacttatttatgttggttatgcatatgtctgtgtaggtggtggtagagtaaagatagggatgtgttagcatccccaatcgggaagattgtttttttggcgccttcttattgtccttccttctgtgggtggagaaaaatttgtgtgcagaaaaattttttcacctctcccaaaaaagttgtgtcacacacggcgcgtcgtataaaaatttgttttgtcccccccacatctcacgggtggtatacctcgtgggagggggacaaattgttgttttatgtgttggtgtggaccacaagcagggggtgggccgtctgtgtcccccttcatattatattgtgatccccaatcatggtcgcccctctcaacatggggcgacatgatgtgtgatagacgtctcgtctgttaataaggagacattttttttaaagggcgttttaataaaagttgtgataatcgttgtctaaattagagagatggtttaaggcccctctgtgagatatacacccactacggagagtggttttttgggagagtgtctcacagtgggagaccctccccctgtgtgtcttttctctctctagtctttctctctctcgctcttctctcaaaagggccacattgagaagccctgaaaatagtgcccacaaacttgggcacagttatagagagagcgagaaaagagatggcacattgggagagagaaaattttatagagagagagcgtttctcaaaactcttttaattcttcaaatgttccacacacatggggtcttaaatntggtataacaatataaataaataatgccctcacacacactggagattgtataaaaggcacatgtggagattctcttgagaggagatttttattattttggtagaatgtgaattgtgtcttttgcacgtaattataaagggagaaagaagagaaattaaatgggcacattaaccctatttttgtttttgaaagccacgggtaagttgtaatgagattttgttaaccacagcacagtggctaaacctgagaatgtggacctggttaccttgggaaagcagggacttatatgaatgtactattaaattaaaagcgggctgattccccggga

SEQ ID NO: 495498 - DNA, 632 bp, Homo sapiens
tcctctcacaaggacctttattgaaaaaacatgcacagctgccgggccctgaaagccccaggggtcccattcaggaagaggcaaccaaaaacaaaccgagggccccaccaacagctcgtgtgcgcgggctctcctctctgtgggagtgggtgtggcagcaacagctctcactctcagcaacaccctgtgtgtatctcattcatctcgaggttcaccatgtgttattcaagaggccgcgggagaagcgtggagagtggcggctccccgcggagttgtgtatagaagagggtgtatgtgccaacaatcaagcgtctgctgtggtgaatagaggagagagtgtgtgtatagactctctcgcggaaacaagtgtgcgtcgcagaaaattatccgagggtagagggtcactcagcaacgagagggacagtggtagagtgagggagagggtggataactctctcaccccaccaccacaacaagtagacaaccaaaacaactctcatcccacccataatgaagggagaaggaaaagaggagagtcggcacgagcatcaacacgccggggaacaatcaacccctagctgtgaggaaaagcctcccccctccccccgaagagggaagaggaaagagaaaag

SEQ ID NO: 495499 - DNA, 354 bp, Homo sapiens
cagcaggtccgaactccataactcttagcgattacacattagacaacaaggatatagaacgaggacagagtaagtttagctcccaccgtattcagacctctataaaggagtcaacgcagaatgtgaccttacatgaaggagtccacgcaaggagtgagcagcgtgttcagggagatcacagcctcctctgccatctccatacctacatcaaacctaaacaggagaccgaccccttagaccccgtcgtagtccaggaaatgtcagtgctgatgccaaatgcaaaaaggagcggacgacggacgcattcgtcgaccgatatgggaactcctcattctatacatccttactgagtac

SEQ ID NO: 495500 - DNA, 143 bp, Homo sapiens
  misc_feature (2)..(2): n is a, c, g, or t
anagtgtggaatcagcgtgtctccaactctgtatcagcgcctctagctcttccccaagtcccgtttctgcttctcagctttattccgggaagcacgctcagactccaggtcttcctggagttcagagacctgagcaagccagg

SEQ ID NO: 495501 - DNA, 214 bp, Homo sapiens
cgtgcggcatactcagcatgtcacgcagtcggtagggaaaggcgcttggctggccagaagtatgccacttacactgggaggctggcagagtggggtgcaaacagacctggtgcaatggtcatcagccggatacctatgggagccatatcccgagcaatgggcagtgtcatgcccactataccccccttggaagcagagtatgcagattgaccaa

SEQ ID NO: 495502 - DNA, 151 bp, Homo sapiens
cggaccgtgcggcaggggggagcagtctgcagctgggcctgaaacgggcagctgctcaggactggccagtgtcttcagcagatagtctcctgctcagctgggaatttttctctattagttcttgattgctctttgaggacctccacaacct

SEQ ID NO: 495503 - DNA, 344 bp, Homo sapiens
acccggtccccttacgtttttttaggcaatcctatcccacctcttcttggaccagttcactcacccgatgggcccaacacttcatcatccaccacctcctggagggggtaccccgaggtgctccgctggcgactctgctcattctgggggtgggggtgacggctggccgtgatctttcccgtaatctggcccctcttacggaacctaggctccgttctgcccatggccttcttctggacactgataggatccagaagagtatgttatcaattctcaagcctaggagaagccaggagcagagaacagctctgagacgatactgcgggccaactgatctccaggca

SEQ ID NO: 495504 - DNA, 482 bp, Homo sapiens
  misc_feature (15)..(15): n is a, c, g, or t
  misc_feature (147)..(147): n is a, c, g, or t
  misc_feature (349)..(349): n is a, c, g, or t
  misc_feature (398)..(398): n is a, c, g, or t
  misc_feature (408)..(408): n is a, c, g, or t
  misc_feature (423)..(423): n is a, c, g, or t
  misc_feature (427)..(427): n is a, c, g, or t
  misc_feature (434)..(434): n is a, c, g, or t
  misc_feature (449)..(449): n is a, c, g, or t
  misc_feature (466)..(466): n is a, c, g, or t
  misc_feature (474)..(474): n is a, c, g, or t
tcggggggcaccccnatgtaccctgggatcgctggccgcatcagaaaagagatcacggcgtgggcgcccagccccatgaagatcaagatcatcgccccgccggagcgcaaatactcggtgtggatcggggggtccattctggcctcnctgtccaccttccagcaaatgtggatcaccaagcaggagtacgacgaggccggcccttccattgtcccccgcaaatggttttagacaccctccacctccagcacgcgacttttcaggacgacgaattttttcaatgggggggggggtgagctccaacccccccgcagtccctttttttgtaacaacttccgttgctgccatngtaaactgacccagtgtttataacggggacaaacattaacttattaccnccttttgttnttttttgaaacaaancccngtggaanaaaatggaaaacttnaaaaagccttaaagtcnttttgttnagctgcga

SEQ ID NO: 495505 - DNA, 258 bp, Homo sapiens
tagcctagaggtaggtaggtaggcagttgagtgcgccgcagccgcatctgtgcccgaagccgcaggcggtgttgtaggcgtcgctatcctgaaccgctgcagcgagagcaccaagacggaagctgagcgtctgcctgtctagaggctggacgcgcacgtccccacgctagacgtctcttgccctttgcctgtccctgtctgactctgcctaaatggtgtacctgacgctctgcaattctgtcaatccattggtccatc

SEQ ID NO: 495506 - DNA, 8494 bp, Homo sapiens
  misc_feature (7307)..(7307): n is a, c, g, or t
  misc_feature (7545)..(7545): n is a, c, g, or t
gccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcggagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccagttcggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgagctttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgtgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgcgggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcggcccccagatgctgacctcccaggctccgtgtgtagatggcttcgaggagccaggagcacggcagcgggccctcagcgcagtcagcgtcctcacaagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctaatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcaccggcctcagaagcccgcagcccttgccgcccagggccagctgcccagctgcattgccaccccctactccccgccacccccagagacggagaaggtgcctcccacccgcaaggaaacacagtttgaggaaggcgagcaaccaggccagggcacccccggggatccagagcccgtgtgtgtgcccatcgctgtggccgagtcagacacagatgaccaagaagaggatgaggagaacagcctgggcacggaggaggagtccagcaagcagcaggaatcccagcctgtgtccggctggcccagaggccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgacgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcggccccgcggatcaaccaggcagagttctgtggcgccgcgtggacagccggagcagttggcctgtgcttggaggcctcagatagacctgtgacctggtctggtcaggcaatgcccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctcccaaggtcccattttcccccttgtgttttcacgcaggtcatattgtcagtcctacaaaaataaaaggcttccagaggagagtggcctggggtcccagggctgggccctaggcactgatagttgccttttcttcccctcctgtaagagtattaacaaaaccaaaggacacaagggtgcaagccccattcacggcctggcatgcagcttgtccttgctcctggaacctggcaggccctgccagccagccaatggaagagaggggctgagccatgggggtttggggctaagaagttcaccagccctgagccatggggcccctcagcctgcctgaagagaggaaactggcgatctcccagggctctctggaccatacgcggaggagttttcntgtgtggtctccagctcctctccagacacagagacatgggagtggggagcggacgttggccctggccctgtgcagggaaagggatggtcaggcccagttctcgtgccccttagaggggaatgaaccatggcacctttgagagagggggcactgtggtcaggcccagcctctctggctcagtcccgggatcctgatggcacccacacagaggacctctttggggcaagatccaggtggntcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagagcaggccagggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggaggggagaagagagtaggaaaaaggagggaaggacagacatcaagtgccagatgttgtctgaactaatcgagcacttctcaccaaacttcatgtataaataaaatacatatttttaaaacaaaccaataaatggcttacatgaaat

SEQ ID NO: 495507 - DNA, 1382 bp, Homo sapiens
  misc_feature (889)..(889): n is a, c, g, or t
gccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcggagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccagttcggagagcggctgtgaagattctggttcactcatatcctttgcagttaatacctgctgagtaccccctgggggcccacgctggggatgtgcacgtgctgcccccgacccacctccattctagtttaggagtgagagtagcgctgattccctgctggtcctaagacaaatgcatggtcatgacctgggagctggttggaaatgaagaacctctgaccctcctccagacctgccaagtcagcacctgcattttcatttgatccccaggggattcttgggcacatgaaagtttgagaaaccctcttctgattcttcagaacattctagaagctaagctactgaggatcccagaagaaatgacgtctgtcgggctctgatantggtccaaatattccgtgccccgacagacgtcccttgggtccggcgtactccagagcatagcaggaacctgctaggaggtcatcagaagctggtccaggaacaacatttcccaataaaggaggcgtaggtcatcgcaaatgcacgatgcagacacagcccggggcagcagaacggggcggaaaacaagttcggacaggccatggtcaatacgagtctgagccaagtgcttagcagaaagtgggagattggcgggtcccaaatagaagggagttgagtgggaaaccgtcacttcattgctcgaacaaaaggagcaacggactaacgaaggattagtcgacagatcacgggcgaggtgacaacacggtccagtagatgaacacagctagctatctcacaacacatcgacttgaacagactactatcaagtatatacaactacacgtacacatgtcgtctcacagctgttcttacctataccataccaccaacgag

SEQ ID NO: 495508 - DNA, 152 bp, Homo sapiens
  misc_feature (114)..(114): n is a, c, g, or t
  misc_feature (130)..(130): n is a, c, g, or t
ataatctgctctgtacctcccagggtctttgtgagtccattgctgaacttgatacactgaatgttgactcatacaaatgacatgcacaaccagtggaccatgcatgggtgatcnctctagatgtctgacnctgcatgtgcatagcaatgctt

SEQ ID NO: 495509 - DNA, 218 bp, Homo sapiens
tgggaggctgcagtgcactccagcctgggcgacagagtgacgacatctgtctccacaacaacaacaaaaaattgctaaacatattgttacctatcttacatactctacattatattagcatgtaatctatttactcattcacacatgactcctattaagagtcaatgtataagtgactcatctagatttacatgtctgatgagtaaatctaaggttat

SEQ ID NO: 495510 - DNA, 419 bp, Homo sapiens
tgattatgcgggggctggtgaaaaggagaatcttgaacgacattgtgtaaaccaggtggagaaatttatggaactatggaataaaaacgatgagttcagaaaggaataccttaggtgcaacatgaagagtacgttgaggagattcagaacactagatgggcgagcccttggccctgatgaagagccaccatacgtaggaaatttttctgataatagagtaaatgcttcagccaaggtcaattcagttgatacaacttcagccttggaaagtgattttcctttaatagcaaaaaaggcagaagaatcatcaaagaaagttatagagctgaagaataagactgcccttgtccaaaaccaaaagcagagtgaaattacatctaaaagtagcttagcagaaccttctggcaggattgagacca

SEQ ID NO: 495511 - DNA, 215 bp, Homo sapiens
  misc_feature (22)..(22): n is a, c, g, or t
  misc_feature (152)..(152): n is a, c, g, or t
cctagaggaccccggcagaatncactcaaagtcctgcactaatctgcttttttgtccctatagtcctctttatgagtatgctgtaaatttggactcacacagtatgtaccctttaagtctggcttttcttaatgtctttgagattcattccntattgttgtatttatccagttgattctattttttatttgctggtgtagttgtatagaatattt

SEQ ID NO: 495512 - DNA, 301 bp, Homo sapiens
tcaaaaaaaaaaaaaaaaccttgctggttttacggctcagggggcatcacggaacctgccaacatgtggtatctcccccggacacccagctttaaaatttctttcttttgtactctttccctttatttctcagaccggctgacacttagggaaaacagaaaagaacctacatgaaatatcgggggtgaattttgcccaatatttggctgaatttcccccatacccagaaggtggagcttgcagtgacccgagaccacgtcactgcactccagcctgggtgacagagcgagactccgtctca

SEQ ID NO: 495513 - DNA, 779 bp, Homo sapiens
  misc_feature (779)..(779): n is a, c, g, or t
tgctgccgtggttcacctcgtttcctgctcgatgccggcatagggaaatctacctgcacataatggtgcccaggcctgagtcggaatcacctgtcaccccggacctgcacacacatctcaagtaccggcagtcaatgttgcgtgtggctaaccatgggcagtcaggctgcagctcattagctattctgatgtcaaataatcatgtgcgggcgacctgagcgggactgacggagacaatgcgtacgcatgctaggtgtgccgggactggtgactgaagccatggatgtgggaggcgctgactgcttgctatgaggactcctgaagtcggaccagacccctggtcccccgactcctccactacggcaatcaattgaaacgggagaaagcccacgagactgcatattacgtgttagtccgcaatcggggagctcaatgagtgcaagctcacactgaatctctcttgcaacggtggcacatagtagtccttgtcgcgctctttgttggtcgccaacgtgtccatggcaccagtccagggattgcaacccctcaaacacgttggctgcaatacgctcgggttattctgacacagggggagttgggggatgcatacttgatccatcgacttcctgggggatgcgcattgattatgcacccgttccgatgagtcagagcagccgcctaaagtgtgactgactgaaacacttgatcgaaccagctcgtattaactactcagaggccatacagctcgggtgggtcgatcctgtgggcttggcaacaan

SEQ ID NO: 495514 - DNA, 261 bp, Homo sapiens
  misc_feature (204)..(204): n is a, c, g, or t
  misc_feature (210)..(210): n is a, c, g, or t
  misc_feature (245)..(246): n is a, c, g, or t
cccgatagcccgacaggaattgggtaagagattgtatggagagccgggcttggtggctcacgcctgtaatcccagcactctgggaggccgaggcgggcggatcacaaggtcaggagttcgagaccagcctggtcaacatggcaaaatcccatctctaccaaaaatacaacaaattagccaggcatgtgtggcaggcgcctgcanatcccnagccactcaggaggctagaggcaggggaaatcacnnccgaacccggcaggc

SEQ ID NO: 495515 - DNA, 347 bp, Homo sapiens
actcgagcagcgcagtaagcacacagagtccatgctgccagtgacagtcatcatttcagcaatcatcaggatttccattttctcaccttgcctgtctcccttctagagatgtgtctgtgaagagtgtttcccgaggagatttggtgtgggagtctgtggacggagtgcagatcagccctcaacatagataggcaccatccagatggctgggggcctagacagaacaaaaaaaaggcagaggaaatgggatttcctctgtctttcttctgtagctggaacattgtcctgcctttggacattagaactccaggctgtctggcctttgaactcaaagacctataccagtg

SEQ ID NO: 495516 - DNA, 263 bp, Homo sapiens
  misc_feature (15)..(15): n is a, c, g, or t
catatattacccctntcatgtcgtaaagaagacattttctcttagagattttcatttatagtgtatctaaaaaaaaaaaatcttgtgtaaacttgcatccatctttttcttgggtgaggacacccaggaatgaccctttggtgtctataatgttgctgtacacaggctatacttgataggcctagtacaatcttgggaacagggttactgtatactgaaggtctgacagtagctcttagactcgcctatcttaggcaatcaag

SEQ ID NO: 495517 - DNA, 1627 bp, Homo sapiens
  misc_feature (685)..(686): n is a, c, g, or t
  misc_feature (758)..(758): n is a, c, g, or t
  misc_feature (770)..(770): n is a, c, g, or t
ggtcaacgactgcagcctcatccacaataatgtctgcatgggcgacggtgttcgtggaaccgagactggcagatggtggaagcttggtgggcctggactacatgtattcggtccagggctaacggtgggggacctccccgtaaggggatccccgagacttgagcagttatgaacccccggtagttggatgactaagcagtggactagagtggtcagagagaagtgggtcagtcgagatcgatgtggcgcttggtgcattggcatcatgtggggaagtctgacaatgggccacctgacgctcgggcagcatggccctacgcataccctgggaagatccccaaagacgtggtggtgcacccattacgtgtgagctggtgggagcaaagcgcccaaggtgcgtgcccaacccagcccgcttcctgcagaactgtcgggcacctggtggcttcatgatgcaacgctttgtagaaaccaacctcttcctggaggagattcagatcaaagagccagccgagaagcaaaaattcttccaggagctgagcaagagcctggacgcattccctgaggatatctgtcggcacaaggtgctgccccagtggtgagcgcttcgagttcggcaatgctggggccgttgtcctcacgcccctcttcaggtgggcaagttcctgagcgctgaggagtatcnngcagaagatcatccctgtggtggtcaagatgttctcatccactgacgggccatgcgcatccgctcctgcagnagatggagcagntcatccagtaccttgacgagccaacagtcaagcacccagatcttcccgcaagttcgtacatggcttcctggacaccaaccctgccatccgggagcagacggtcaagtccatgctgctcctggccccgaaagctgaacgaggccaacctcagtgtggagctgatgaagcactttgcacggcttacaggccaaggatgaactaggggcccatccgctgcatagcaccacagtctgcctgggcaagaatcggctcctacctcatgggctagcagccagacacagggtccttaccgtctgccttcagccgagccactagggacccgtttgcaccgtcccgggttgcgggtgtcctgggctttgctgccaccagaagctctactcaaatgaacgactgtgcccagaagatcctggctgtgctctgcggggctcactgtaggatcctgagaaatccggtgcgagagcaggccttcaagggccattctggagcttccgtgttccagcttggagtctgtgtcggaggacccgaaccagctggaggaagtggagaaggactgtccatgcagcatccagccctggaatggggaggaagccgcagctagctgggcaggcctgggccgtgaccgggggtctcctcacgtcaccttccaaggctggatccggatcggcagccaaaccattgtcccgcagagaaaagccaagattccccaaaagaaccagggcgtgaagagttcctgcgccaggccggaacccggagtcacggacacccctaacaacctcaagggcgcggggacgacagacgaggagagcacagacacagcacgaggcgagcacggacgcaagacaagggggagagcgaca

SEQ ID NO: 495518 - DNA, 273 bp, Homo sapiens
acagcatctactccctcatcttcaggatcccgatggcgcttctgacccgctgcggggtcaccaagctcttcttcatcttcctcgtcatccacctctccatcgatataaccttctacatcctcctgctgtccactcgcgtcctcctcttcaccttcctcctcctcatcctcgtcctcctcgtcttccactacctgagcatctacatcatactcctactgatcctcatcctccttctcatcatccaggccctccacgtagccctcagcatccgag

SEQ ID NO: 495519 - DNA, 2043 bp, Homo sapiens
agggcgggagcggcgagcggattccatgagattgccctgatgcatgccccacctgcctgcctgcctggcctagttaccatcacacccctgggatggaagccgcagctgcctgcagccgtgccccatgtcaccatcacctgcaaccatgagcatgcgatggcctgatgacccagcatgccgcaccgcagaacccacacaagcacgacaccaagccacaatacagaagccagacgaacaaaccaaacaccagagacacaaaaaagagaaagaaacagacacacggagggcgaagagacaaccggagcggaatcaaaaaaacagagagaggaaacatgcaccaggccgacgacccaacacaaacgcaaacaaacagccaccaacaaaacgagacacagagagaacagacaagcgacaaacatagagccaaacaagcgacaccagcgaaaccacagaaaacaacgccaacacaacaacacaaccaaagcgacaacaaacacccactcacacacaacaacaaaaaacacaaaaatcaaacaaaaccaatcaacacaaaaacaacaaaaaatgacacccccactcacacacccaaccacacacactcaacacacacaaaagacaaaaccaaacacaacacatataccacaaaaaaaaacaacaacacacaataaacactcacaaacaccacacaccaatgccaacaccaccgccacaaagacgaaaaagcatccagaccaaacaacaaaagaaacaagcaaagcaaaagagactgcactcacaaggaagaaagcgaaacgaaacgaaacacagaacacaccaacaacagagaaccgtagacacaagacaaaacagagcattagcaaagcgacaaaaacgaagacaacaaacaagaggagcaaaacgcagaaacagacaccacacacagaacacgaggcacaaacactaaaacgacaagctaagacagaccgcaaccaagacaagcacaagaatataagggaggaacaacacagcagaaacccagcacgcacgaaaccaagacagcccacaaatgacaagcagggagaagagcgacacagcacagacaacgcacagcgccgcaaaacagaagaccgccacaaaggcaagcacagaggcagaaagaacgccgaacacaagagaacgacacaaagacgaggcagaagagcagatcacagaagacacaaacacagccagagcaagccaacagacaaagccgccgaagacaagagcacagcggacagagagcggcacaccaagacaagacgcaaagagacgaacagcgcggacagcgaagctgacagaggcgaacaaagccagacaggagaagacacaagagaagccacaagaaaagaagagcgaaaaaccacagacaacacaaatacaacacagacaaagactaaatcgacaccagaaagaaacgacacccgagcagagagcgaacagagcagaaagacgagccgaagagaaacaagagacaagacaaagagcacagcaaaagtagaacgagcagagcagagagagagaccgggaatagacgcacaagaggagaggaacccggaagacagaagacagagacgcacgagagagcagcagacgcgccactacgagaacgcaccgaacacacgatcgaacagacagccagataagaccaacaacaatcgagcattgacacgaacaacgaggacaacgacacgaacgagatcaggaaacgaacgaagcgaccgaagagcagcgcgggagcagaaagaagtagaaaacaacaaagcaacgaaaacagcatacacaagaccagagacagaaagagagagcaacaaggcgagagaaccgacagagaagaagaggaagagagacaacagacacgcacagaaaacacaagaagaacgagagcgaacgaatagagacaacaaagagcaatactaagtagcaacacactcagcatcgcgacgcacagacagcaggagcgacaagatcagcaagaaagagagacagaagaacaaagagacatagagaaacatacagaacgttcgg

SEQ ID NO: 495520 - DNA, 673 bp, Homo sapiens
cgaggaggacgatgccgaggggcaagaccaggacaagaaatctcccaagcctaagaagaagaagcacaggaaggagaaggaggagcggaccaaaggcaagaagaagtccaagaagcagcctccaggcagcgaggatggcatgctgtgtggtgagcctgtgtgcatgaagtggctgctgccagatgtgatggatgcatgctccctgccgtgatgtccatgctaactcccatcctacgcttgaaagattccttatgtataacattgaccttgtgagcatcctgtggggcatgtcttgcagtgagtgacatgccacgtgtcacttgtgtgccatctgttgcttgtgagaacagtgatgcatgcatgcatctctacaagggcatgtgagctcagctgtgctaggactacactcaagtgccatgtgatggccccggcctgcaggggctacctcctgtccacgattggcgtcccctgtgcctttccagcttgccccaggcgtctccaactgaagcccagtattgtgttcaccatccagagcatcgtcatggcgcagaagctcaaggggaccctgtccttcattgccaagaatgacgagggtgcgaaccacgagaagctggacttcagggctgcacttcagctgcagctcctacttgatcaccaatccctgctacagtga

SEQ ID NO: 495521 - DNA, 244 bp, Homo sapiens
ggtaacaaaaataagcaatggggaaaggactccctgttcaataaatggtgttggggtagctggttagtcatatacagaagactgaaactgggccccttccatacagcatatacaaaaatcaactcaagatgaattaaagactcaaatgtaaaacctaaaacctcaaagataacctaggagataccattctgatttgacttttgtgcatttttggctggagtatctcgtatagatttcttcactg

SEQ ID NO: 495522 - DNA, 992 bp, Homo sapiens
ttcggatactgtgagggctagaatccggtggcattgatatcatgaatatgggatgtgcatgctgcattactttcatgggatggagaccggttgattgactaggtcgtaggcattacagaactcgtggatacaaacaggatcgttggatacggcgattgagatcagtcaccataggaacccgtagagaatagtagactattggtctcaaccatacctcacatgctaccaatatcaattcagtaactgactgactaggaatatggaagtgtacatcctacacaacataggtgataggctattggaacttgtactatgaattacaatacaccctgatggcatcttgtccccagaaatgactcatatgaaagtgcagactatgattggctccatgctgtgcatatgctagatatcactgcatgtacttagaggatggacctagaatgtggcattcacatcctagactagcggagtattggaaagaagaagaaggaattcatgcctaattgttggactccctcgcactgggagagccctcttgcaccgaacctctatcaaagagtcgagtccccgaatgtgagcacgcgaggtcatttcccgccacgtattcatactgatggctagagagtcaaatgctatgggcgcccgttgatccatgagcatcttttatcataggccttgaagctggttgggtccgtgtcacgtagaaatctcaggccaggtgtcatgcgtagttcgcatcactcgagatgaaggtccctctagggtctccgagggaagaaccgtagaccgtagccacgaagttgtctaaccctcgtgcaatgacgacgtggaacaccgatgtgctcattgaaggtgttgccgtcttgtgtgactgcatcgaggctatctctagctcttgagtaaaagaacctattttggaaggttgctcgggtgtcccaataataggttccctcctgagcaaggtgggattgtgtgcccattcgtaggggccg

SEQ ID NO: 495523 - DNA, 636 bp, Homo sapiens
  misc_feature (514)..(514): n is a, c, g, or t
tttatttatttatttatttatttttttgagacagagtctcgctctgtcgcccaggctggagtgcagtggcgcgatctcggctcactgcaaggcttggccccctgggttcacgccattctcctgcctcagcctcccgagtagctgggactacaggcgcccgccacatacgcccggccaatttgttgtatatttagtagagatggggtttcaccgtgttagccacggtggtcccgatttcctgacctcgtgatctgcccgccttcacctcccaaagtgctgggattacaggcgtgagccagcatgcccggcgagatctgatggtttaaaaaaagcaagaggtcccctgcacaagctctctctttgcctgcgtgccattcatgcaagatgtgactgtgctccttttgccttctgccatgatggtgaggcctccccagccacgtggaactaaattattccttgtgcaggtggtgcaaaggatcagcacgggagtttgacctgctccgtttccgacctnggtcggttcacccctccttaggcaagcgtggcggttcccccgcttccaggggagggtcaccctctgtgatgctgaatttagcagggacacctgatgggcacagtgcacttgaagcccaagag

SEQ ID NO: 495524 - DNA, 502 bp, Homo sapiens
cggatcctatacattctggagcgatcatctagttactcgaccgtggggtgctcatgacttggaatcggcctgcttatagaatcgtctgggctgggagcccactgtccgaggtcaaccttcccagaatcctggattccccctcacaccacctctgtagtgtcacccccttcccagccctgttttcgataaatgttccctgcaaccagtccattctcttaatcgccacacttcacagaatcttccatccccctcccaccttctaggcgaatagtccccaaagctgtgttcctccaaggggtccgaggaatcactcactcctggaggctggcaaggagacagtctgaggccaggaacacatgaagggatgtccccgccccagcactatcagggcctccccaggcttccagagttgaaagccaggagaaaatcggcaaagaccacccttccctaaagccaagcacccaatgatgctaaaaaacaaaaacaaaaaaaccgacaaatc

SEQ ID NO: 495525 - DNA, 735 bp, Homo sapiens
  misc_feature (729)..(733): n is a, c, g, or t
ctagagaccacagccaaagtcctcaagcagcgggtcgatagcctcaccgccaagcttcagggtgccgaagcgccggacaccgtcagggacccagctgtgggcctgctgcgctcgtgcccccacagcctacctgccgcccccacgctcgccacccccacgcttgccaccccagcctgccctggagccttggggcccaactggggcagaggggcacctggggagtgggtgagcatgcagccccagccccttctgcccccgacctacttcctggagggcgagacactgtcgtggggccccagctgggagcaacagcagagtgtgagcccgagggcccactgcgagagcaagccccgaggttttccagaggagggacacgtggacgtgaaaccagacaaaaggctgcagagaggcgtggcccccttccaggccctcagcccctctgcggggagctcatatgcgggcccagccacgctgcaccctatctggggctccctgggactggaggagacgccgtcggtcggaggggcagattctgtggcgccctgcaccccccggagctgcggtaagggcgaccctgcggacaggccctgggctggctggtcgggtggccggggcatccaccgagaacaccttccactgcctagcactcgagcttggccctacggggtagagaaatccttttccacgtggagagcatccacgcctcgttattaaaggttttagaggctnnnnnga

SEQ ID NO: 495526 - DNA, 204 bp, Homo sapiens
ggtggtgtggttgtgctgggtgatgatgatggagctgacagtagaggtggtggtgacggtggttgtgttggtgatgatgatgatggagatgacagtggtagaggtggtggtggtggtaaaggtggttgtgttggtgatggtgatgatagtgaaggcggtgggagtgggagtggctgttagggtggttgtatccgcaatcttctt

SEQ ID NO: 495527 - DNA, 367 bp, Homo sapiens
gcacatcagaggacccatgcgaggtttgtctcgcacctatcttccattggaacatgattgtggactcacctcatccacttatggcagcgagtgtgtcgttgtgtgtagtgcagtgcagggaactttcctgaccttatttaaacctgggccgaggattcgtggaatctgcttgatcagagactctgagtgcaaaaacgcatcatacttcttggccagcttcttgacagttatttattcttgttgagttagattcagcgcctcgatgtacatgtgtgggatatccacggtcttagcttcaatcacagtgctgctgttcccccaggaaacaacacagagaacttagtgcggggagtggacttaagcctga

SEQ ID NO: 495528 - DNA, 481 bp, Homo sapiens
  misc_feature (475)..(479): n is a, c, g, or t
cgaggtgtgtctcaggctcctctcctgctgtgatggcttgggtcccccgtcccgtgctcccggctgaccagggagtgaagccaggtgccctcttctccaaggttttccagaggagggacacgtggacgtgaaaccagacaaaaggctgcagagaggcgtggcccccttccaggccctcagcccctctgcggggagctcatatgcgggcccagccacgctgcaccctatctggggctccctgggactggaggagacgccgtcggtcggaggggcagattctgtggcgccctgcaccccccggagctgcggtaagggcgaccctgcggacaggccctgggctggctggtcgggtggccggggcatccaccgagaacaccttccactgcctagcactcgagcttggccctacggggtagagaaatccttttccacgtggagagcatccacgcctcgttattaaaggttttagaggctnnnnnga

SEQ ID NO: 495529 - DNA, 423 bp, Homo sapiens
tgcatgcacaggagatgctgcttctccttacagaattcacaacaccccatcccagcctgaagcccatcagagcttcctgtcaggcggatggtccagctccgatcttgaacacctttccagatttcccattgtataatggatggtcccactagttgtcaagttccttccacctagccaaaacaagctccaaactccatgcataccatggctcacaatgcccctgtccaatctaggccctgcatacctctccacactcatgggcagcctttttcccttcctctgtctgcatcccaatggcccaattgtcaaggccaataccactaggggtttaggcacctactgcctcctctatcaagggacattctctcctctccccctgaaacttcacagagcgtagttccttcaggttccagctcagatact

SEQ ID NO: 495530 - DNA, 484 bp, Homo sapiens
attcggacccccatggtgttggtaccgggaatcgcggccgcgtcgacaggaaatgcaggttgaacggaattctctggggctttggggaatttatgcgtgggtgaaccaagaaataccaattaataactacgtcagttgttagtgttggttaagttgttgcttggaaatgagaagtcgcttagaaactttccgaagtgcttaaactttagtgcacacaccgacacactaacaagcaaaacattgttttgctttgctacaacggtggggaatacctaacaaatgtgcactgaaaacaggtgacacagatcaccagtccccgaaaaccgccgggaagggtgtgtgatgccatctccccgcaggggagatgtctttaccagcttcctcctggtggccaagacagcctgacccagggtcgttcgtctggggtgtggtgttatcactaatcagcccttgaaaaccgctccgacgtcatacccacaatcac

SEQ ID NO: 495531 - DNA, 202 bp, Homo sapiens
gtcgtctctagagtatcccgcgacagcacgcgctaacaacatggtcatccgggacgacaaccagaccaatccgcctgcaggaggctctgaacctcttcaatgagcatctggatacaacagagcgggtgcgcaccagtctctgctgatccttgttcctcaacacagcaagactctgctcgactgagcaaagtcccttgtctgg

SEQ ID NO: 495532 - DNA, 651 bp, Homo sapiens
gtgcggggcatgcttcgagcacggcgcgttgagccgctgggtgagcaacggttgtgggttttgcagaagtaatagcgcaccaactgggattaggacgctgcgactcgggacagtgggcgtggtcagcaccagcaggggttcggtgtcttccggaatatcctgcaaggtcacatgcgacaccgagagctggctgtcggagttggtcaccgaaacggaagcttcaccatcggcctcgtggacgatcaccacggatgtgtccgggaccatgccgtcagcctgtgcttggttgccgaatatcagcagcagggcaataaggccgaacgcggtgttagagcatgtcatcgtcatgacgggttccagattaggcgaaatgagtgggtcagaggtaacgcaagtccagaacgatggagccgtcgaggggcacttcctgattcagggtcaggtactgcgaaaagttgatggcggtgtccacttgaagctggaccctcaactggctgatgaagtcgggctgacggtcgcccgtcggagcaaatgccatataggatcgtggatagccattgggctcgggcgtccagctttcgccgctgttggagggaggcaggacttgcatggcctgggagtccccactgggttgggtacgacaacgcacgg

SEQ ID NO: 495533 - DNA, 332 bp, Homo sapiens
attccctttgtcaaccagtgttcctcctctaaatcccagaacacagaaaatgattcgagtggctgctttctcagttctcccaaggatggcacttgagtagtcccactctagatgagacgaatgacaactcattacataaaatggacgccttaggacagtagggcttcattctttcctaagactctgttgaaaaaagtaatttcctttctttaaaactgtcttgaagaagtagctgacaaaccaaacacagatatttatttgaaacatgttaaaggccgcaaaacatcccaaatgtccaaacattttaagggatgactaagtgaataaacccc

SEQ ID NO: 495534 - DNA, 120 bp, Homo sapiens
gcccgtagtgtgtgattggtgttgtgtaggtgggtgtgtgtgcttgtggtttggtttgttgtttgtgtgtgttgttgtgtgtgttgtgtgttgtgtgtggttgttgttggtgtgtctttc

SEQ ID NO: 495535 - DNA, 1010 bp, Homo sapiens
gacacagtgcgggcacctcgctgtcaccaacctggcgctgagtgccctgtaacctggcagagtgtgcatgtgggatgccgtgtctgtggctgactgctggccgagatctatgtggcggctgcattgagagtgaagacccagttctcccaacgggccttgcgatttatctgacaacgcttcttcctgagcagtgccccgccaggcctgtcctggcactagcagtggctcagtgcctcctgccatgcagtggctctgcccaccgccgtgggccaccgtttcttcgtgtgcactggggactgtttcctgtgctctatgtaccccatgggagagcctgtatcagacttggccgggaacccagatggactccctctgtgcccagtgtgactacagatattccagggaacgtctcttagtagcgagcactgaactgtgtgacccagtccaaacccagacctgggtcacctgacttggggacaaggagattctcggatgccctcgggtaccgttgcagcgtgctgaacagactgtgctgatgctgcaagtggcgtcctgcctacagcttctcccatcagttccagcatgtgcaccacaccggcgtagacccggtggcaacgtggtgggcctctctgacagctgctggttggatccactgatgcggcgggatgaggaggggggttgaagcggttgtgcccgctgatggggcaccttggcgcgggtgctgcaggagcctgaagacccctgccagagggaaggatctggcactcccttcaagctgcctgggcctgtagcgcctgtgccacgcaagattcttgtccacgcaggcttgccatttcttgtgccgagggccgtgggacctgcaaggatgctgggtcaccacacgcatggactctgttaaaaggcgtgcggtggctgcgtcaccggctttggggtgcccccttgcgatgagacgtcctgccgcaagcggacaagagcaaccatatgacaacgagcaaactcaggaataacccaag

SEQ ID NO: 495536 - DNA, 103 bp, Homo sapiens
gaagagtttgctggttgtatgttaaatatatgtttaaatttttaaagagactgccaaactattttctaaagtagctgtaccattttgcattactaacgacact

SEQ ID NO: 495537 - DNA, 2481 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctcgagtttttttttttttttttgaagcccaatttttttaaaaaattaacaatttcaatccaggaaaataaaaggtttgccttcaataaccaaaggaggagggttccttggaaaaccttttaaaattcaagttaacccaaaaagacctttttaattttggttccacccaccaaaccatttggtaaaacttaaaatttttaagggttaaaatattttaacccaaaaggttaaaataaaccaaatttgcggttactgggcaaaatggctttttgttggcctttcgttgaacaagtcccttaacaaattgtttaaagtttggaggccttgattgggccaggccaggaacctaacccttttggaacttccggtttaaagggtggcctttgccttgcccgaaaaaggatttcacaaccccttttgggggctcccc

SEQ ID NO: 495538 - DNA, 2613 bp, Homo sapiens
  misc_feature (3)..(3): n is a, c, g, or t
  misc_feature (22)..(22): n is a, c, g, or t
  misc_feature (1972)..(1973): n is a, c, g, or t
  misc_feature (1975)..(1975): n is a, c, g, or t
  misc_feature (1978)..(1978): n is a, c, g, or t
  misc_feature (1980)..(1980): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaanntnggngntttttttgttttttttttgaatttcttgctaaggccctttttaaagtggggttttgttaaagcaacgggttagagaatttaacggtttagttgtgttcacccttggggttttaaatttgaaaaatcctcgtggagcaagatcagctaaccagtatgcacaattcagagcgtataaccccgcggggggggggagacataaggggtccaggggacatctttcaattcggggaccaaaattgctccaattagaagaaggacaaccacttggtgcccccgggggtgtccccgagcagggtttccggggcccgggaaacataaacagggccttactacagctaacaaatgcgtctacatggtaagacgcggggggctcagacgacacaagggcccaggtggtgggaggccaaatgtcggaaggaagtgggtcccttgcggggcacaatcagaaaatcttttccccccttgggagaagaagttctgtctggcggccaggtgtggtggcacagccgtgacatgagtcagagaaactgcgcccgggctaaaaattcatggcagcccgagagaggacaacagggccgacacaggcggcaatggactagaaaagagcaagtagagactatcaactcaagaatt

SEQ ID NO: 495539 - DNA, 237 bp, Homo sapiens
gcttctgcattttgcactgggactgccatctggctgccgtcaggttggctcgtaggccgggcagagtgggagagtgccgccctgtccaactgccaagcaccaagttgcaacgggctccttccggtctggggacctcatgttccctgaatcagcttctagccacttgcgtggcaagacacaacacttacctccaggaatgtaccggccagcgggagcccatcgtatcacgctcaatca

SEQ ID NO: 495540 - DNA, 1976 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcagcagggcgggtagcaccacctcggtgtatccataaatggtactgcaaacaaaaaaaatcgggattatcgggcgcgaaaa

SEQ ID NO: 495541 - DNA, 406 bp, Homo sapiens
gccagaaatatcttacaggacagaataatatgtacaagaatggggtcccaatccagaccccgagagagttcttggatctcgcacaagaattcaggtgagtccctagtgcgaagtgaaagcaagtttattaagaaagtaaaggaataaaagaatggctactctaaggctgggcgctgtggctcacgcctgtagtcccagcactttgggaggccgaggcaggtggatcacccgaggtcaggagttcgagaccagcctggccaacatgataaaaccctggctctgctaaaaatacaaaaattagctgggcacggtcgcacacacctgtaatcccagctgcttgggaagctgaggcaggagaattgcttgagcccggtagacggaggttgtggcgaggaaattacggcca

SEQ ID NO: 495542 - DNA, 826 bp, Homo sapiens
ttcagaccgtagcatcaccctcccatcctgccctcaaaggcatgacctggatccagtcggcctgtcggcggtgtagtgggtgagcctagggctgtgaggtgcgcgccgtacttcctcttgctctacccgccgtttcatcttccatgacaacaacaacacctgggagggccactactaccactactcagacccggtgtgcaagcaccccaccttctcctatctacgcccggggccgctacagccgcggcgtcctctcgtccaggtcatgggaggcaccgatttcgtgttcaaagtgaatcacatgaaggtcaccccccatggatgcggccacagcctctgctgctcaacgtcttcaacggccaatgatttgctgtgggccgagggctcctggcaggtgggcatccatgctaggatgtgacccacaccgatggctgtcgtggccctgggcatcaaactacctcacacggagtacgagatcttcacaaatggaacaggatgcccgggggcgctatctgctgttcaacggtcagaggccctcgcgacgggtccagcccagacagtggccggagaagagagccacgtcctaccagatgcccttggtccagtgtgcctcctcttcgccgagggcagaggacctcgcgggaaggacagtggaagcagcctgtatgggcgggccctgggaggcgcgcctggtcctgctggtgggtgacttgctgcttgtccctctgtgcttggacctcggcagtggaattttgacttctatttttccccaggatctttttggcgttgtttcccgaagctttttcttgggctgatgcggatgccc

SEQ ID NO: 495543 - DNA, 1958 bp, Homo sapiens
  misc_feature (3)..(3): n is a, c, g, or t
  misc_feature (22)..(22): n is a, c, g, or t
  misc_feature (1912)..(1912): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcagtcggacggggctgnggctaaggcatttaacccgcctgtgcggctctggtacctcccttta

SEQ ID NO: 495544 - DNA, 1999 bp, Homo sapiens
  misc_feature (3)..(3): n is a, c, g, or t
  misc_feature (22)..(22): n is a, c, g, or t
  misc_feature (1907)..(1908): n is a, c, g, or t
  misc_feature (1914)..(1915): n is a, c, g, or t
  misc_feature (1925)..(1925): n is a, c, g, or t
  misc_feature (1933)..(1933): n is a, c, g, or t
  misc_feature (1952)..(1952): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaacaggnnggctgnngggtagggcnaataaccntccctgtccactgtctgtnttacgtcgtaattagagcacactgggggcgcggggcggcgcggggtg

SEQ ID NO: 495545 - DNA, 870 bp, Homo sapiens
ccaattttgaggccaataacaccgtcggtcgatccgtttccaggattctctgggagactcatggggcattctcttctcccaccctcggactttaccccagtgtgcaccacagagcttgggcagagctgaacagttggaccagaatttgccaagaggaatgtcaacgtgatgccctttcaatagacagtgtcgaggaccatctttgccttggagcaaggatatcaattgcttacaattgtgaaagagcccacagaaaagttacctttttcccatcatcgcatgataggaatcgggcagctggccatcctgttgggcatgctggatccagcagagaaggctgaccaagggcatgcttgtggcacaggtctcgtgtgcggctgtcgtcactggttcctgataggcaagctgaagcctgtctatcctcttaccagtttaccactggcacggaacttcggagtggacgattctcagggatacgtcaatctctctcccagttgaaggcagacacacacaagggttggcaacccccagctgatgtgggacggacggcgactagtgtcgactgtgccttcgcaaccacatccctgacgaccggacgccaccaacctttttccccgaaaaaaggcagctctccacccaatagagttcccatctggcacggacatacctccggtacaaccccagtcttaagtctctggaggcagctggatggtgctgcagccacagcgattgtcgccgcgcactggtgtcccctgcggcagttcctacccactctgggggcaccaaggccaaggtttaggtggtaaacaggtctcactgacgtgggctcgagtttgcattttccatccgtttcacccttctcactgcgcg

SEQ ID NO: 495546 - DNA, 1259 bp, Homo sapiens
tggcccttgggggtgtgccccacgcgccccccgtatatattgtgtgcccccccccccccccccatttggggggaagacgcccgccgccctgtggggctttttctcagcgtgggttcttccaacgggtggacattttactccccccttggtgaccccctgtgcccccccggggccccctatattttatatggtccccccccggggcttattttgccccccccctcggtatatttggggaggtttgtggccgccacacacccccggggctttcaaccccaccgtgggggacaacaaggggccaaacaggttttttttcccctgggaagaaccctttcgtaaaaaaggcggccaaacatacagggtttcttggaatatcccggccccccgcgtttttcttggggtgtaaaaaaaacgtccttggggaaaaagagtttggggccccccctcaaaaaagtttctctgtggagaaggttctcttggggtgagaaatcccccgcgcccacaattgggggttgacaatatatgggggtttcccccctggcgcacaagaggccccccaacaatagggtggttggtcttttggagagaaggccccttttctctcccaaggagcctaatatcccacccctctttggggcttctgcgctttgggccgtgttttcgcgtgaatatatgtatgacccacgcgccacgcttgtccgcgctggtgggtgggttcacatcgccccataagtgccccccaccccggctttggtggagcccacacagagagagggcgttgggcctgggagagctttgggccacacaggctccaccccacagagttctctggcccaccgagaaaggcgttcacagagagaggcgctataatatggagaatatattatatcgccctttataaatatcccctcgcccacaccccccacactctctctatatttccacagtgggtgggagaagagaccgggtgttccacagagacctcgtgttgtgttcacacattgggccacatcttaaagtttatagtgaagtataaaaagagctcggtgtaaatgagtaaccaacatgcactcgtaaaccctctcacgaaggaaaaggaggaaatgttttgtggagcccctttggttttcttttttgcgtgtggcacgcttttaaattatattatgtttttaaaatcacgtactttttaatgggaaccacttggccccaaaatttgtccaccagaattttgagaccccatttaaaaagtttaatgagga

SEQ ID NO: 495547 - DNA, 2077 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 495548 - DNA, 332 bp, Homo sapiens
  misc_feature (101)..(101): n is a, c, g, or t
  misc_feature (156)..(156): n is a, c, g, or t
  misc_feature (166)..(166): n is a, c, g, or t
atgctcatcagtaaaatggaaataatttctccaggccaggtgtggtggctcatgcctatagtcccagcactttgggaggccaaagcaggcagatcactttnaggtcaggagtttgaaacctgacctcaagatggtgaaccccatcttttctaaaantacaaaaaantgagctgggcatggtggcacatgcctgtaatcccagctattgggaagctgaggcacgacaattgcttgattctacaaggcagaggttgcagtgagctgagatcacggcattgcactcctgcctggggtgagagagtgagaccctgtttcaaaaaacttaaagcaaa

SEQ ID NO: 495549 - DNA, 1928 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 495550 - DNA, 919 bp, Homo sapiens
ggagagaactagtctcgaggttttttattttgtgttttgccggtgaattctttaccttataattctagtcatctgggttaacaatggaaagctcggggaatccaaaattaacttcctgtgcccggtgagcttttattatagaccaccagaaataaagttccaaccttgtgtcccacatggtccggctggtgctatggtccaaatgaaccttaatgagcgggttgccatctagttggacgcggattctctatgcccacaatttcgctggggaaagaccaggtcctcgagggaatggacttcgatgaaccagctgcacacaacgatcgcggttcccggggaccgctttggctatatattttcggaacgcggactatatatcagagtagggctataggaaagaattctcctctgagccgaataaaagacgcagaacatgcttcccactgaatcttttaactccaattgcggcgttaccaagccggtactgggaatttccgtggaaaagaattcacagtgagagaggaaagcgggaaacaagaggataagtgcataagcgttcacgcgaaccaaccaccaatattcaatctttcctagagcgtgaccgatatcatatcaaaggtgctcccgtggagacgtgaacaccgtgtgacagggatcgcaagaatcacaatacatccaagactccacgagaaaagacgacgcgagtgagaaaacaagttgccggggacaccaccgagaagcgtcggtccaccggggcactccaccgcaccaattgggggcgctaccaagagaaacctgagggcggacaccggaaccgtggaagcatgggggctacgcggcaccccgggggcaagaacactgtggcccgttgggggaacaacaagggaccgcgggcaagtggagtggcaaccgaagagag

SEQ ID NO: 495551 - DNA, 1852 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 495552 - DNA, 102 bp, Homo sapiens
ggatcaatgagacaatatgagcctacttcacaagagcgccttcccccgtcaatgatatcatctcaacttagtattatacccaccaccaccaccactggcgct

SEQ ID NO: 495553 - DNA, 104 bp, Homo sapiens
aggatgagtcggatctagcttgcggctgaaaacagggcacttcattgaaagtctgcatgggaaggatccagcctcctccctacccacccagagcagggagcagg

SEQ ID NO: 495554 - DNA, 1958 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccatatagcacagtttgaggagcgaatcaagtttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 495555 - DNA, 315 bp, Homo sapiens
gcgagagtgtaacgaggccggttcagtgttacgatatctgagcatataacttacggtgaagataatctcttccggaagtactacacaggtctcctgcatatataacaatatggacgagtaaatcactcagtgataatcttaaagtaccactgatcttaaacataaatgaactgcatatttaagttggcttcttataatgtgagattctggaaatacttctttgtttaaattatactttaagttctggggtacatgtgcagaacatgcgggtttgttacataggtatacatgtcatgttatccctcccctagcccc

SEQ ID NO: 495556 - DNA, 230 bp, Homo sapiens
accgtatcaatgagtacacctctaaatcacacgatctgtgggacaagcatcaagcacgcagcagatgcagttcaaagacgcttagtcgtagcgcacacccccaacgggaaacagcagtgattaacctttaacaataaacgaaagtttaactaagctatactaaccccagggttggtcaatttcgtgccagccaccgcggtcacacgattaacccaagtcaatagtttatg

SEQ ID NO: 495557 - DNA, 433 bp, Homo sapiens
  misc_feature (7)..(7): n is a, c, g, or t
  misc_feature (42)..(42): n is a, c, g, or t
ttccagnccttttttttttccatttatgcctcctcccttgcntttttttaaaattaaagaaacctattttttttaagagcagttttaagattccacagcaaaattgagtgaaaagtgcagaggattcctcatataccctccctgtccctcacacacactagcctccccccactgtcaacatactgaacccacaatgctaatttgttacattcaatgaacctgcattgacatattatcacccaagtccatagtttatattagaattcactcttggtattacaaattctgtaggttttaacaaatatataatgaggccgggcacagtggttcatgcctgtaatctcaacactttgggaagccgaggcaggaggattgctggagcccaggagttcaagaccagcctaggcaacatagtgagaccccatccttacaa

SEQ ID NO: 495558 - DNA, 1909 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccagcaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 495559 - DNA, 266 bp, Homo sapiens
  misc_feature (5)..(5): n is a, c, g, or t
agtanctaaaccacagcatttccaatgtcagcatgcaaatggccttctcatcggacagcagatgccatctaggactttcatagctgacgaggagaagtcaatgtctagtgtccaaaggacaggctgactcttgtgttacgggctcatgctgctagcaagtttaagttaaatccactgctcatttaccatcctagggcccttaagaatcatgctaaacatacctctgtctgatgcttttttaatggaacaacaaagcctggctggta

SEQ ID NO: 495560 - DNA, 263 bp, Homo sapiens
cgatcttggaacctgtacgggcataacggtactcagaaggctacgcgaatatgccgacggctcgccgtgcagcagtgcgtgacaatccgcgtatggtcgtgcgtcggcgcatgttgtggttcgggatacgactggcatgagtagtcaggtcaattctttcagagccttgccaaccagccgggacaccgagttgcacgccggacctgccgcgcgcaagcagcgcgacccacgccaagcgcgagcagacagcatgcgctaagtag

SEQ ID NO: 495561 - DNA, 1210 bp, Homo sapiens
gtggagtttcgccatggtggtcaggctggtcttgaactcctgacctcaggtgatccacccgcccgccttggcctcccaaagtgctaggattccaggcgtgagccatcgtgcccagctagacgtcttcctttttttttttttttgggagacgggagtctcactctgtcgcccaaggctggagtgcattgggtgcgatctacggctcactgcaagctccgcctcctcccgggtatcacgccaatatctcctgcctaagcctcctgagtaagctgggactacgggcacctgccaccattgcgcagtataattataggtatattatagtaagagacggggttaacgccgtgtgggacaggatggtctcgaatctccgtgagtaggtgatcgtgcccgcactttggcctcccagagtgctgggaagtcgcaaggtagttgagatcaccagcgaccgtggcccctttataggtttgattatatttacgaccggggacttccatatgtcatccggaattttcgcggccctgaagctccatagaaggtggccaaccagatatgggatacacccaaggggaagtacgacaatactaatagggcccgcggggcgacgacagagatgcgacaactactgtgcagaagggagagcgggcacacaagcagacaccgggggaataaccgaaaggaaaacgatcccccagagagaacaccagggggcggcgcccccaaacacaaatacagggggaggaaagagaagagcagccgccacggcggggggcccccagaaccgcctcacagagagaccgcagagaggggaccagagcgttcggaggcaaagaaggggggaagccacacacacatagtgatagcagcgcgggggatatacaccaagcagagccagcaacgacaatatataaaacacggggaatagaggagcccaaaactgggcgacaaggggccaccaagcgaaagggtgacagcggacatccggtaggggcagaaaccgcagaactttggcgcccgcagcatataacggagaaaaaagacagccggagaagaggcggacacaagcctgacaaccccgacatgagaagaaacgacagggcgggcagaacaaagagccccgaagtgggacacaccgcggagaaaagtgaacacccatccaaaaacagaaaaaaactgcgacaggaaagaacaaagagaaaaaaagcaggaa

SEQ ID NO: 495562 - DNA, 445 bp, Homo sapiens
aggagatcaggaagcaataacgagagccacgtcttcacagctcagcgagaaaccgctgcacctctttctagtggtgtctgatgctctctacagtgttgagagaaacttctccagtaacgaactatacaaatcatcactgaggaggatagtcgtttcctgagtcgcttttaatacaaacagtctgattctcatttaggagcataggctgttaccgggcagggaaacagtatattactagatcttctctgacaggaaccgggtgatcagcgttgttagactgtgcatcccggttgtgggtcattccctctagacttctgagatacaggccattgactctcttggaaggagaaatagtcagtgtatttgcttgtaatcttgcagtattggtttaagagtgtgtttaataatacacaatatgcagactcagctaaggtatcccccagta

SEQ ID NO: 495563 - DNA, 289 bp, Homo sapiens
atccccgctcgagccaggacctggcacatgtatgaatcatctatttcgagatataaaacaatgaaaggaacagaccttcggcttggagttgtatgcctctatgaactgaattgtttattgagaagagatgattccgttatacccactcacgattgagctgtctccttcgtgagtgaatatcacggaatcattctcttctcaatagactaattcagttctgtcagttcataccccatccgacgcacgaaggatcttttgtgttttattgccccatcgtctgcagaatcaa

SEQ ID NO: 495564 - DNA, 756 bp, Homo sapiens
gcccagtacctctcccaagtccacacatgcgaggtgatagcatgctttcgtgttaattatgtaatgcagaatttttataatcttcgccttaatactttatcatttcgttttattcttgaatgatgaggcttcgtgcccccccttcccccttttttagtccccctaacgttgatcatgtatgaaggcttttgggtctccctgggattgtgtggaggcagccagggcttacctgtagcactgagcttgtagaccatgttgaataagaagtgcacaccttaaaaactgacaatcataaagaacacaaaacaagaaataaagaagaaaacacccttggagcccatctctgtgtgttatcctaggtgccggcagcgacagccggaacatggatggtacgcacgatgggttcaacgactggtttcctcctagcgccctgcctttccttgttgcacacttgggcgtggacaagttctttgtgcggaggcctccaccctgacattttcgggagtagcgcaatattatagtatatcgggaaacatccgcgccgtggtgaacccggcgatgtttcattacaactcggagaaaacccggtgagggacggtccccacgggacccgaaaattccattgaacacccctttacagacagatcaattgcctcatcgccccaaggtggtgctcgagaacacccggtaggtatgcgaggcccatcaccaatgcccacacctgatccggggtggcaccagcttgggttgcagaca

SEQ ID NO: 495565 - DNA, 152 bp, Homo sapiens
tccgaaggagtctatacaacgccacgtttagtgccttttggtgaatatattccagtatccggtttactgaaatgggtgttgcctgccatgcagaatgatccgtcgatacgtggttattcacggtggtgaacaacagcaacaaccgctttcta

SEQ ID NO: 495566 - DNA, 945 bp, Homo sapiens
cgtggtgcctcctgccgtgcaatcccagcatttgggaggccaaggcaggcggatcatgagatcaggcgattgaaccatcctgctccagcttggtgaaaccccatgtttactactcggatacaaagagtagcggggcgatggtggtgcgttgcctgtagtcccagctactcgggaggctgtggcagtagaaaccgcttaagcctgggaggcagagtgttgctagttgagccaaaattgcgccgttgcagtgagccgaaattgcgccgttgcaattccagcctgatgacagagctagactccctctcaaaaaaaagaaataaaaactctagtaaggcaaagatgcggtctcgaaaagtgtgcccggaaacgagagattatttcgtttataacagcggtgtggccccaggtggcactcatgtgcgttgtaaatgccaaaaagagttgtgggaacgtgccaaggcgcacggttggactcacccttgtgcgctcagcaggttttcgaacacatagtctgtcccacagtgttgttgaaacccgtacatcctttgtttaaattctacgaaacatttgcctggcaggaggtggacttctcggctagaaatcccaacccagttggtgatgggccaagggcaggtaggataacagcggtccaggccagattctaagacctcttgtcgcctaacattgttaaacccgcattctgtctaaaatttcgacaacttaggtgggataggggtgggatgtcctatagtcccagcaactgtggaggcctgccggagcaagaggtttagtggccaaggtttgccgattgcttcaacctgggaaagaggaactccttgtcgacacaaaaaaaacaaatttggggcgaccgaaaagttaaacttttgggcgcgcagaaataaaagcgcacttccaagaacgcgcatgtgtcacaaacacgcgcgg

SEQ ID NO: 495567 - DNA, 147 bp, Homo sapiens
ggcccctggagtctgtggagcttggcatctggtcaccctccggcggggcatcacctctgagatctgaactttgggcacagtcaggcgcttcagagtggttccctgagcccccaggttacagccagagtgccaggaggaggaggagga

SEQ ID NO: 495568 - DNA, 319 bp, Homo sapiens
tctagaggatctcaatcgcacgacatgtagactcagagaacccagtgcctgatagtccagtcagcctctgtcatcccagccatgttcctagtgtgctccagcgcttcactggcccctccccacaggcggctgggacctgaacatgaaggagctgaagctgctgaagaccatcgcgaagggggagttcggagacgtgatgctgtgcgattaccgagggaacaaagtcgccgtcaagtgcattaagaacgagcccaatggccagggcttcctggctagaaggctcagtcatgacgcaactgcggcgtaccaacctggtgga

SEQ ID NO: 495569 - DNA, 606 bp, Homo sapiens
agcggaggcaaggctgaggctgcagtgggctgtgatcatgccactgcattccaacctgggtgagagagaccccatttttaaaaaaatatatagggccgggcgcagtggctcacacctgtaatcccagcactttgggatgccaaggcaggcagataacctgaggtcaggagtttgagaccagcctggccaacatggtgaaaccccattcctactaaaaatacaaaaattagctaggcatggtggcaaatgcctttagtcccagctactagggaggctgaggcagaagaatggcttgaacccaggaggcagaggtttcagtgaaccgcgattgtgccactgcactccagcctgggcgacagaacaagactctgtctcaaaaaaaaaaaaaaaaagggataatccattctgggcatgatttcaaagacagagtgagaaattgaaaaatttctgtccggctaaatcatctccaccagaattcaaaagaaaaaaaaaagcttataaatctatggtccatgttaaaaaaacttgcttgtgatgcaaccaattaattggagggagcacaacctttttttaccaattttgacagcctgcatttggcttgggaaa

SEQ ID NO: 495570 - DNA, 104 bp, Homo sapiens
cgcttcgcggagcaggatgagccgtgaacagtccgaaggaagtgggacggatgatagtgatcagtatggaccttctttccttggtataactgaattccttcctc

SEQ ID NO: 495571 - DNA, 290 bp, Homo sapiens
gccagaaaaagcccggggggttcccaaaacgtgttgggctgatctcccgcccggggcccccatttgttgtttagggtccggggtctattctgattggttcaaaaagacttttctgaaatggcgtcttccctttgggggcccccccgtccccctaatggttctccttccccaaacacttacttaattcttctcctagcccttttttttttttaacagatgttgtaatttaccccttgattttcccatttaccctctgttttttccccttgggataaaagttaggggaggga

SEQ ID NO: 495572 - DNA, 122 bp, Homo sapiens
atgagtatgaggacactccctaggatgaagcaccttccgattcctgttcttttaaacaatcgaggaatataatttcaattcatcgcatcgactttatccatctgcggagtaaactatggcac

SEQ ID NO: 495573 - DNA, 487 bp, Homo sapiens
aaaaaaactcttttcgggggttcctttgttttttttttccattcccaaaaacaccggccttttttttgtctatacaggaaaaaaagaaaggtcttaaaaattttttttccccaaaggagaaactgggtcttctccctttaaaaaacacacctcgagggaaaaacccctccctacactgtgggcccccctttttacttttcaaaaaaaaaatccccccctttttgggggcccaagccttctctggaaaaaaaaaaatgtttaaaccatcttatttcactctataacttgccctgaaggcctacgaaaataatcacaacactttttccaaaaaaaaagccataacctcgcaccacacaaatgggcctctttcaaaaaaaaaaaaaaaacccctccacattcgtgctcggcagaaaacattctaattatttcctctagaaaaaatattccccccaacgcaaaaaaatggtgtatataggaccccacaacc

SEQ ID NO: 495574 - DNA, 223 bp, Homo sapiens
cgggtgaaggcgggttaaagtgcttgccacattcttcacattggtagggtgtctctccagcatgagtgatcatatgtgtagtaagggtagaggactgggttacaggctttgccacattcttcacattggtagggtttctcgtccagtatgaataatccggtgtgtagtaaggtgtgagagacggttaaaagcttggccacatgctgcagaactagtggagatt

SEQ ID NO: 495575 - DNA, 868 bp, Homo sapiens
gctcagataagtgatctctgggtcttgagagggtacgtccagaaggtgggggcgaactgtacagatcaacatatcagagacagtttggctagcagtgacctcagatatggaacatgtccgactaccgctctatgcactcattgacactcctatcgtaccagaccctccgtcttcactcctcctccgtcctcctgtgggagggtggtcagttgtggactgtagaggactcatatcaccatgcttgatgcccagttagattctgaagatctgatttgatagaagcagttgattgaatgcttaaatacaacacatggtattacctgaaagtaccagagtacctgggatttcgagaggaaccacgctatcagcaatgtactttgacatcttagcttacaacttcccataagatgtacgctggaagagtcatcggactaacgtgggagacacggtaagggtgccccctagaaatactcggaagagatattggaatggttcattatgagtcgagagcagccaaggttagagcgtcgttatgcataaaattgcttacgttctacacccttaggaatcatcaactgatagaggtttagcgccatggacccaaataagatagcttggggtacaccgaagcacattcttccatacgacagggaatagacctagcgttgtacgttacctgcacatataacttggagacggagatttgcacaatagcagacagcaagactgacagtagtcagaacaagggagagtgatctcgaaagcatattgcacacaccaagaggatcataggcacattcagagataaaaccaaatggctagaatatcacccagataggggacaccatagagtggcaaaagtgggaag

SEQ ID NO: 495576 - DNA, 996 bp, Homo sapiens
ttcgagaccatcctggccaacatggtgaaaccccgtctctactaaaaatataaaaattagctgggtgtggtggcaggagcctgtaatcccagctacacaggaggctgaggcacgagaatcacttgaactcaggagatggaggtttcagtgagccaagatcacaccactgcactccagcctggcaacagagcgagactccatctcaaaaaaaaaaaagaaaagtaagaaagaaagggactttccctttagaaggggaaagaaaaaatcataaaatatggagctgatgcccggtatatagaaaattaggcgtttctcgaaagctgtcctatgtttggcgttgtatttaagtctttattctcttcctttaggtggagaaacaaagtaccaattttgaagggattttttaatttggtcattgggttctgtcagtagaaatacccatattgtgctacccaatttttctggtgaagaaatggtttccagtggttatcattatatctaacttataacctcccccatagttatgaagagtaccctgaattgccactatggtggacactcggatactgctcctggtgaacaaatattttaacggaactcttacaacgttttccttttaaaagatctatgatggcacctgcatttaccttctaaataaccgtgccatggtggcttggccgacacgcacatgctattgtacgcctcagaagaaaatatttactggcggtcgcgggtccgtcaccacaattacgcgaggggattgggtgacctttcacttttattgagccgccgttttgtactccccctggaactgggcaatctgaaccttcccggatctggactggtctcggccacatgcgcggcttaacggttgtaaagccctttgcgatgagcgcacatagcagaatgtagtatgcacacgttacaccaacgcagacatgttgttttcccacaccttggaaacgcgcaggagagacacatcaggggtagaacgac

SEQ ID NO: 495577 - DNA, 1902 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 495578 - DNA, 1048 bp, Homo sapiens
gtcaccccttttgcctccatcctcaaagacctggctcttcaagtcatccgtcagctgccaagtgttctgtaaggaacatctacttcatctgggtgactcggagccagcgtcagtttgaatggctggctgacatcatccgagcaggctgcgaggagcaactgcatcaccaggacctggatgtctgtgcagcatctacaatacaatccatgcttggctgagatagttcgaacctcatggaccactgatgctgtacgatctgtgagcaggtacttccagtaagggttcttgaaccgcgcgtctattcgacaggccatgcgcttgccatcacccacgtttgcgcgtcctcgccactttgagcccttcttcaactcccatgccaggaggtccacccccaaggtccggaagatcggcggtgtctaggctgtggcccccactggacatgaccagaactaactgtgcgaaagacggccctgatcaagcatcatcaaccagtgcaggaaccgggacctcatcttctccccacccatttactgaggaacttactaaagcccctgaaccgtgcccgtgttctgcccactgaccccaaattagacgcaggacggtttctgaagccccaacaacctacatccttcatgcttccgtatccttatatagcttggcactgcctcaggcccttacatcctgaacttatccgcgagacttcctcaaacgccgtttgcttacccagcgttggcccagtaagttcaagtacaccattggtgctgggccttcaggggaccgccccagggaacccagcgaatgctgttcgtcagcgcatggacgcaaactgcgctgcgcgagccgacacgttgattcttaaggggggaccgtaaccaagcttgaacgcaaaggtcacgggcgaagcatcccctggaattctcggccaggcaaccagtggacagccccttcgtgcgtttccagaacacttcgagccaaatcacacttctcatacacctgagcgaccccttgactcgtgatcaacgctcacctactgctggcatgtgccctg

SEQ ID NO: 495579 - DNA, 1349 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacgaacacctgggggatccttctagatcgaccgcagcagcaagtgcctgcccc

SEQ ID NO: 495580 - DNA, 338 bp, Homo sapiens
gtaatatattactaaattcataacagtttcagaatgtcttatcaagaaaaatagaggccgggcacagtggatcacgcctgtagtcccagcactttggaaggccgaggtgggcagatcgcttgaggtcaggagttcgagaccggcctggccaacatagtgaaaccccatctctactaaaaatacaaaaattagctgggcgtggtggtgggcgcctgtaatcccagctacttgggaggctgaggcaggagaatcgcttgaattcaggaggtagaggttgcagtgagccaagattgcgccactacactccagcccaggcaacagagtgagaactccgtctg

SEQ ID NO: 495581 - DNA, 1895 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggcctattcctggggcactgttggcctggacctgagaggaattcattcccacctgcagcccttaagactcctggcccagtctgtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 495582 - DNA, 1115 bp, Homo sapiens
  misc_feature (3)..(3): n is a, c, g, or t
  misc_feature (22)..(22): n is a, c, g, or t
  misc_feature (973)..(974): n is a, c, g, or t
  misc_feature (996)..(996): n is a, c, g, or t
  misc_feature (1000)..(1000): n is a, c, g, or t
  misc_feature (1003)..(1003): n is a, c, g, or t
  misc_feature (1005)..(1005): n is a, c, g, or t
  misc_feature (1015)..(1015): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccagtcagggtcatctctaccggaagggtgaaggctgtggacccannatggcggggatccttacatttngggncgntncattgcggtncatctggggggccccaacttatgtgtggtcgtgcttaaggggcccatgccgggtacggtgaatcgggaactgaaggcacgtttgtgggacggtggcgcag

SEQ ID NO: 495583 - DNA, 564 bp, Homo sapiens
  misc_feature (445)..(445): n is a, c, g, or t
aggagaatcgtttgaacccgggaggcagaggttgcagtgagccgagatcacgcaactgcacttcagcatggacaacaagagcgaaactctgtctcaaaaacaaataaattaataaagaaggacttcccattccttggtgctggcctgtaggcagtgagcaccctgtcgctgggtgcatttaagcaggggctgaaacactgcttgccaggaattccatgaagggactggtgttctggaagggggcccagttagcgttcagaggaagggccacagtgttttccaagtggactcactggggtgtaatcatcaagaccctctgacactttctcctagccttgttggtcatgttggggtgtggactggccttttctgggttgggtttggctgcagagatagcagccctgccaggagtagccgcatgtctttactgctttccacgtagganactttttaggagtggtgccaatggcaggaattttagcatggcctagatgaggtttgattgggggtaattgagccacccatgtccccagataagctacacatcgcctagtctgttattca

SEQ ID NO: 495584 - DNA, 84 bp, Homo sapiens
gaaaaaaggggggaattttttcccaaaatttttttgaaaaaaattggggggggggcggcccaaaaaaaggcccgggggcattta

SEQ ID NO: 495585 - DNA, 1982 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 495586 - DNA, 580 bp, Homo sapiens
  misc_feature (461)..(461): n is a, c, g, or t
ttttgagacagagtcttgcactgtcgcccaggcaggagtgcaatggcgcgatctttgctcactgcaacttccagctcccgggttcaagccgttctcctgcctcagcctcccgagtagctgggattacaggcacccgccaccacgcccggctaatttttgtatttttagtggggatggggctccacgatgttagccaggctggtctcaaactcctgacctcgtgatctgcctgccttggccttccagaatgctgggattacaggcataagccactgtgcccagccagcaactggcaattaatacaggccttgtgtttccaacactgtcttctgtacaaacctgcctgtcctatgtaccattggaatgctggtctctgatgcgtaacggtggaggaaagttggtgcagagatagcagccctgccaggagtagccgcatgtctttactgctttccacgtagganactttttaggagtggtgccaatggcaggaattttagcatggcctagatgaggtttgattgggggtaattgagccacccatgtccccagataagctacacatcgcctagtctgttattca

SEQ ID NO: 495587 - DNA, 1000 bp, Homo sapiens
  misc_feature (3)..(3): n is a, c, g, or t
  misc_feature (22)..(22): n is a, c, g, or t
  misc_feature (923)..(923): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgcaaggtgatcctcgcctttaagcacgcggacttgtccccatattccagatcttcggggcaggcggccnctctacggagggggaggtgggcccgatgcgggacctccttggcaacttccttcctcgggggcccttgtgtgaggccg

SEQ ID NO: 495588 - DNA, 501 bp, Homo sapiens
aggagaatcgtttgaacccgggaggcagaggttgcagtgagccgagatcacgcaactgcacttcagcatggacaacaagagcgaaactctgtctcaaaaacaaataaattaataaagaaggacttcccattccttggtgctggcctgtaggcagtgagcaccctgtcgctgggtgcatttaagcaggggctgaaacactgcttgccaggaattccatgaagggactggtgttctggaagggggcccagttagcgttcagaggaagggccacagtgttttccaagtggactcactggggtgtaatcatcaagaccctctgacactttctcctagccttgttggtcatgttggggtgtggactggccttttctgggttgggtttggctgcagaaggtcttgaataacagactaggcgatgtgtagcttattctggggacatgggtggctcaattaccccctccctcatctaggccatgctatcctgccattggcaccactcct

SEQ ID NO: 495589 - DNA, 466 bp, Homo sapiens
cggtcatgatccaagagagaaagaagaccaggtcttaagtcacgtaaatgtgcagctttgagcttcttattcattttatttaaaaaggtcattccccggtgagttgatctggttataaaaagctgctcgggcagcgacatctggttgaaacactgctgtagcagggtccacaggctaagtagggggcaagggctcttgtaagtcatcaaagtacaagggttcccctggacacgttggtaaccaagctagggttaaagtgcacgatcgtgtgcaaacactaggaccggtcagcagagctctgagaagggctgggttcagttccatcctcggagctactgtctatgtccggctccattgctgtctcctcatcatccagctgttactagtgaagttgtttagctcaagaagcccactgggctccaccagcacattggagctggagtgacaaggaatagcatactgagga

SEQ ID NO: 495590 - DNA, 719 bp, Homo sapiens
  misc_feature (409)..(409): n is a, c, g, or t
tcagttatcaaatctatttttaatcttctataacaagtcacctttttcttcccacctatttccaatctggcgcctaggggtacagtgaaaatgatggcctcctcttctttcccgtggagtctcgtgaggtattattgtggcaaacagccagtctccacccactgtggcgtgagagaggaacttatagggaaccacagcagaaagtttcaagggctcatatagtgtgcccgtgcagcgtgcagggaattagccctcacttctcgaggtgtgggtgagtggggttaggagtgcggggcgagagaacgaggggccctaggaaaaagaaagacagagtggttcacgagtggagcccctctcgcgtggagcgtggcagaaagttctctcgcgtggtgtgtgtgtcgtgagaggncgagagacaactaggaagccatacagcgggagtctcatagaggccaagagggttaactcttttctaaaatatagaacgacatataggatctcaggggagagccgtgggaacccctcaactatagacccagtgtgtatataaccttctcacaggcgcccccacccgcggtgtgtgtacgcgaccaaagagggcgccagaaaagtgtggcaacagtgtgaagcggtctcgggggctatgccgtggccgaggccccctctccttttcttcccgcgcagagtcgtttcaggggggacagggcccccctggggtt

SEQ ID NO: 495591 - DNA, 1981 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaaatggctcattgactacaaccaggtggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 495592 - DNA, 234 bp, Homo sapiens
  misc_feature (46)..(46): n is a, c, g, or t
  misc_feature (97)..(97): n is a, c, g, or t
gacacttacgggtgattgtactctgtacctcgtgagtaccgagcancagagcaacagtctagcgtatgtgaaacgggttgacctgcgatctctgaangacttaggactttgagtcctaccgcactttgagaacttcactttaaagatacacttgtctatgatgtgtatcgatggagtaaaagcataccatgtgaaacttaaggcaccaggtgaaataatcttcgtaagttgtct

SEQ ID NO: 495593 - DNA, 1893 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgaaactgactgtcgacttttccggcacggtcatcatagctggcaccacagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccagttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 495594 - DNA, 246 bp, Homo sapiens
  misc_feature (56)..(56): n is a, c, g, or t
  misc_feature (65)..(65): n is a, c, g, or t
  misc_feature (129)..(130): n is a, c, g, or t
  misc_feature (132)..(132): n is a, c, g, or t
  misc_feature (202)..(202): n is a, c, g, or t
  misc_feature (217)..(217): n is a, c, g, or t
  misc_feature (240)..(240): n is a, c, g, or t
gagagtggggttagctctgcctagcgctacacaagaaaacctccctccagtaaatnggtgtgggnggtccgcttttggccatcatcgcacccccccggtcactgggcgttgttgccgggcacttgtttnncnggctgggtgtgtaccgtaaccgtgggtcctctgacaagtgcctaactcggcccaccccttagggtgtgtntcatcgaagtgtagngaatggtggaacgtttgtttgtngtgtgc

SEQ ID NO: 495595 - DNA, 155 bp, Homo sapiens
gacagtcgacatctacaggatccccctattttccaataagggaggaaagagttactgtgcactagtggattggtgagcttactttgcttctaggccaaggttatagaaaggtcgtctcatgggaggataccgtagcgcgaacttcgctaatcatg

SEQ ID NO: 495596 - DNA, 1535 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 495597 - DNA, 865 bp, Homo sapiens
  misc_feature (3)..(3): n is a, c, g, or t
  misc_feature (22)..(22): n is a, c, g, or t
  misc_feature (722)..(722): n is a, c, g, or t
  misc_feature (725)..(725): n is a, c, g, or t
  misc_feature (727)..(727): n is a, c, g, or t
  misc_feature (730)..(730): n is a, c, g, or t
  misc_feature (744)..(744): n is a, c, g, or t
  misc_feature (747)..(747): n is a, c, g, or t
  misc_feature (759)..(759): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgatgactgtcgatttntcngncanggtcatcatagctnggnacagggctatgntcgctcattgataagccgcattagagagttggttgtgaagcaagagaactgttgggaatgtccaatagtgcttggggggccaggttcccgcttaagacggcttgga

SEQ ID NO: 495598 - DNA, 439 bp, Homo sapiens
  misc_feature (32)..(33): n is a, c, g, or t
  misc_feature (45)..(45): n is a, c, g, or t
  misc_feature (65)..(65): n is a, c, g, or t
  misc_feature (72)..(72): n is a, c, g, or t
  misc_feature (110)..(110): n is a, c, g, or t
tcaattccaaagcccagtgaacgggatactgnncagatgagctancccggcccattaatgttaanctccctncatcaatataagacttgggcttagagttaggtctgtcnctacaccccacagaaagattcgggaacacaaattttacaaacacacaaagctagggctttcccaggcttttcattgtccttaaattgcctaaaattaaactgtcctttgggaagtttttaaatagcaaatgttttacacctcttgaaatttgcaacattttctttcatatatatgtgtatatatgtgtgtgtgtgtgtccctcatgtcttctaatggaaaagaaaaatgaagttcaattatttgtttttctttatccagtatatatatgtatattttctgattgtgttgtttttctgtctaaaagtttggtcatgcttcaaaaaaaaaa

SEQ ID NO: 495599 - DNA, 661 bp, Homo sapiens
ggggtcagaaataagattttttgagttacaaataaataagatcagactctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaattttgggccccttggccccaagtttttttaaacttggaaaattttttctttggggcccaatttggggcttttttggcaaattccccctttggggggggtttttaaaaataaggggccgggtttttaaaacgggttttggggaaaaccccgggggttcccccatttaaaccctttggaaaaaatcccctttttcccagggggggtaattcaaaaagggccccccccgggggccttttcaaaaagtggcgcacccttaaggggaatgggaattttggggggttaattttttggaaaaaacgcgggaaaatttttggtaaaacccctcttttttaaaccaatgggcccaattgggaaaacccccttttaaattaaaaagattccccccaatggggttaaggtttttcccttttttgaacaaagggccctttttttagggggcctttcccccctggggggcc

SEQ ID NO: 495600 - DNA, 121 bp, Homo sapiens
agcgctgagcatactggattttcttaagaaatgaggaaaagtgcaagtgatctcagtacggtgggggaaaacaaaaattaagaaacaagacaagtggcacctggccactgtgctgccttaa

SEQ ID NO: 495601 - DNA, 281 bp, Homo sapiens
gtaccacgagtggagtcatgtccccgtacgagtaccattcaggggtcaaccactctgtgtacagcaacgtgctggtccagaacagccgtgcgctttgttgctgacctggcccagtgacctgggtcttcccatccccagccagtggctggcggtggctgacaagatcaaggtagccctttgacgtggatgcatgaacttccacccggtagttcgactgggtactgagcctggcgaggtggtgaagcatggcagacgtcgtgctcctggtgacacccctcgtg

SEQ ID NO: 495602 - DNA, 267 bp, Homo sapiens
aacgaaggcgtttgaagtgagtgatgttgtttattctattcacttagcaaagcctgaagttagggattttattcgaagattctcccaagagcatgggtttttaattacccataaaataacggaagaactggtaattcctgctcagttcttctttcatagaaaaaggttagaaagattaaagttgatatctatcgcttttctaggttttttaatgtcacccaggagttagcccgacttttcttgtctgtggtatcggaggctcccttc

SEQ ID NO: 495603 - DNA, 1072 bp, Homo sapiens
  misc_feature (709)..(709): n is a, c, g, or t
  misc_feature (818)..(818): n is a, c, g, or t
ggttgcattcctatcagccacttgtgtagctatctccgctaaacttgtagtgaatgtctctccgtgaacagttgctggtctaatgacgactccgctgctgcctctgtgttcacaagacaaaggctgcttatgtgccaatggctgagcctcctagaatattagacactgttatgcaggtatggatggagaagactgactgtctgtgattcctcttcgtattaaaccctgctcttgatgttactgcctcttgatgctgaccaacattagattagtcatagcattcctagttgcactaagcgttggatagaagtatctgacacactacaagatggcaggatgcatctcgtgcctggcttcatgtgctactgtctcgactttgtgttacttttatattttggaatcaaactattacacactaaaagaatatactaccggcatgagacacatgcgttggacccagtgtagaccaatttacccgttctgtgcgtaagtaaagagaaccacgaggattactttcgaccaatgtgctgtcatgggtagaatctagagcagatactttaaaagaggagacctgagtttacagagacactactacaggtttccagagggcacgccttttcataactttcaatttttaatagaagatcaaaaggcgtatgtccctattcagtacaagggaataccatccgtctgctaaaaagtctcaacncttgtcgcacttagataatggagacgcgagattgcgatagtaaaggaattcgaaggacctttttcggaagggatcgtaaagttctcaaggagccacatttgcccatgcntccggaacatggcaccaagaaaaatcattgtgcagtaacaagttaggttggacctcgaagttatttgtgcctcggtcacacagtctttcgggttatgatcgcagtagcccaccttcaaagacgctctggaaatttgttcgcaaaaacacgggaggacctaacagcggaaaagttgaatatatctttccccgaaagtgcaaggaaaaggtagataggcggacgtctggaggccttgcttaataaagtgatagcca

SEQ ID NO: 495604 - DNA, 91 bp, Homo sapiens
gcaactacaaacacacctcggagcagagccatggcggctgctgggtcgtcggcggcgcgggtctgtggtgtgggggacgctgagcggccgc

SEQ ID NO: 495605 - DNA, 185 bp, Homo sapiens
cgccacatgtcatggccacagaaggaagcagtagggcctccttccgtgccctgcctgcagctggcttccacctgggacgtgcctgctgcttcctgagagcccggctctccctccagtacttctgtttgtgcccttctgctttccccatttcctttcacaggttattagccggttcttttgggcct

SEQ ID NO: 495606 - DNA, 178 bp, Homo sapiens
acccccaggttcctgaccatgaccaccttctgtctgaagaggagctgcatgaatgatactctggcaatcatctacacaggaccaaacgcaacaggcgccctggcaccgttgaggccttagttgaactctgctagaacatgacttagtagcccagtttacagataaggaagctgctcct

SEQ ID NO: 495607 - DNA, 334 bp, Homo sapiens
aaaaaattaaactatgtaagttcataattagaaccaatattaaaaatgaaagtaaagcaaggcactcatccagtaatcccagcactttgggaggctgagacaggaagatcacttgaagccaggagttcgagaccagcttagacaacaaagtgagaccctgtctctaaaaaacattttaaaaagttacctgggtggcatagtggcatgttcctgtagtcccagttactcagaaggccaaagtgggaggatcgcttgagcccagcagttcaaggctgtagtgagctatgattacgtcactgtactccagcctgggcaacagaccaagacccaatta

SEQ ID NO: 495608 - DNA, 839 bp, Homo sapiens
ggacagtactttatggaacaactgggaggttccctggcatccggcaggagtggcttggccaacccctggtttaccaggagggggcaccgtgaggggctctgtggcattcccctttatgtttcgccccttcttcgccgcgtccttccccttgccccccccaccccactccagcgaacacctttgggtttgcccgcactttttttacggcttcgggcttttttccccgagagatatttggggccccctgtagagcaccccgctgggtgagccgtcttatatttcaccacacggttgagggaacctgtcttccgtcctgtaggtcttttctataagagcattatgccccccctaatggatcacattgggtaaacccgtcacatggtggagtcgccgtaaatcacccggtttccccgctcaaccccttttgtctaagatctatttgagggaaggggaatagtgggagaggaggaacccctttgagtcccgaatacacaccccactatgtctttaagcacattgttgaagtatgagaactggaatacattcacacacttatatccctgaggcttgtgatctgagtaattagccggtatgatgctgcgagctggagaaatagaaagtatataaaaattcaagggttatatgtgccacattattttttggccctgttcatgattttaagttttcacgtgtccgtgtacaaatagaatttgtaaagttgtcatttcccatatttaaattgtggaaaattatttagaaactttaaaatttttacccgcctttttaaaaaggacacctcccttttttgtattgtaaaaaatttcacttttaacctttta

SEQ ID NO: 495609 - DNA, 956 bp, Homo sapiens
tgcgcacaattttggggggggcccccccccgtgcgccggggtgggtgttctcccgcggtcgcagggggggtggtgcccccgcggccgtagttcttttctgcagacgcggcgtgtttgtctcttctcgccccccccccggggtgtggttgttggtccataccagggggccccccacagggcgggttgctcaagcgggtctctcctcgctggggctggcgtcgttgaaactacacgagcggagtgggtggttttgttcgcgcagaagttgtccagctcgttcacatgcggtgtgttgtgtatggctgcgccccccgcgcgctgggcagcatcaaccccgcgtgggttgcggcggcactctcgtttgtcgctgccacgacggatgtgcgttgtggtcgcgctcgtcacaagttgagtgtgtttctctcctctctctctgtctgcgcccccccccccgcgaggaggggtgtgttgtttgtccccctctcttctcttctgtcgcgccggcgtggtgaacccctctctcttcggaggggaggtgtaatctgttggggagaaataatagtgggggcgcgcccccccatgaagaagatgttctcgggcgggtagttttgaggcgccctgctcttctcgaggaggggtggggattatttggcgtttgctgctgagataagacgccagcacattgttgtctggtgcgcagaagggtttgttgaggggaagacgcaacccagcgactgcttgctatcatcagagaggaggaggaacagggaggcaggtggttgttttcaacgaggaactcctctctctcctccctcgccgcccccccccccaacggggggggggggttttttctccccccccccccccttttcctcccccaacccctgtcctttttttttttcccccgggggggttttttcaaaaaagaaaaaaggggaggcccctccttttaaata

SEQ ID NO: 495610 - DNA, 1102 bp, Homo sapiens
ggcagggcggactggtgacagccgcaacggcagcccataggtccttgtggcgtggacctcttccagacgctatgcttgcctccccccagtgagtgagggatgagtgggcctgaggcgaggcatcgcacggaagatgctagcgagtcgactccggagaccgaggactctggctgatctccgtgacgagtgaatggtacagccatccattggacgtcgctctggggcaagtaccctgtagcaagtgttatcggaccacgttcaatacggtgcgagctgagacctccagcgaccatggtgctatcccagctagctttgaagcaccccatgaccaggttctcgttatcggagacccgggctctcccaggaggattgccctcgtgacgaaggcccgacagcatttgcggacacttgagttgaggcggggcttttcatggcgcaccaaattgtgacctttactagcccgaggttctaacccggatccagtacgaagtttccaaacgccaactagatttatcatttcacgttgttgtgcccgggtgcgagcacaattgaaccccacttggcctagcgcgagcgtataagtgcccaacaccgctgactttgtcacagtggtttcccccttaaggtaagtcgcacggtgggacgtgacattgtcattgggcctcaacagaaacaggcaccatgagcgtgcatgcgaagggaaggggactgtaccgggggtagcaacgtaggcgtctccttaggcgtcgcccgcttgaggcacggagttactgagcgcacccgaagtgggcaaggggacctccaaagtcgaaggacgttcggttcagttggccccttgagcgccgttggattcaccgcgttggcgtttcgataccggcccacgagggagaggccctgtgcgaaggcttccttaagcagggccacgagacgaagaacctcttggggccgcagtgccacatagcggataggcgttgtcaccatcctggaagccaagttgggttgacacacgtgcagaccgaagcgcggaaggccatcgcaagttgcaccgcgtgttgcacttcccttgacgatgtaaggccggtcccttggaagcgcacctttc

SEQ ID NO: 495611 - DNA, 937 bp, Homo sapiens
  misc_feature (18)..(18): n is a, c, g, or t
  misc_feature (61)..(61): n is a, c, g, or t
  misc_feature (74)..(75): n is a, c, g, or t
  misc_feature (77)..(77): n is a, c, g, or t
  misc_feature (89)..(90): n is a, c, g, or t
  misc_feature (94)..(95): n is a, c, g, or t
  misc_feature (108)..(108): n is a, c, g, or t
  misc_feature (118)..(118): n is a, c, g, or t
  misc_feature (121)..(121): n is a, c, g, or t
  misc_feature (123)..(123): n is a, c, g, or t
  misc_feature (127)..(127): n is a, c, g, or t
  misc_feature (129)..(129): n is a, c, g, or t
  misc_feature (133)..(134): n is a, c, g, or t
  misc_feature (145)..(145): n is a, c, g, or t
  misc_feature (148)..(148): n is a, c, g, or t
  misc_feature (158)..(158): n is a, c, g, or t
  misc_feature (166)..(166): n is a, c, g, or t
  misc_feature (177)..(177): n is a, c, g, or t
  misc_feature (179)..(179): n is a, c, g, or t
  misc_feature (187)..(187): n is a, c, g, or t
  misc_feature (189)..(189): n is a, c, g, or t
  misc_feature (193)..(194): n is a, c, g, or t
  misc_feature (196)..(196): n is a, c, g, or t
  misc_feature (233)..(233): n is a, c, g, or t
  misc_feature (235)..(235): n is a, c, g, or t
  misc_feature (239)..(239): n is a, c, g, or t
  misc_feature (261)..(261): n is a, c, g, or t
  misc_feature (272)..(272): n is a, c, g, or t
  misc_feature (276)..(276): n is a, c, g, or t
  misc_feature (299)..(300): n is a, c, g, or t
  misc_feature (303)..(303): n is a, c, g, or t
  misc_feature (329)..(329): n is a, c, g, or t
  misc_feature (855)..(855): n is a, c, g, or t
  misc_feature (932)..(932): n is a, c, g, or t
tcattttattatcattgntattactaataaatcaatagaaattgaataacaaaggaaaaanctcaagacaaatnncnccccccctgccnntccnnacacatgcccacncccacatccnccncncccncncacnnccccctcccantcngtcctacggnacaaatanttacacaaaantntacaaaangngggnngnggggcccagcggtgtggggggcggggggggggggggngnaggncaccagcgtctccacgctaagngtacttgtggnttcntcctcttcatttgggccaaaagnnccnggggggtccagcatcctctgctcagnctcagtgaggccaaacgacgtattgtcatagaaggcaaactcagggtgagtggggaagctttgacacttgtcttttctacactgagaagggctcagagaactgaccctctggtagttatctttgggggatatgggagaagactgcttccttgagacactcttgtgactgggggacggtccccgacgagctctgtggggctctgttctctcaattccggccactaatcctgcctggtgatccccaaggtctggtttcctcaagggctgccccaaagtgtaggatttagggagagggtttaatggaccacgggttccacttgcctcttggaaatgctccagtttttcaggaaacaggtgggcacctcgactctgaggcctaaatctgtcctctgcctgctcgcaggtccgcgtcctagagctgtaggcaggggcctgccgtgggagtcagagtggacatgctcctctctcggaacggccgggcctgcctggcttcatggaaactcgctgtcctcctgaaatgggcgtncctggcatggctcctttcggacgggccccctctgctgcccacgtgccttgcctgtaacttgcggatcagagtctggntgggg

SEQ ID NO: 495612 - DNA, 344 bp, Homo sapiens
  misc_feature (105)..(106): n is a, c, g, or t
  misc_feature (114)..(114): n is a, c, g, or t
  misc_feature (120)..(120): n is a, c, g, or t
ttgtttctcgtgagctgagtctagaggatcccgatgcgtcctgtgcatctggctggactggtctgggagtagctgagtacctcagcggtggtctggtggacctgnncgcgggangagatnaccttgccatcctggacctcttccacaatggtacgcacctgacgggtggtcaccggttctttcttgtactgagtcaggtgggcatcctctccctccagcagcggcggtaggtggcaatctcctgctccaccgcgtcttcacatccagcaggattttgtattcctgttctgctgctccatctcgcaacaaagtgggccaagctgaacctccagtgctgccaatca

SEQ ID NO: 495613 - DNA, 135 bp, Homo sapiens
cggagggagatcagactcagaggttcactggagtgaacccataggttcaaataggtgttgtagcttcttcgccattcgtcaaatcttcaatggaacctttgtgaagctcatcaaggcttcgattaagatgctgag

SEQ ID NO: 495614 - DNA, 380 bp, Homo sapiens
  misc_feature (141)..(142): n is a, c, g, or t
  misc_feature (150)..(150): n is a, c, g, or t
  misc_feature (156)..(156): n is a, c, g, or t
tgcgacttttctgggaacgctttacttgggctgggaatcctaggccgtattactgtggggcagatggcggtctgcctccctggcctcctgggctgccggccgggttactgagatcctcgcgggttggtctggtggacctgnncgcgggangagatnaccttgccatcctggacctcttccacaatggtacgcacctgacgggtggtcaccggttctttcttgtactgagtcaggtgggcatcctctccctccagcagcggcggtaggtggcaatctcctgctccaccgcgtcttcacatccagcaggattttgtattcctgttctgctgctccatctcgcaacaaagtgggccaagctgaacctccagtgctgccaatca

SEQ ID NO: 495615 - DNA, 465 bp, Homo sapiens
tgggatatctggatatcttatgcagaagaatgaactagacccctagctctcaccatgcaatcaaaatggattaaagagttaaatctaagacatcaaaagaaactactacaagagaacattagggaaactctccaggacatcggtttgggcaaagatttcctgagtagtacctcaaaagcacaggcaaccaaaacaaaaatgtataaatgggatcacatcaagttaaaaagcttctgcacagcaaagaaaacaatcaacaaagagacagcccacagaatgggaggaaatactggcaaactacatatacatctgacaagggattaataatcagaatatagaagctcaaacaactctatagaaaaaagccaaacaatctcatttgaaaatgggcaaaagatctcaacacacatttctcaaaagaagacacataaatggcccaaggggcatataaaaaaatgctcaaca

SEQ ID NO: 495616 - DNA, 120 bp, Homo sapiens
gatggacagcagtgcagccgacagtctcgaacccctttgggatcaatgcggctagcgtggggtcagtgctgttcaatagcccagaaatgcaagccctcctccagcagatctctgagaacc

SEQ ID NO: 495617 - DNA, 271 bp, Homo sapiens
acctgaccctgtggtgtatccctgctctctgacagcccctttctcacccctggtccccacggcccctggatctctcccctctgctagaatctcgctgagtggattggtgggtgaggtggtggtcacgcactgggtggagatctggtgccccctgtgaggccggacaggaagggccagtggcggccaaggtctattgagaactcggtggcatcccgctcctgatggcctgggtcccaccgcccctcccccagccttcctgacagcagaggag

SEQ ID NO: 495618 - DNA, 685 bp, Homo sapiens
  misc_feature (5)..(5): n is a, c, g, or t
  misc_feature (40)..(40): n is a, c, g, or t
  misc_feature (106)..(106): n is a, c, g, or t
  misc_feature (136)..(136): n is a, c, g, or t
  misc_feature (174)..(174): n is a, c, g, or t
  misc_feature (203)..(203): n is a, c, g, or t
  misc_feature (218)..(218): n is a, c, g, or t
  misc_feature (244)..(244): n is a, c, g, or t
  misc_feature (345)..(345): n is a, c, g, or t
  misc_feature (349)..(349): n is a, c, g, or t
  misc_feature (351)..(351): n is a, c, g, or t
  misc_feature (559)..(559): n is a, c, g, or t
  misc_feature (609)..(609): n is a, c, g, or t
  misc_feature (630)..(630): n is a, c, g, or t
ttctngtctcatcactgcatcattgaaagaacatgagcanacttggagtctcaggctgcaccctacctttttgaatggaagcttacatttttaactagcatagaantggtatgctaatactgtatattagggaacnttgaggtgagctgccaaatgagacaaaatgcaagccanagaaaagtgaaactaaggttggatgggtnaggggagtgcatttngtagaaatgagcaagattcttatatngtgaagagaattttcattaggcaaattttgaaaccagtaatttcagaatcacttttgaactttgcattccaattaacaactcatgagtcatagctaaggtncacnantaatttctactacattgtgtgcttgctgccataatcatcggtatggtatctctcaccagcactcccctaccctgtgcctctctggcataggattatctttgaggaaacagtacctttctaaaggaagacaaatttgttcttggagattgactagcatattgactgcgccatgaccaaggtaaaaacttgcatggtctggagcaggttnaatggctagctgaggtagggcaagttagagtatgggaagagagaaacggngaggacagcagtgagggcttnctgggtagacagcaggagggggttgctgctgggaggacttccagtgaaaggccag

SEQ ID NO: 495619 - DNA, 354 bp, Homo sapiens
  misc_feature (12)..(12): n is a, c, g, or t
  misc_feature (35)..(35): n is a, c, g, or t
  misc_feature (195)..(195): n is a, c, g, or t
  misc_feature (212)..(212): n is a, c, g, or t
aagcacgaaggntaccccgtcaccatagggaaatnaaagctgaatctccagcctgcgtggcgccgctctagaactaggggtgtgcctcggagtgaatggccgctcataggaccgagcgcatgttcgaccattgcgtaatgcatcaagcctgcggctaccagctgctgattgaggtccgctgctgcctgggcgatnctgtaatcttctgtgancctgtcgggattattgacggtgtcacgctggtcgtaacagtctgcctgatactcctgctccagtgaccgccatgttgcggtaaccagtaactgccgctaccccagtagccccgaattcaagtacctctagggccggatcagc

SEQ ID NO: 495620 - DNA, 222 bp, Homo sapiens
aagaaggcgcattctaggttattgccacataactatcaattgtgctttgcttcttcgtgagactgtgatcacaccccatgatctagtgttagttctggatttctccggcatcgaacagataaatgactggtcatgactgggaaagcctgggtgcacacagaccggtgaagaaagaatgaataccacggttctggaccctgactctagaatgaatgttttcct

SEQ ID NO: 495621 - DNA, 865 bp, Homo sapiens
  misc_feature (3)..(3): n is a, c, g, or t
  misc_feature (22)..(22): n is a, c, g, or t
gangctagtacgagctgggtgnaatcggacgaggcagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaaatggctcattgactacaaccaggtggcactgactgttcgacttttccggcacggtcatcataagtggacacagggctatgtcggctcattgactagccgtgaagagggtgggctgaagtcaaggcccctgctgggaatggcccataatgggcggtgggtgca

SEQ ID NO: 495622 - DNA, 102 bp, Homo sapiens
tatctgggcttcttgcattctgagacagccaagtctgtgacttgcacgtactacccctgtcctcgaacaagatgtttcttgccacactggccaaagatctgc

SEQ ID NO: 495623 - DNA, 452 bp, Homo sapiens
agaggactgccgttttggctgtcgtgcctggtatactgtgttttcacacacacacacacacattttttaacagatggggtcttgtcctgtcccctatggttggagcatccgtgctgcaatcacagctcactgccgccttgatctcctgggctcaagcactcttcctgccccagcgtcccaagtagctggactacagacaggcgccaccatgcccagctaatttttttttttaacttttttttttcccctcaaaaaaaagttctcactatgtggtccaggctggtcttgaattccggggctcaagcgctgttcctgcctcatgctctcaaagtgctgggattacaggcatgagccaccagatctagccaataatgatccttttaaaccgtccagtgatataaattcatagttcctctttttaaaagaaaaacgtattatccaccccatactcc

SEQ ID NO: 495624 - DNA, 286 bp, Homo sapiens
cgatctcatgaccttatgatctgaccgccttggacaccgagctgtgattacacgcgccagtgagcgcaaactatgcctggctcctgatgcataaacagtgctctgagctgcacctttcaggagagctttgcggggcatcatagcctttctgaggacatggtatgtgaacggtggctgagcgacctggatagagcaagtggcttaacctatctggagcttaacgagaagggccagtagatcatcgcatggacacttaagagaatgcccggcatattagggacttcgg

SEQ ID NO: 495625 - DNA, 1135 bp, Homo sapiens
ggctggttctggcccggaagttctgggagtggcgggcggcgggccggcgcggtgagggcgtggcggatgggaaccaggtccggcctgtgagcgtgtgcgccgccctgctggtccggtcacgtccccgcgttggcgccgctgcccgcgtcgtacggaacgagggcgccgcggccccgtgctcgccgcccggtcctgaacccgaccttgcctcagtgagcagcctcgagtcagagtgcatcatgatgcatgcgtgcccggtagagtgaaggtgctcggatgcaccaagtaggtgaaaccaggcaggcgggggcgtgcttgcagaggagcacaccaagtcgaccggacacctccaaaccgctcacagccacatcaggcaagtcattcgtgcaccaacaagactagcccatgcaaacccaagaatctggacacgacagcaccgaagtggcaaataacatctatagacagtgaacggtctatccacaacgcgatcagaccacgaggcaccacgtggtacacattgacatacaagagtcaaaaactcatgagacccacactatttgacccaaccttatggcgaagggtggaacacatgctctaacattacgcatgaagacacagcagagcgcacggaggaaacaaacccagaatcccagtacttagacaacacaacaagaccgacccccatattgaactggcgacatgagacaacagaacagaaagacgaccaaccatgaccggagaccaacgaaactaccaattgaacagactagacaagagccacacaagagccggcactaaaaaccacacacaagcacagtatgaacacttaggagagcaaactctttgcaaagcattaagcccatattccaaaagaggagccacaaacactcttaggcgcacattcaatactgagatatcaaaaaagacacacatagaagaattccagtcagatagtatagagattaccagccgcagttgtagttgaaggcctaacaagtagaacgcaagctgcaaagacacaagggataagcacagccacaaataatcacaccgaggacaagtcaatcaccacattctaggagtcactatgagagagtcagcccaacagcactctagacagatcgcccaacgacaa

SEQ ID NO: 495626 - DNA, 391 bp, Homo sapiens
cgctttgtagaaaggatggtgagtgctagcccgtccccgagttataggagtagagctagatgatcctctaatcctaatatttagaaagcctcctgtatgtcctttgactccttcagttggcactggcaccagactctaccctgtacgttcttatctgcaggtaaagaatagcactcgtattcaccattgacctgagacaagaccgcccagcgtcgtaagtgtagcagtaatatcataacagaactgtatctcttagcctatgaacatataccatatgtcttggtactgcctaactctggtacatccgaatagtacctttgtgcctatagttaagaggtacctaaaggttaaggggaatcccttacttcctctctttctcagtagtgaaatc

SEQ ID NO: 495627 - DNA, 587 bp, Homo sapiens
  misc_feature (326)..(326): n is a, c, g, or t
tttttttttttgtttgtgggaagccccggcacactgggccagaatatgcagggcccggagcagggcgccttcgtccacgaatccctccacgggcacagttcaccacacgcaccccctttcttgcacgtgggcaaagggtgtttgctcatttcagcaagccgtgttcggtggagggcaggaaaggagtgtggtgcacaggtgattgaaactcacagagaaggccaaatctccctccaggggcagcgtgctgaacaccaaaggaggccgaaaccctctgtggggaaagtgagtggggctcattacccttattaggtctttcattcccnaaaggacgtgcatctccggggtagcttaccttcttcttcccaattccgtgcccaggccaagaattctcccagggggctctttcccatttcacgcctcgtggtcccccatgtgaacctttcttctccggctcccatttggccggtccttaattcagaagcccgttcgcccgtgggggaaactgtggcctgggcccgggtcccctgtgacttcattcccccaagtgtgaggtttcggggggccactgagggctgtttccccag

SEQ ID NO: 495628 - DNA, 316 bp, Homo sapiens
  misc_feature (25)..(26): n is a, c, g, or t
  misc_feature (33)..(34): n is a, c, g, or t
  misc_feature (39)..(39): n is a, c, g, or t
  misc_feature (52)..(52): n is a, c, g, or t
  misc_feature (63)..(63): n is a, c, g, or t
  misc_feature (65)..(65): n is a, c, g, or t
  misc_feature (67)..(67): n is a, c, g, or t
  misc_feature (73)..(73): n is a, c, g, or t
  misc_feature (75)..(75): n is a, c, g, or t
  misc_feature (77)..(77): n is a, c, g, or t
  misc_feature (90)..(90): n is a, c, g, or t
  misc_feature (97)..(97): n is a, c, g, or t
  misc_feature (106)..(106): n is a, c, g, or t
  misc_feature (108)..(108): n is a, c, g, or t
  misc_feature (116)..(116): n is a, c, g, or t
  misc_feature (119)..(121): n is a, c, g, or t
  misc_feature (126)..(127): n is a, c, g, or t
  misc_feature (131)..(131): n is a, c, g, or t
  misc_feature (134)..(135): n is a, c, g, or t
  misc_feature (139)..(144): n is a, c, g, or t
  misc_feature (147)..(148): n is a, c, g, or t
  misc_feature (154)..(155): n is a, c, g, or t
  misc_feature (171)..(175): n is a, c, g, or t
  misc_feature (186)..(186): n is a, c, g, or t
  misc_feature (217)..(217): n is a, c, g, or t
  misc_feature (227)..(227): n is a, c, g, or t
  misc_feature (232)..(232): n is a, c, g, or t
  misc_feature (236)..(236): n is a, c, g, or t
  misc_feature (310)..(310): n is a, c, g, or t
cttgccgatccggctttattgagannttttgcnnattanattttacaatttnacattttacantnanaaattntntntgctattacatangctgcanacttttcananacactacngannntcttnnattnctnnggannnnnntgnnccatgnngagctcctgagatatnnnnnttctttcaccntcattttcatcttccttggaagatgaagaancacattcctnacatntccntccgtagcctgtctgtttaggagactttttcaaaggaggatccaaacagccaaaatggtagcagagtctgcatncatcac

SEQ ID NO: 495629 - DNA, 832 bp, Homo sapiens
  misc_feature (510)..(510): n is a, c, g, or t
taaataaaagggcccagggtttcgaacgaagccaaattacataggcgaagaccaccactgctctagtacgcacacccgtttgataatggggcaacaaaccactggtaatactggtgacatctctactctcttgggggacgacacaacttgggggaaatacctccccccctctgtggaaatatgagagatcgcggactacaaccatggcactccccgcgttggatgttagggtaatctccttacgcacgaacccccgcgctatggcagcgtatgtatgtaccacacacgctggggaggtatctctcttagagcgagcaggaggggtgtattctctctccacagcgggagtgtgtttcccacccgactgtggtggtgttcacaccacagagtgtaggagcctccctctcggggggggaacctttctcacgagagtcccaccttccactcggcgcgtttcccggcgcgttcttgtatttgggtattggaggtggtacctacgcctcgtggacncctttctatgctgcgtggccgaggagagtgacgagcgtgctgggctgtcttgcgtttttgtcccacacaagggctcaccacggaggagacataggttatgtgtgtaaacacacgcattgtcaacctcacggtagtgagtcattgacaagacactcctcactggtgaggaccaccgttgtgtttatgccgaggcttacctgaaagttgttgcgtctttatgaaaagggttattcaggtggtctgtctagtaataaaaaatacgtctttgcctgctcgcaagagaggggaagaatatttttgggaaaacaaccacataacacaa

SEQ ID NO: 495630 - DNA, 620 bp, Homo sapiens
gcacgaggagagagagagagagagagagagagagagagagagagagagagagctcgagagtttgatttttttttttgtgttcactctctgtgtttgtccctctctctctctctcacctctttgtgtctcattgtgtgctctctcttctcctctcacctcttgtgccactcgtgtctcctctttctatatactcaggtcattctcagccccgtgtgctctgaatgtgctcttctctatactgtcacacattatatatctctcacgatattttaaaaaacaaaaaaaaaaaaaaaaaaaaaaaaacaaatatgaagaaccaaacccctcgggggggccccctgccccattttccctctatagtgtcccttttcaaattactgtgcgcctttttacacccccttgtctctgaaaaccctcgcgtttccccccttaatctcttttcgatacatccccctttttccaggtgtcgtattattcaaaagtcccgcacctttcgccctttccatcacttgtgccccctctttggcgcaagtcccatttgtaccctcaattttttttcataataccccgccaaatttttttacaaatccgccttttttgcaccaatgccctatatctcc

SEQ ID NO: 495631 - DNA, 96 bp, Homo sapiens
gcgccgtggacatggccgagaccttgaagaccttgcggcaggtggaggtgattaatttttggggactgcctggtgcgctccaaggtgtgcatgttg

SEQ ID NO: 495632 - DNA, 114 bp, Homo sapiens
agcggccggagccgctgagcgccaccagggcagcagccgccgcagccgccgccgctgggcagaggagccagagacgcgagcgggcgaggtggcggcggcggcggagcgggagcg

SEQ ID NO: 495633 - DNA, 103 bp, Homo sapiens
acaacatagcatgatcatgtccctatttaaaacaaaaaaaattagccaggcatggtagaagcatgccatatagtacccagcctaactctggaagcgctgcagg

SEQ ID NO: 495634 - DNA, 240 bp, Homo sapiens
actgaatctgtgcctcctcagtagcgggactacaggtgtgcgccaccatgcccagctaatttttttttggtattttttagtagagatgaggtttcaccatgttggcagaatggtctcaatctcttgaccttgtgatctgcctgcctcagtctcccaaagtgctgggattacaggcgtgagctactgcaccccgccagtaatttttaagagtgtaagggtgtctgaggcacagatttgagt

SEQ ID NO: 495635 - DNA, 411 bp, Homo sapiens
  misc_feature (6)..(6): n is a, c, g, or t
  misc_feature (178)..(178): n is a, c, g, or t
  misc_feature (182)..(182): n is a, c, g, or t
ttaaangaaggggattccttctctcaatttggagaacatgacatatagggggaaaaaagtctaaatgcctcccacctgattggagatatgtgaccgtcaacattaattcccccatagcctaaacatttaaagagcccctggggtacaaggttgcacgcctgtaatccccaacaatttngganagccccagcaggaggactgcttgaggccctggaaccccaagacccagccctgggtaacagagcaagaccttgtctctccaaaaaatttaaagatttagccaggcgtggtggtgaccatctgtggtccccggagctgagtcaggagaatcacttgagcccaggagttcaaagttgcagtgagctatgatcatgccactgcactccagcttgaatgacatagcaagacctc

SEQ ID NO: 495636 - DNA, 153 bp, Homo sapiens
gaagtggaatttcctttttgagtagtttcttgcatggtgtgtccaataggtcaaacccagacctactgtttgcaaacaggccatctgtagagatacaatctctggactgccaggacttggtgcttgcttcattcatttaaatacaagctctcc

SEQ ID NO: 495637 - DNA, 949 bp, Homo sapiens
cggccagcatcgcgatttatttatttatttatttacttattttgagatggagtctcactctgtcacccaggctggggtgcagtgggacgatctgagctcgctgcaacttctgcccctcctccctccaggttcaagcaattctcctgcctcagcctcccaagtagctaggattacaggcacacgccaccttgcccagctaatttttgtatttttagtacagacagggttttgccatgttggccaggctggtctcaaattcctgacctcaggtgatccacctgccttggcctcccaaagtgctgggattacaggcatgaaccaccacacctggtcttgttgaggattcttgcatctatgttcatcagggatactggcctatagattttttttcttgtgtccatatctagttttggtatcagggtaatgctgccctcacaggatgagtttgagaactggtatgagttcttctttaactgttcagtagaattcagcagtgaagccatcagggcctggacttttctttgatgggagactctatattactgatttaatctcattactcatagttgggcttttcgggttttctatttcttcttggtccatttttggaagttggatctggtcaagaatttatcctttccatctggttttcaatttggtgggatatagtgtgacataatagtctctaatgatcctttgattcctgggccatccgggaatgactttaagcccctgtgctttaacaccctgagcgggggtaattaaaaggtagttgggcttaatgccaactgtgggacgaaccctgctgggtacatgtaactggataggcctttgcataagacctatcgtccaaaacctaggggggccggaaccacaaccctatggagaattaccccgttttggttataggatagcgcgacggaaggataagatacccagtgaagagtca

SEQ ID NO: 495638 - DNA, 473 bp, Homo sapiens
ctactttgttctgtttccaaagttgccccactgataaactactattaatttactgaatgtcaatattgtctgttgcctctgccttatagtcgcacagttaaatctgccttttcaataatcaacaaacgaattttggtcgattgtccacatgctatgcagttttcgggatatacttatgtgaaaaagcattggttgtttatttcaatttccaatttcttactttggttgctcttccttctgctgagaatactcctttccctggctatattcttccgtccttcaccctatcctgcttctctcatggcttgcactttattgaaattgtctaattacttggtagccttttccctttaacttgagctttttaacgatagggactaaattttttttgctggccgtggcatccccaatgcctaaacccaatttgtgggcatttcaaacttcgcttagtaaattgacggtcttttgcgccc

SEQ ID NO: 495639 - DNA, 366 bp, Homo sapiens
  misc_feature (10)..(10): n is a, c, g, or t
  misc_feature (366)..(366): n is a, c, g, or t
tgagacgganttcgctctgttgccaggctggagggcagtggcacaatctcggctcactgcaacctctgcctcccgggttcaagcaattctgcctctgcctcccgagtagctaggactataggtgcatgccaccacacccagctaatttttgtatttttagtagagatggggtttcaccatgttggccaggatggtcttgatctcttgatacctcatgatccgcccgcctcggttttgcaaagtgctgggattacaggtgtgggccaccgtgcccggcctaagagctctcttttttacagacatcacacacaacacatataactgcacagacaaacagcagcagatccagtagttacaaagattttn

SEQ ID NO: 495640 - DNA, 321 bp, Homo sapiens
gatcgacctcggcgacctgcattatgagcttcctcaacgctttgggtaggccaaggcgggaggatcgcttgaggccaggagttccagaccagcccaggcatcaacatagataccacatctctacagaaaataaattagccgggccctgcacgcgtgtagtcccagctactggggaggccgaggccggaggatcgcttgaacccaggagttccaggctgcagtgagctataattgtgccactgcactagagtctgggtgacagagacactgtcgcaaaaaaaaaccatcaaagcccttagctcttattgcccaggctggagt

SEQ ID NO: 495641 - DNA, 581 bp, Homo sapiens
tctctaacattaacgttccagtcgatgtagctaacaatagatcataagatcatttaaaacttaagaaaaaaaaaatcaaccagacacagtggctcacgcctgtaatcccagcacttggggaggccaaggcaggtggatcacatgaggtcaggagttcgagaccagcctggccaacatggtgaaaccccgtctctaccaaaaatataaagaattagctgggtatggtggcatgcacctataatcccagctactagggaggctaaggcaggacaatcgcttgaacccagggggctgaggttgcactgagccaaaatcatgtcactgcactccagcctgggtgacagagtgagattccatctcaaaaaaaaaaaaaaattgggtcatgacccagaaattccacccttaggtatgtcctcaaggcaaatgcccagatacatgctcaccaggtagtaaagggataataaataatagtagcacagtcccaaatagtccttcaatggatggcacggttggatggtactcagttggggacctgagacccttggagatgtccatcaacattacaaccaataaaaaggtgg

SEQ ID NO: 495642 - DNA, 541 bp, Homo sapiens
  misc_feature (405)..(405): n is a, c, g, or t
  misc_feature (493)..(493): n is a, c, g, or t
  misc_feature (500)..(500): n is a, c, g, or t
atggctgcataatattccgtagtgtctatatgccatattttctttattcattccataattgatggtcatttaggttgactgcatgtccttgctattgtgaatagtactgcaactaacatatatgttcatggatctttataaaagaaccagttatagtcctttggttatatactcagtaatgggattgctgggtttcgtggtatttttgcctctaggtttctgaggaatggccacactgtcttccacaatggttgaactaacttacattccaaccaacagagtataagcattccttttctatacaacctcgccaacatcatgatattttttgaatttttaataatggccatctgattggtgtgagatgctatctcattatggttttgatttgaattctctaatgantgtgatgttatctctcatatgatggttgctgcaggtaggctctttaaaagtgtacaattttgaatatgactttcatgatagcttattnctatgtntgtttggaaaccaggtcctataactaacatataagtaagaa

SEQ ID NO: 495643 - DNA, 587 bp, Homo sapiens
  misc_feature (8)..(8): n is a, c, g, or t
  misc_feature (14)..(14): n is a, c, g, or t
  misc_feature (49)..(49): n is a, c, g, or t
  misc_feature (72)..(72): n is a, c, g, or t
  misc_feature (92)..(92): n is a, c, g, or t
  misc_feature (135)..(135): n is a, c, g, or t
  misc_feature (173)..(173): n is a, c, g, or t
  misc_feature (190)..(190): n is a, c, g, or t
  misc_feature (209)..(209): n is a, c, g, or t
  misc_feature (212)..(212): n is a, c, g, or t
  misc_feature (214)..(214): n is a, c, g, or t
  misc_feature (217)..(217): n is a, c, g, or t
  misc_feature (220)..(220): n is a, c, g, or t
  misc_feature (224)..(224): n is a, c, g, or t
  misc_feature (251)..(251): n is a, c, g, or t
  misc_feature (258)..(258): n is a, c, g, or t
  misc_feature (265)..(265): n is a, c, g, or t
  misc_feature (308)..(308): n is a, c, g, or t
  misc_feature (310)..(310): n is a, c, g, or t
  misc_feature (320)..(320): n is a, c, g, or t
  misc_feature (336)..(336): n is a, c, g, or t
  misc_feature (367)..(367): n is a, c, g, or t
  misc_feature (472)..(472): n is a, c, g, or t
  misc_feature (481)..(481): n is a, c, g, or t
  misc_feature (517)..(517): n is a, c, g, or t
  misc_feature (534)..(534): n is a, c, g, or t
gggggggngggttntttcagggaaagggaaaaaaagggaggattttggnagggagggaattgtccaaaggcnggggggagttttggtgtttnggggagaaagtcaggaaggggattggggaggtgttagttttcnacagggcagggtatggacagcagaggatggcattgttnacggtttccccaattcntgcaggatcagcgacatcngantnttnatngtgnatcccggccagccatggtgccaccagntttatcntcatgantactttcccgaacaaagagctggctgatgagagccagaccctnanggaagccaanctggtcaatgctgtcntcgtgcagcggttaacataaccgcccagccngctgcctggcctccctcctgtgtttcccatggccagtggccatgccccatggggatcgcccctcctgcccccttgtgcatacccagcagtccagtgcaacgtctnctccatagntctggtttcttagatcttggttggacgtttgttttntccttagttgcatttcntgggtttttgtgatgatcaatggactttaatgaaaaaaaaaataaaaacaacc

SEQ ID NO: 495644 - DNA, 356 bp, Homo sapiens
aaacaaggggcggtccggtttattaaaatgccggtcaatgggtttccaggtcccccgggccttgcaaataaataatggggcatgcagggggcccatttaggggcgataatccccccttttcccccgttttttttgaaaaattgtaaatttggtcaaatcccccggtttggccttaaaatttggggaatgttatggaaaaaatagtttataagtttgttaaggccttaaaacagggtttttttttttgatttttaattttttcccccaacccttgtttttggggttaaaattgttttttgggggtttttttttttcaaaataaaattaaaaacttttgttggaaaaagattccccca

SEQ ID NO: 495645 - DNA, 414 bp, Homo sapiens
  misc_feature (116)..(116): n is a, c, g, or t
  misc_feature (119)..(119): n is a, c, g, or t
cctttctgctcagaactgctgcccaaggtgccacatgcagtgtgtggtggtgacaggacaaacccaaagcttactgggaagccactgggtaggtctcagctgtgattatatacatnaancaaaggcagtacaatattcttttacctcttccagtgacaaaaggacatgggcttacaagatgtagaatttcaaagatctctccctttattggctgccatttctgttgtatctatcctttccatagtaatgatacattttgtttagaaatgtgaacactagtttgatttaatcttgcaatacatgggaacttgaacttttagccaccataaaacaacacatagacatataagttacttttttaaaaattaggacaaatttttgtggatgtaaaatgttacctctaagactgcaaac

SEQ ID NO: 495646 - DNA, 642 bp, Homo sapiens
  misc_feature (359)..(359): n is a, c, g, or t
cggcacgaggggaggtgtacatcgcgcccactcgtgcgcccagatcagaccccctgtacgcagaccgactagcgaactataggcctgaggcgtttgggtcctcgggacacggctgtgcatgacacccgggggtcggccatgccagtccgcctcagacgcagagggtccctctggcaagcgccctgtgagtgggccattcggaacattggacagaagcccaaagagcgcaaattgtgacaattgtggaacccacattggcctgagataccgcttcgaggcaccccttacctggccattcgtcaggacacaccacccacaccagtgttatattctggcttgccggagagggtggtcccggnggcacattggcgaacagacccttgcgtgtccaggtttgcagatctcccctgtgccactaaccatactgtgccgggctgtctgtgtgaacttcgtgcctagacgcggctctccatcttgggtcctctccgtggtgcccaatgtgtttagaggggggcccccctcttgggtcccctcctctgtcattacctgaagagccccacgccacacactgaatgtgacctgtgcctgtcgcgctcggccacatttgggggccccgtttgactcaacttactccttttcgct

SEQ ID NO: 495647 - DNA, 615 bp, Homo sapiens
  misc_feature (120)..(120): n is a, c, g, or t
  misc_feature (141)..(141): n is a, c, g, or t
  misc_feature (189)..(189): n is a, c, g, or t
  misc_feature (208)..(208): n is a, c, g, or t
  misc_feature (215)..(215): n is a, c, g, or t
  misc_feature (235)..(235): n is a, c, g, or t
  misc_feature (283)..(283): n is a, c, g, or t
  misc_feature (301)..(301): n is a, c, g, or t
  misc_feature (310)..(310): n is a, c, g, or t
  misc_feature (334)..(334): n is a, c, g, or t
  misc_feature (349)..(349): n is a, c, g, or t
  misc_feature (358)..(358): n is a, c, g, or t
  misc_feature (361)..(361): n is a, c, g, or t
  misc_feature (372)..(372): n is a, c, g, or t
  misc_feature (375)..(375): n is a, c, g, or t
tacttttccacaggtaaagaggtggactgtagaaccgcttaccagcattgaatgtcagaagagcaggatttggcaaaggggatgaaatcagatttggatccatgagagagggcaactctnggacaggccagcggtatctcnaaggctgaaggatctcagaatgtgatctgcggaaagtctgtgaagacngagctctaaggaaggaacngtagccntgggtaaggactacagccangcactagggtaaggacactcagggaaagtaggcagcatgagatggtcngaagctaacatcagggcntggggtacngtaacatttaggacagggttttcnaactgtgaataggtnatgaaatcnacnagagatctccnccngcatttaaaaatagtataaaaatattaatgtgctttacatataatttgggtaaagatcttttcctgtaccctttctttttttttttttttttagtatttattgatcattcttgggtgtttctcagagagggggatttggcagcgtcataggacaatagtggagggaaggtcagcagataaacatgtgaacaaaggtctctggttttcctaggcagaggccgccttccgcagtgtttgtgt

SEQ ID NO: 495648 - DNA, 451 bp, Homo sapiens
  misc_feature (17)..(17): n is a, c, g, or t
  misc_feature (50)..(50): n is a, c, g, or t
  misc_feature (86)..(86): n is a, c, g, or t
  misc_feature (105)..(105): n is a, c, g, or t
  misc_feature (433)..(433): n is a, c, g, or t
  misc_feature (445)..(446): n is a, c, g, or t
  misc_feature (450)..(450): n is a, c, g, or t
aaatgttgaaagggaanagatggattcccccttcccagtagttttcaaanggttaccctgttgcctgtttcctttcaagtaaatgncccaaattatgatcaattnccctaacataatagtttcattaaaaataaaaacccataaaccgtacaatagtctttaaaaattaggtccctacaaggcccggcgcaagttgtcacgccctgtaatcccagcactttgggaggccaaggcgggcggaacacgaggtcaggagtttgagaccagccctggtcaacatagtgaaaccccatctctactaaaaatacaaaaaattagttaggcgtggtggcgggcacctgtaatcccagctacttgggaagttgaggcaggagattcccttaaagtggtgagccgagatcgcgccactgcactccagcctgtgcaacagtgncgagctccgatnnacant

SEQ ID NO: 495649 - DNA, 671 bp, Homo sapiens
gtggatgacagagcgagaccctgcctcaaaaaaaaaaaaaagaaaaaagaaagccacacttattcttttcagtaacctgctagttgcacaggctgtactttagggtacttaaaatatgccctagaaataaatttgcaaggccctaaaattatcactggtaattttgggagtaatccaggatatagggtcccgtttaacaagagatttttaataactctcagacattgcattccagtaggaaataccttgagaaatccatattggttatgttacaaatttcatattctggtactacaggtaaacgttaacgagttttaaacagttaacgattggtcacaattttcctctcttttctatattcacaagggcgccccagtggttcaatggtcttaagatttccagtatttggacacttattttttaaaatcctggtcattggagataagaataatccaggtacgcatctgtgaaattttcaatgaactgtattaatgggcatatcagggaaatttacccagaaaagtatcagcttcttaaaagttatgcctagaaaatttatgtaaagctaaactacgtggttagaaagtatccagggtaatatggtataattggtcacattctaaccttgaatttgacactaacatttttaaagctaaaaacaacaaacacag

SEQ ID NO: 495650 - DNA, 842 bp, Homo sapiens
tcgatttgcataccctcgattaatagcgagggtggtggcctgcaggggtgttggcgggcctccgaagcggtctccggctcggtgcgcgtgttgactgtgcacgaaggttggctgacgccgccccgccgggccccagatcatgccgcagagatcgggagcctgcgggagcactaagtgcgcaatggtgccacagcagcagccggtgctcagagtggtcccagctatgccaaaaaagttgcgctctggcttgctggtgctgcttggagctgctgggactgtgagcgtcgtctatatctttggaaacgaacccctgggtgggagccaagacattgggtagcccaaggattcccttgataagtttcgggacacagttgactccaaatttcttggggtaacatccacgagtcagcctcaccggggaccattacacggttccttttccccccagcatttaacttccgcaccatgcactgaattccgattcggaagcccacacgccaaagcctccattagcacgtatcacattacccccaggaccccctctttgcacgggaaaacccggttaagcctaaacccaacggccaacccccagttgccacctatacggctatataccggcagcgcggtaacacgcctggttgaatttccgttcccctcttacacttccccgtcgaaacgcttgaggattcagcctcttcagtcccaaccttcggccctacgaacaagcgcttcctacacggcaacagtcccgcgaaccaacaacgaccccataccacgcacggacagccattacgcttacccacggcccacccctacataagccccctttttgttatatcacc

SEQ ID NO: 495651 - DNA, 384 bp, Homo sapiens
caagaagaaagaacatcacgacctaatactcacccaacacaaaggtggcaaggaatgaggtgaataggtagagtcatgtataccaggtgtagttgataaaacttgtaatctattcccaaagctgcagcaagagatgagacatgattctgttataaaggctcaaatactgcatttctagcaatttaaacacctttctgatatcaccttacactcaagtgtgcagtacttaaaatagagcctggattgcctataattgtggcttattttcaccctttcttggctatgaaatagttcatttcatacctcttggctttatacaacgatgtattgaatttagagaaggggcatgtgctatcttgcccacttacaaatgtagttctcggc

SEQ ID NO: 495652 - DNA, 339 bp, Homo sapiens
cgcagtggctcatgcctgttatcccagcactttgggaggccaaggccggcggatcacgatcgagaccatcctggctagcaaggtgaaaccccgtctctactaaaaatacaaagaatggcgagaacccgggaggcggagcttgcagtgagccaagatgacgccgctgtactccagcctgggtgacagagtaagactccgtctcaaaaaaaaaaattttcaaattttcaggactcctttttcaggattctggatattgtgacctatctttcccttttcctaagcctttttgctctacactcagacttctctttatccatctcctttgctttcttttaccat

SEQ ID NO: 495653 - DNA, 467 bp, Homo sapiens
  misc_feature (215)..(215): n is a, c, g, or t
  misc_feature (217)..(217): n is a, c, g, or t
  misc_feature (225)..(225): n is a, c, g, or t
ggtcgaactgtgtcccggttcatgggtaacactagtaaaggttagaattgaaggcaagaaatccctagtggagagtgtttgacgggtcattagcataatgagtccttcaatcataatggcaagtaaaggagtggaaagaccatctgcacatccaatgtggaagtcaccaaagtgctgggattacaggtgtgagccaccgcacctggccaagaatnanttctcttntgttatatcccaagaccttgtgacataacaacattgaataatcgtttggtcagccaaagaaggaagggaagaaaagaggaaagaagacattgcagataatacaaacaagttgatatcctcagagtttttggttatgttaaagaggtttggtgagagagaagttaaacttgaagaagagtttgttcatcacagaaatagaattgtgtgggtcgacgggccgcgaatttagtaagtagtagtag

SEQ ID NO: 495654 - DNA, 315 bp, Homo sapiens
  misc_feature (291)..(291): n is a, c, g, or t
cattttgaaaactactaatcagaccgggttcagtggctcgcggctataatcccagtactttgggaggccaaggtggaaggatcgcttgagtccaggagtttaagaccagcctaggtaacatagtgagtccctgtatctaaaaaataaaaaaaataaaataatgccaggtgtgatggcatgtacctatagttccagctactcaggaagctgaggtggcaggatcacttgagcctggggagattgaggctgaagtgagccgtgatcatcatgctactgcactccagcctgctngacagagtaaggaccctgtcttca

SEQ ID NO: 495655 - DNA, 109 bp, Homo sapiens
gtctggctggcaggcaaggtctggcaggcagtcttcacttggcaatctcaacaacagcaggcagtccaacaggggtcacggcagctcggcatattcggtcaatccatgg

SEQ ID NO: 495656 - DNA, 231 bp, Homo sapiens
atatgtacagcttaagaactgctagaatgttgtcatcgctagcctctctgaatggaatctgttagaattctgtccgcttgtgttcatacttgcttgtgatacatgtatccattctcaatacacaagctgattctattcctggaagtgttcccataaactcactgttgtgtgatgagcagaatgaacttgcgttttgagtgctttgtatacccgcacactgtagctcacctc

SEQ ID NO: 495657 - DNA, 281 bp, Homo sapiens
cgttctgaagtattaaccatgcgtgaccaaagaaactaggcttagaaatcagatatacttctgatgctacagtgaagattctcattacaaaagtagaccacccaatcttcgaaaactggatcacagagctccattatggatatcaaagtattgcagagtgccttagcagccatccgaacatgcccgcgtggttcgaggaaaatgcttctcagtccacagttaaagttctcatcagactactgaaggacttgaggattcgtatacctggctttgagcccctc

SEQ ID NO: 495658 - DNA, 1109 bp, Homo sapiens
  misc_feature (199)..(199): n is a, c, g, or t
gtgtttcgtgcttgttttgttcttcgttctgtgcttttttttttttctgcttcttgtttttttctgttaactcgcttttttctttcttccgttctacttcttttcttccttcttctttctcctttttgcttgtcttggttctcgcttctcttgcgctacttcccttctcccctttatcctgttgcgttgtgtgtgtganaggcctcgtgagagaagaagaaagagggaagaaacacgaagaccccgggcgcacccccccggctggactgcgtccacacaccggctttcttccccggcacatggcaactccggcttttagactcccccacgtggcccccccggggtcccgccgaggactggaaaattccagttcaacgtccttgtcgggtggcacaaccacgcagacgggtccaagcccccatcctgagaggtacggttcggaggccgcacccgcggggccctggtccggtgcaaacatttccggcgacccacgactcccaccatcctagataaggtgatcttgcccccgcttccgcaggcttggacccccgggcgcggtcccagaccccaggccagaaaatgtgcgctgtccccccagacgagccacaatctccgcgagggcctgcgcccacagggcctccagaaagtggctgcaccaccaccctagtttccacataagtgggcactttgcctgggcgtctggcctatcatcgagagctcgggttcattgacgctctcgaataattcctgtgcacgaaaccctggagccaccgtttagcaaaccggcttcgcttgataccgcttagggccccgccccttcccccaagttccggccccgcccccgttcacgtgcgctgggcactttccctgctgcctgtaaatatgttggttaatcaccccgtttcgccctggaggccctcccggcccttcacactttcccctcggggagacccacacgctggctgcgtgcccctgctgctgtcacacttttcccccgggacctggggcttttgtcccccagcttcctgtccccctctgtcggcctaccccccccccccagattatttttcaccccccacctccaaataaatcccctgcgtttttggtta

SEQ ID NO: 495659 - DNA, 821 bp, Homo sapiens
  misc_feature (27)..(27): n is a, c, g, or t
  misc_feature (138)..(138): n is a, c, g, or t
  misc_feature (148)..(148): n is a, c, g, or t
  misc_feature (203)..(203): n is a, c, g, or t
  misc_feature (209)..(209): n is a, c, g, or t
  misc_feature (227)..(227): n is a, c, g, or t
  misc_feature (248)..(248): n is a, c, g, or t
  misc_feature (254)..(254): n is a, c, g, or t
  misc_feature (270)..(270): n is a, c, g, or t
  misc_feature (276)..(276): n is a, c, g, or t
  misc_feature (290)..(290): n is a, c, g, or t
  misc_feature (293)..(293): n is a, c, g, or t
  misc_feature (298)..(298): n is a, c, g, or t
  misc_feature (300)..(300): n is a, c, g, or t
  misc_feature (304)..(304): n is a, c, g, or t
  misc_feature (310)..(310): n is a, c, g, or t
  misc_feature (323)..(324): n is a, c, g, or t
  misc_feature (330)..(330): n is a, c, g, or t
  misc_feature (332)..(332): n is a, c, g, or t
  misc_feature (338)..(338): n is a, c, g, or t
  misc_feature (341)..(341): n is a, c, g, or t
  misc_feature (344)..(344): n is a, c, g, or t
  misc_feature (357)..(357): n is a, c, g, or t
  misc_feature (371)..(371): n is a, c, g, or t
  misc_feature (385)..(385): n is a, c, g, or t
  misc_feature (389)..(389): n is a, c, g, or t
  misc_feature (392)..(392): n is a, c, g, or t
  misc_feature (395)..(395): n is a, c, g, or t
  misc_feature (402)..(402): n is a, c, g, or t
  misc_feature (408)..(408): n is a, c, g, or t
  misc_feature (416)..(416): n is a, c, g, or t
  misc_feature (434)..(434): n is a, c, g, or t
  misc_feature (440)..(440): n is a, c, g, or t
  misc_feature (449)..(449): n is a, c, g, or t
  misc_feature (457)..(457): n is a, c, g, or t
  misc_feature (461)..(462): n is a, c, g, or t
  misc_feature (509)..(509): n is a, c, g, or t
  misc_feature (518)..(518): n is a, c, g, or t
  misc_feature (528)..(528): n is a, c, g, or t
  misc_feature (533)..(533): n is a, c, g, or t
  misc_feature (536)..(536): n is a, c, g, or t
  misc_feature (540)..(540): n is a, c, g, or t
  misc_feature (543)..(543): n is a, c, g, or t
  misc_feature (548)..(549): n is a, c, g, or t
  misc_feature (552)..(553): n is a, c, g, or t
  misc_feature (556)..(556): n is a, c, g, or t
  misc_feature (561)..(561): n is a, c, g, or t
  misc_feature (563)..(563): n is a, c, g, or t
  misc_feature (565)..(565): n is a, c, g, or t
  misc_feature (568)..(568): n is a, c, g, or t
  misc_feature (575)..(575): n is a, c, g, or t
  misc_feature (577)..(577): n is a, c, g, or t
  misc_feature (586)..(586): n is a, c, g, or t
  misc_feature (589)..(589): n is a, c, g, or t
  misc_feature (592)..(592): n is a, c, g, or t
  misc_feature (609)..(610): n is a, c, g, or t
  misc_feature (612)..(613): n is a, c, g, or t
  misc_feature (616)..(616): n is a, c, g, or t
  misc_feature (622)..(622): n is a, c, g, or t
  misc_feature (628)..(628): n is a, c, g, or t
  misc_feature (636)..(636): n is a, c, g, or t
  misc_feature (646)..(646): n is a, c, g, or t
  misc_feature (663)..(664): n is a, c, g, or t
  misc_feature (683)..(683): n is a, c, g, or t
  misc_feature (685)..(685): n is a, c, g, or t
  misc_feature (692)..(692): n is a, c, g, or t
  misc_feature (703)..(703): n is a, c, g, or t
  misc_feature (707)..(707): n is a, c, g, or t
  misc_feature (757)..(757): n is a, c, g, or t
tagtcacctgattaacaagagccaganttcattgcatgctgatcaacgaaccaacacaacttttatcatacactaaaaaaagggtagaacaaaggccaacttaaagcctggaaagtcatctaatctgttaaattagtntcccgccgantcattttccccgccttctccttttcccttcccttctcctctccccacccactctngcctcntgtcgcccagcgcgtggngtcgcagcgctgccgctcatnggcgtnattgccaccctccccnccccgngttaaagcctattntcntgccntnaccntcatgngtagctgggattnnaggggngngcggcnaanccngggtaattttttntattttagtagggncggggttctaccgngcgnccnagngtggcgnagacancgtgacantagggaatcggccaacgntggcancataaaggntaggattnaagnngtgaggaacagagccaggcccattattttttttaaaactaattttantaaaatttncttaaaaatnatttnttnattngtngaagnncannaanctacncngnggngctcatnanggcttgctntanatncttttagaaaccaatcnncnnaanttttangactangtaatagnccgataacanccaatgagtgcttggcnnccggtttgttgtgggattngnaataaangagaaagggtncgtnaatcatcatggcgttaatttcttatccaacattccggtcgtgcaggtgtnttgggcaggtgatcccgaggcaatctgccgtgttctgtgaatcttggcggaagggaggcgagct

SEQ ID NO: 495660 - DNA, 127 bp, Homo sapiens
atttttattacaaaattttttttaaaaaagacgaaatagacaacatcctagaaaagaccacaaagatttaactattgatagcgtaatgtacctacgaagttgtagcatgtgctagctaactctaaga

SEQ ID NO: 495661 - DNA, 440 bp, Homo sapiens
gtgcttagggaagggagctttgggtatagtgcagacatgaagagattcactgaatcaaagcaaggatagtaggtgtggatagaggaattgttagaagctggcggggcaccactaggacctgtcagctaaaagcagggcagagtggtgaggaagaaagaggaatcggagatgcctctttgatttcctccttacttgtccgagtaaatgaaaatcaaaacaagggaaggaaagcaggttttagaaaagcttgagctttgggatactgagtttatctgtgtaacaaccaagtggctgttgtcagtatgtggttgaagagatgtctgtgctagagataatgggtttaggagtgatcaatgtgtgggccacaatgaaagccttcaggtgtctatccaggggcattagaggtgggttggccatcagaaggaagcctagacaggtcc

SEQ ID NO: 495662 - DNA, 909 bp, Homo sapiens
ctgacgtcacgtggcgcgttcgtttgccgtggtgagtcccggccccacccaccttacttcgggccatcgcgtggtgtcactcccgattctgcgagtgcttctcggagatttgaggccttttgagccttggtccttttggggttttaccggatcccggatgcgtttcccgagtcagctctgtgcctcctttgagggcattacagcccccggacccccgccatccataatgtgtgagggttctgtaaggacaagctgctccatctaagcatggtgttctgggttcccggttaaattacccggtggtgggttttatcccgggccaaaccaagtgccccaccagggggctttacagaggggtgccctcttgtttgagttccccatgtactgtagtactctgtttagaattatttcctaggtgcctgaaagtgttctgacatgacacttgctactttgtaggccatctgtgatggcaggtaataaagccactgttcaccgtgaaatggtcatggaagtgtacataggttaggccctttcagcagaccttgccgttagtcagccaggacccccttgtttcgttatttggtagccttaaccaaattttttttgccaattggtttcattctcttgatgaagctgagccactgtcccaccaggtttagtttgtacttgaaaactgccaagtagtctccaagtattttagaggggatccctattgatggcccaagaaaatttgcagctataatttgcttctgacggttccttctctgtgaaaccttatttttggtgattctaaagaagccttgcctttcttggttgccattttacagctatacttttttgtgtaatgttacggttccctttctgtaaaatgttctttttggtgatctaaataaagcctctcttgtttga

SEQ ID NO: 495663 - DNA, 473 bp, Homo sapiens
  misc_feature (5)..(5): n is a, c, g, or t
  misc_feature (27)..(27): n is a, c, g, or t
aatanagggttttaaaaaaccctttanaaattattttcaaaaaactggttccaaatgaaaaatcccccgaaaagtgcattactgtttttcctcacccccctagaagaggcaatattatcattcctcctaaggtaatcctaaattgccccccaaaaatgtaataaaatctctgaatcagcccaggtgcagtggctcatgcttgtaatccccagttctttgggaggctgaggtggatgaatcacgaggtcaggagttcccagaccagcctggccaatatggtgaaaccccatctctactaaaaatgcaaaaattagttgggtgtggtggcatgcacctgtagccccagctactcgggaggctgaagcagaagactcacttgaacatgggaggcagagattgcagtgaaccaagattctgccactgcactccagcctgggcgacagagcgagactccatctcaagaaaaaaaaaaa

SEQ ID NO: 495664 - DNA, 910 bp, Homo sapiens
tagagcactcaggtcataggattgttacaaggattaagtgagttaacatgtaaagtgctcagaaagttaccatggttaaagtccaataaatacaattgcttttaggatgtttttctatgcttcattatcgatgaaatacacggggtgtttctcttttcctccttttagactcactgaagatttttgttatattatgtcacagttctcagtatatacctttgtcatgaaagtgaagccccaagtctctttttttttttttccttgggggcagagtctcgctcctttcccccaggtgggattgcaggggggcagatctcgggtcattggcaaggctctggcctccccggggttccttggccatttcttttggcctcagcctccccgatgtagcgtctagggactacagggcgcttggccaccaggcccgggctaattttttttgggttttcttcagcgtaagaacacggggtttccccccggttgttacgcccgggttgggtctcagatctcctttggacctcggtagatctggcctggtctcgggcctccccaaagtgggctggggtttcacgggcttggaggccaccttggcccaagcgcggtggatatccccccagaggttcttctaggagccccatttggggttaaagtatccaattgagggaccaccatctccctttgcgaacatctcacgttcaagggcgccaggtcctccctggggataaacttgcgcacgttactaccttttatttgggccattaacccaattaggggcacgtttcgacgtggcgtttggcacaaactcgtccctccctggttttggccccttttcccttttctctccttttcccttctttgcccagcccaggtgggcccactctcctgggatttccccttttcacttcgaact

SEQ ID NO: 495665 - DNA, 107 bp, Homo sapiens
gtcgtgagaagcgtgcggaaagagaaggtggacctgtacaaccagctggaggaggagaggaggaaggtggagtgatctgcagttcctgcgatgtattggagtccatg

SEQ ID NO: 495666 - DNA, 643 bp, Homo sapiens
  misc_feature (201)..(201): n is a, c, g, or t
  misc_feature (230)..(230): n is a, c, g, or t
agattgacaccgaggcggtaggcaccttctcagtagcagcaccagtcatttttaaaagctgcgcagagaacatctgtgtcctgctttaaagtccagaataataatccttaactgccaactttttaagattcccagagaagctaatatagacagggatgtcatgtcttgtccccactgttgtcaccatgtgaagtgctgggngctcctacactttacataaaaacgtacangcccttaaaagttgaataatgtaagaaaaattgtattttaactgcaccataaaagctagatgaaagttaaacctataattaaaaaattaaaattacaaaagttaaaaaataaaaaaaaaaataaaatgacaaaagttaaacatattcaatttataagtgagttgtgctttatacttgacatatgtaagcagtattagaaaaactaaacagtatgtcccactcctccctgcccctagggcttaataaataactagcatgaaaagaacacattacatcaactgcttctttcaaacatatttcactggagagcctgaatatactagaattatgttttatacggttcatgaacttcataggggaaagttccacaatcaactactattatgagcaagcttgtgtgatacctgttccat

SEQ ID NO: 495667 - DNA, 165 bp, Homo sapiens
gctcagcaccggccggatcagctgtcttccagtttctgtcctcagcaagggtctagtcttcatccaaggtcgatcagcaggggatcaagagctcgagcctcagtgcaggtgagtagctcctactacaataggtgaaaaatgctcatcgagtgtcacagtgcgcat

SEQ ID NO: 495668 - DNA, 233 bp, Homo sapiens
acgcttcagtacctgaccagctgtccaccatacttcccaccatcctccactggctccctcacccaagacccggtcgcttcgtttgagagcattccacccagcctgagtgagtgacggctccccgttaatgctcatcttcgtcgtcgtcatcctcctcctccttctataatgggagccgccctgggagtctacaagtggccatggaggacagcagccgaggtgtccccagcaag

SEQ ID NO: 495669 - DNA, 814 bp, Homo sapiens
ggtgaaggcctcgatagagagaaggtctcattacgagtgtttggggaagagagtcgtgtgggcccaggtctgtggctgctatcagatatgccgctgtcccgttgcgctgcgaggacccgacttgtgccaagagaggtatcctcaaaacatctggagcctgaaccagaggaagagatctattgcctgaggactatgacgatgatcctgtggactacgaggtccagactaggttggagggtgctactcagctaagctggtacaaggtgttcgacccttcctgcgggctcccttactactggaatgcagatcacagaccttgttatcctggatctccccaacatgatcccaatctccgtggttaccaaatcgtgcccaagaagtctctagatagtcagttacatgcagatgcttgacagaaaagtttgggaccgggaccctaggacaagtcggacaggggccatgacgaagttcggaacctgcagctcatgagaaactagacatgggtgccacgacctaagtcgagaccggggccagcgacaagtctgacagggcatcgagagcgatggctactgacaaaggatcgaacagacgagagacgagccgagacagggaacggcgatcggggcaagcgcagggctcgtggagaattgcgaagcaccacggagaaagagcggcaacaagaaaacggaggtccatccaaatacgaccgaagaagggaccgaaggatccactatcctcaacaggagcatggaaagggaagcaaagcccagaaggattgaacagctcagaagccgaggcaacctagggactacaa

SEQ ID NO: 495670 - DNA, 144 bp, Homo sapiens
ctgggcaaccgtttacacccggaatccggtttcaccgggcggccgttttcaacgggaaaacgctttcaacttgaaaacgattttcccgggcgaacccttttagggggcaaacgcttttaatttgtataaaggtgccacgttcca

SEQ ID NO: 495671 - DNA, 981 bp, Homo sapiens
tgtggctggcgtgcggctggtgtgctggcggtgactgctgctggtgaaggaggaggagtgagccgagctgtggcgcttgcacctgaggcctgaccatggacgaggaatacgatgtgatcgtgcttggggaccggtctcaccgaatgcatcctgtctggtgcatcactgtcttgtgtaactgtgtgacagaatgtgtgcttgcaacatgtgaccggacaccctctactactgtgggtgcgatgagctcctccatcacacccctgtgatgtgagctgtataagcgttttcagttgctggaggggccccctgagtcgatgggccgatggccgagactggaactgtagacctgattcccaaaattcctcatggcataacagggcagctggtaaagatgctcctgtatacagaggtgacctcgctaccatggacattcaaggtggctggagggcacgctttgtctacaaagcgcggggccacagatctacaaacgtgccgtccacctgagtactgacggcctctggccttccaactcttgactggggccatgtactgacgaaaacgcgagccttccagcccagttccatggatgttatgtaggcaagaccttcgactgacgcatgacccccaagcacccacagaaggcgcgctcgaccccccagaactaacacaagcacatgcgctgacgtcccaccaggaaaagtctgcacctcgggccacggcatgatcatccgaactgcaccatgaggcaaatgccccgtggcgcgccacctaccagagcacatgaaatggacgacccatgggacacaagacccgtggcggcatggaggagaacggaaaagaacaggcactcaaccagaggaaccaaagagcaagatccagatggagggccaggggagaaggacaagaagacacccagcaaactaaaaccccacgcggcacagagcgattggcgccagcacggcgcacacgggcgtatggcca

SEQ ID NO: 495672 - DNA, 661 bp, Homo sapiens
aagcagcggcggttaggaggctgccatggacgacgaggaggagacgtaccggctctggaaaatccgcaggaccatcatgcagctgtgccactgaactgtggctatctggtgacccaggactgagcttgaccagaccctggaggagttcaaagcccaatttggggacaagccgagtgatggtgtgctgtccgctggcgcactggacctcacctgtgctggtggcccacaacgatgaccccaactgacacagatgtttgttgttctataccagaggagcccaaggtggtgcatcaagacacatcaaggtgtactgccagcgcatgcaggaggagaacatcacacgtggctctcatcgatggatgcagcagggcatgacacacctcctgccaagcagtcccatggtacgacatggcaccccaagtacaatcacatggagcagtatctgcagcagtgagctgctcatcaacatcacggagcacgagctagtccctgagcaatgtcgtcatgaccaaggcaggaggtgacacgagactgctggccctgatataatgcgtccgagagcaccaagctgcccaggatccagtgcgggaggacactgtgtcgcgctactacgggaataagcgtgtgcaggtggtgaaatccatcggcccagtgaagagga

SEQ ID NO: 495673 - DNA, 1107 bp, Homo sapiens
  misc_feature (125)..(125): n is a, c, g, or t
tacaatttttcctgggagaatcatggcaatggctggccagctttgggatggcaacccgggggccacaatgttctggcacactccctttgctactggtgtcctgtatatgggcaagaacctttcantctcgccttttattggttcatctatgactcctgctttatcttccaaatataagagaaacaccgcctattcttttcctacggtgtatggatctttcgttggtcagattggaccccctggctgggtatgtgtcctcttttttcctggacgctctggggtttggccttttcttggactgggtgggcctatccaccttgtgtcccccacaacccgagcagagggggaaagtctctgtgtttcgagccgctcccttttggtactcccctttcaagcgggaaaatgaattatcacgaggtttgtggggcctccgtgtgtgttgtgctcgagcacacaatatgtgatattacagagctctccctcaagcggaaagcacccaaagggagaaaactcgcggaaataatttcgcccaccgaggaaggacacccccacacgaacgtctccctcgcgtttttcgaaacaactcgcggggggcccgcctggaatgggaagggtgcgggaccaaaggcggaacgggacgcgggacactgtgaacagcgggggcggaccctcccaaacctttgtctctccccctcccctgtggcgttggccggggttcccccctattgggtgcatatctcatgggggcggggggagaattgacgcgggacatgggggcccgtgcgcgacaagcaaggctgttggagggggcgcgccacctgggagggtgcccccggggcagtggttaagttaaacttcccttcccccggggcccttcggaggcgccgctttttgttccccgggagaaaaggggtgcctttggggcccctctttgttatgcccgcgcggccgggggccccggaaatttttggggcctcgggggaaaccccggggggtggaaccggtgttctctggcgccgggagatcctggggggactcttgtgtcttagtgggccccaggtcaaggaaccgcggggaaaaacacctcccttgggagggttccttgac

SEQ ID NO: 495674 - DNA, 729 bp, Homo sapiens
actagttctagatcgcgagcggcgccctttttttatttattttttcatgtttaacatctttaattcaaatgtaaaacgttcaatacaagccatttactagggcttagaaattgtgtgggcttttttaaaacacaagaaaagtggggacaagtgccaacgaaacgtgcacctttctccaatttttcaaaagcttttcaagttaagaggcatagcatcatcagggcctatcaaaagaatccatttaactcaaacccacttttcacccccttaccaattgtggtctttacaccacatttccacaatctctttaatacattatttccgtgaagattttccagatctcagctttgtgctttacattaaccattttaaaaagattatttcgcacccaggtgttgtcttacgcatattattggccacaacacaaaattcattacaacatatactctctcaatatattgccatttctctttcttgtttatacaaacccaaaagggggggacaaactaatcttgtgtacgacacacgcaatttacttatacgcccctcacagaatgtgcatttacgccaagaacaatgtgggctacttatgtgccactattcaaagagggcctataaaaacacctcctacagtgctatcccaaagtggtgcagaattagcggttaagccctttaaataattgcctttaacaacgcattggaatgtgggcaaacatttgcaaaagattc

SEQ ID NO: 495675 - DNA, 447 bp, Homo sapiens
aggctgattctgtcatcttgtgctattgtgataatgctgtaatgaacaaacacaggagtgcagattatttccttaacatactgattttatttcctttggatatatacccagtagtggggttgctggagcatatggtagttctatttctatttttctgagcacctccgtaatgttttctataatggctgttttctataatgtataatgtatgattttataatgttttctataatagtaatttacattcccaccaacagtgtgcaagggtaccctcttctccacttccttgccaacaccttaacctttgtgcattttttttttttttttggagacagtggttcattttgtcccccaggctggagtgcagtggtgcagtcacagctcactgcagcctcaaactcctgggctcaagtgatcttcctgcatcagcctgtccagggggtcccg

SEQ ID NO: 495676 - DNA, 103 bp, Homo sapiens
cgtcagactccttcctgaggacagtgaaagtgatcataggagagacccttttgcttgctacttcattctgttcttgacctaataataaaatgttatgaaccat

SEQ ID NO: 495677 - DNA, 192 bp, Homo sapiens
  misc_feature (53)..(53): n is a, c, g, or t
  misc_feature (99)..(99): n is a, c, g, or t
  misc_feature (111)..(111): n is a, c, g, or t
  misc_feature (125)..(125): n is a, c, g, or t
agctaatactatatgctcagccctactactagaggcttgagtatttggttttngagtgagtaatataagataagccttgctaggttcgccaactatgcnccatttcccctnaccccatcttgtcngagggcgtgactaccccatgatccaggaagataattcatttaggcctatatggacaaaataccacgt

SEQ ID NO: 495678 - DNA, 234 bp, Homo sapiens
tctagccgatccctttggaggttatgccctgcttcagctggagctcaaagtacgaatgcctgagctgggtgcagtggatcacgcctgtaataccagcactttgggaggccgaggcaggcggattacaaggtaaggagtaagagaccagcctggccaacatagtgaaaccccatctctgctaaagatgcaaaaattagccaggcgtggtgctgttgtgcctagtaggtcccagtt

SEQ ID NO: 495679 - DNA, 189 bp, Homo sapiens
atctagaggatcccggtcacctgcgacagtacttttcaaaggttgtagggttcaagcaatttttaaaaactcaataaaatgcttatatcaacaaataaaatcagatagaagaataattctcttctattactaatccattcagaaagtgggttctacatcattccctaataattatctaggtcccaatag

SEQ ID NO: 495680 - DNA, 142 bp, Homo sapiens
agtcgttacaagcttctaaaatgttgcaaaattaaagtctgctggatggttttcgccttaacccatattcttccattcattccaaatactatctccagctggatagcagttttccccacttcctgtactgatttcacaatct

SEQ ID NO: 495681 - DNA, 143 bp, Homo sapiens
  misc_feature (7)..(7): n is a, c, g, or t
  misc_feature (9)..(9): n is a, c, g, or t
tgcatgnanagcataggatcatggttatgatatttgctaatagagcagcattgttatgtaagaaggcggttatacatgggtggtggtcagagagcaccactgctgctgctacttagccacttgtgtaacctttttttttaagc

SEQ ID NO: 495682 - DNA, 273 bp, Homo sapiens
tagccggcgggatgttacgcgatgtgatttctgtcccgtgctctgaatgtccaagtgactgacattcaatgcagcgcgcgtcaaacggcgggagtaactatcctctcttaaggtagccacatgcctcgttcatctaatcagtgacgcgcatgattggatgatcgagattcccactgtccctacctacaatccagcgaaaccacagccaagggaacgggcgttgcgcaatcagcggggaaagaagaccctgttgagcttgactctagtctggca

SEQ ID NO: 495683 - DNA, 1560 bp, Homo sapiens
  misc_feature (98)..(98): n is a, c, g, or t
ggaggccgacgctgggtggcccgtgtctgggctgcttgcgagtgcgaatggtgactcgggagatccgagtcactatcggatctgcgtcgcgatagagnctcgggtaacaccggcaaccagtgtttggcttagccagcggcatgtctgatgtgtcacaggagccagctagcttctagagagttgtgacctctcacattctattcagcacataggtactacctcacatgggtatcgtgagacgaaatggcacaaatgctactggcatttagactcaattggtgcgtgtttcacatctaaccgtaacgtaggagggaatagtaggcatccaacaagaacatagggaagtttggggactccggtgtctgtgggggaagaagacgttgggtccaaggaagtctcaggtacggaagggtagggccaattttggggattggcctattatggactcgcggttaaaatcacgttatttataggagatactttggaattccagggattaggggaaaggagtagtggttttcgattgccctagggcacggaggggccttgtggcatggttttggggacccttttgagtatgccaattcttggtaggtcgtaaccttaatgggttggttgttgggagaacttagttctttgggattaggacggaattcagggtgaggattttaatttcggaaaaaacgagagggttggctaaagactagttaggtgaaccgctatcggagtttacatttgctttcccattgcggctagttacggccaccacgttgtcggattttaactcccaacgagggttgaatatttttgcttaacctttccacgtccacgggggaaggaacatttcgggcgactcttttacacacccactgtcattgtgggctgcacctagggcaccattggagctccgagaatttcaaggggcacgaacaacgcggcgcctaggtttccttcccacttgtaaaaagttgtgtccattcgacaactggtcagcgaagggtcccttcatttggcgggagctttgatggcacactttgggaggtggattgaagcccctgattgtgacgcacaacacccagtgggtgctgtcgtgcgtcgcatcttggggaagattgctctggggtctcaaccggagtccaaagtcacagcccacctaatgtgaatcccccggaaagtcccttaagggaacgccaaaggcacgcaattcttttagccttttggcggcgaggaccgtaacagagttccttggcgatggcttgacaaaggggcagttgcacacagggtgtggctgggcgcatccacgtcgcttgggcacacaaacatacacttacgcggggggagagtaccaggcacggtccacctacaaatccaagtggaagggccatcgtcaggtatgaggtatccagaacacacaggagatggtgcacgtctagcgacggagaggaacagacgcacgtagtcattgcgaaacattgggtttcgctgagccaagcttgagtaagtatcagcggcgccgacacagatgtgacgcacatacagagggagccgtatcgtgcgacg

SEQ ID NO: 495684 - DNA, 134 bp, Homo sapiens
tcctgaccacgatgatccacccacctcggctcacaaagtgtaggggttacaggtgtgaggcaccactcccagcactatcttggttatcaagtctgaatttaggtatcacaatcacaccacatttaacaaacaga

SEQ ID NO: 495685 - DNA, 447 bp, Homo sapiens
ttagtccgacatacactctcccagtcttaggtattttctcactcttgttcatggcagccctgatcatgttttattctggccaaaagccttcaaagttctgccttttgtcaagacctctttatctttaccctctatttgctctaccatctgcactgtgcttatgttctcattcctccccctacttgatacaaactggacaatcactgcatccttaggagattttacctttgcgtttgctgtcctttcttctcttcgttgagttttcctaaaaaccaatataaatttatttgtctgtaaatatcgacactcttccagatccagctcacattttgcctctcaccttaagctgcttgggttctcttttaatcctttgcagacagagtgaatatctcctcttctccctgaattgccattgtacttcctgcgattttattttatttcattgta

SEQ ID NO: 495686 - DNA, 408 bp, Homo sapiens
tctcatctcgattccagcgtgcatgtgcacagtgcttttcccatatcaggggctcaggctgcacatgccatgcagttttcctgcagttcacggcagacgttggcgttagggtgctagtggtcgcataaatactgttgtgccaggttcatgtctatagttcgtcttttgaaaagccctgcgggagacagcactggcattgggtttggacgtggcatttacgggcagaggtggataaagaagacccatggagtagccttagcaaaagagtggtatttgggtagtaggactttgttcatgtggctggagtgtacatgtgtactaggagatagagtgaaaaggtggaggtaatagtaatttaaaatataacagtaaaaagaagcagctgtgtattgatcacttactgtgcac

SEQ ID NO: 495687 - DNA, 498 bp, Homo sapiens
gcgtgaacctgttacgcaggcgggtgagcccggcaccacgggatctggattctttctatagtctgccctttccagaatgttacatatggggaatcatacagtatataggattctcagagttgcttccttggcttagcaagtatacgtcccagcttcctccatgtcttttcatggcttcataaagcatttctttttagcactaaataatattccattgtcagaatgtatctgttcagcccctcacctacacaaggacatcttagctgattctaaattttcgcagttagcagtaaagctgctaaaacatccatgtacaggttttagtgtggacgtaagttttcaactcctttgggtaaatcaacaaggttgcaattgcttgatcatatggtaagagtatgtttagctttgtaagaaaccgccaggctgtcttctgaagtgcctgtgccattttgcattcccacctgcagtgaatgggagctcctgttgctccacatcctc

SEQ ID NO: 495688 - DNA, 119 bp, Homo sapiens
gcaacaacaagtatttcctacaccagcaactctgacgaccacctgctgaaaacatcgagctgtttgacaagctctcctgcgttcaaccggccgcgtgctcttcatcagatgtcatgtga

SEQ ID NO: 495689 - DNA, 370 bp, Homo sapiens
gccggctgaggtggagctggaatactcccggggcctggaaaagcttttcgagcgcttctccagccgaggaggccgccgggcgagcagccgggagcaccaaagcttccggaaggagccgtcacctcctgtcgcccttgcactgctgggcggtgctgctgcagcacacgcggcagcagagccgcgagagcgcggccctgagtgaggtgctagccgagcccctggcccagcgcctgagtcacattgcagaggacgtggggcgccatggcaagaagagcagggatctgcagcagcagctgcagtatgagctcctgtaggtggtctcagagctccagacggccaagaagacgtaccaggcatatcacatggagag

SEQ ID NO: 495690 - DNA, 424 bp, Homo sapiens
  misc_feature (81)..(81): n is a, c, g, or t
  misc_feature (358)..(358): n is a, c, g, or t
  misc_feature (411)..(411): n is a, c, g, or t
tgtctgaaaacctccttttaactggttgtccctccaactggttacccatcatcatccttcaaagtatttggtacgataccnccctggtctgtcctatactcctaacatcctgataacactttttctgttacatttaaggctcacccaggccttcatttctgcatcaacaaactgtgttccccctccagaccatttctccattgaaactttatgtagggggaaaagctgtaattgcctctaaccctaggattttagtccacaaatcactatggcatagaggatgagtactttttttaggaacagagcacatccaggccgggtcagtagctcatgcctctaatcccagcacgttgggagntgaagcaggaagactgcttgagcccaggagttcaagactgacctgggcaacantggtgaaacccca

SEQ ID NO: 495691 - DNA, 165 bp, Homo sapiens
atgactcatctatactgacgctatctatactacatatctatactgactatctatcaccatactacgtatctatactaccctaaatgaatctaatgtatagtaactatctattatattcatttagggtagtatagatacgtagtatggtagtataggtagcgtcag

SEQ ID NO: 495692 - DNA, 285 bp, Homo sapiens
aagtcgtctttagagtatccccttgtatcatagatatacaacaactataattctcatatgtagcaaaagggctagtgtttcgcttctatagggtactcaatttttatgttaccttttggcattcttagtgcaaaaagaagcatgtggtggctctcataaaaatttcaaaattcattatttttatctttaacagattactgataatacagaatatataatctattggaagaactgccacatacattttgtccttctaaaaatattgaaatttaactagtaagggta

SEQ ID NO: 495693 - DNA, 396 bp, Homo sapiens
taggcctcctgctccaccttggttcatgtatgcatgcatctacatcctatcttcagcatcacaaactcattctcagcagtggtactgcttgttgatttcatcctcatacttgttcttgaatgtctaccaccaggtcctgcatgtttctcagctctgagtccatgcggcccctgttccccacatgatgcttgtccagcttgcctcctgaggttgttgattgtacttgctcgaacaacggctccaggttctgcctcacatgtcttgtgttgccctgctccttgcagcagggtccacttggtgtaccagaaaccttgtacttgctgctccatgtgaacctgcaccttgtctgatgatgtgaggcaaacttaatagttgagggtcttgatgctggacgat

SEQ ID NO: 495694 - DNA, 1328 bp, Homo sapiens
actagttctagatgccagctgggaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaagaggcggcggcggcgcgcccgtgtatatattttttcctctttaggaggagcccgatatgttaccgaccagccgtagtatttattatgaggagaaggtgtggccctttatatagggacttgttttttatactactggacgcgggtgagcgtgtgtaataaaagatatcggtgctagggagagaaaagaagggataaagtgggatattattgtgtgagaaaaagaattttttattgggtgaggggggggtgaaaagaaatgttatgtggacgaaattaatatcttatcttatagaaatttgtttataaatgcttgtgaggaggtatttttttattagtttgagagagatttttattgagggtgcgtgacactacctatcgtgtcatatttctgcccgctcggcgacatgaagaatgttgcggcggcgcataggacgtgttatttaattgtataatagtattttttttaaaccacgagggcattttttgttgattaaatataaaaacacgataattgtatataggtcaacgatgataccaaatacaaattgatcaataaatgatgataataaaaatatgaatgtttaggtggttacattactaaattggaaccgtaaaattagaatagactaacgagaaatatatcatgaatgtatactagcaaatcagataacgtaacaaatagatgaagcgtctcatcagaaaaaggatatagaagtcaactatttcaactctacgagcgccagcgagaagggtcgacgaagaggaatagaagcggctaggtctgatcttttatatgagatgcattgaaaagaatgaattaagtcgtacactataacagctaatagtggtaattattattccagtggaacgtaaatgaaggagagagaagaaaataacatagataaccgatgaataacaaggtggatatctacaaaagacaataaatagaagagcatacggaaaagcactaccatgtgagcagcgactgtgaaaaatgagttataaaagagagacgcggaaccatacacaaatgagctcacagctgacgcagacgctccgtgtagacatgtgtggtccacgacgtgtggtagactgagctcgacaggctgaagcgtagagcgctataagggcggagggtgatggagcgaatcggatgcgagtgtgcgttgggtagcttgggacgtagacacgagcaccgagagcggg

SEQ ID NO: 495695 - DNA, 289 bp, Homo sapiens
tcatacacaacaaacgcaaatacacagagggaccctggaaacagaatccctccccatagagaaagacgcaggcacagagactcgagccaagttacccaacatgtcggtgtatgcagaaaagtccggtcacatcacacacagcacagaggcacgcagcgaaggcagtggcattcacaggactactttatattaccgtttacttacctttggcacatctcctgtacaggcaacaacccattggattaagtagagttttgccacaagcaaaagactctcactctttggcaca

SEQ ID NO: 495696 - DNA, 255 bp, Homo sapiens
gataacctaattacgccctcatcacgcaggcagtcccagccttctcttccaagtctgtgtcactttgcaatgtagcatttagaagacagacagaggagccaggggatttgctcaaagtggtagagctccttagaggaggagctggaaccagcatccttgtgccctaaccccccgcccactgctttggccaaaaataccttcttaccgggtgtgtattgaccccctactcaacagcttgtaacccaagcccttaac

SEQ ID NO: 495697 - DNA, 111 bp, Homo sapiens
tccacactgggttcgagttcagagtgagggccagcagacagcgcgacagcaaaggctacagagacacgggctctttgaggaagagaatgggataagaaggaccgggaggaa

SEQ ID NO: 495698 - DNA, 1648 bp, Homo sapiens
  misc_feature (237)..(237): n is a, c, g, or t
cccgcgtgtgtgtctgttagtgtcggtgcggtggtgttacttctctcgatcggtgttatggtggccgtctggggtttttgtgtgtctcccctgtctttactgtgtgagtgggtgacgtcttcatcgcaattgtgtcggcgccctccttgtgtttgccgtccctacctgtgtgaggtggagggtgtgctctctcttatttcgttttctcgtcgcccgagcgcgggcacctccactctngtggggggcgaccccccgttgtgtgggcttttcccactcagggtgggcaccacggtcgtacttcttgtctttttatgaaggggcataatgatgtgttggtggcgacgatctgctgtggctgccctacgattgcttccccaccagggggtggctcctcttggggggggtaggagacgcttttgtttcgtcatgctgcgagcacaagtttatgagtgcgacgcaaagtttggtgttgggcgccacgcttgggtaaggagcccgctcgtgcttcagtagtcgtcaccagacggcgtgtatgttgatgcctcttccctccacggaggtgattttactcctgggtgaccccgcgagagggggccgtcttgtggtctttgagaaagcttgttggtgccttcgtcgtcgcccacccctgtgggggggcgcccccccctcgccccacaatgtgggtcttgggggaccccagctcttttccatctctgatcgtcctgggagaccccctgtgtctgacgcctctggacccccgagattcccccagcgccagcccctttccctgggggatgcccaccagggcgatttttctttgtgtgtggtgtatctgttgaacccccacccacggggctggtggagcccaacacccagagagacgcttgtttctcactcgggaatggactacttcctctgtatgatggttatagccgactagccgttatcccacgatgtggccgccctggtggtatacacacacacgaaatgttcttccgttctggccgctcctatatgtgtggagacaccacttgtgggcacactgtcccccacatggcacacacacacacacacgggggaggctctcacactccacgggtggggggttttaaaatgtttgtgtgtgaatgtctctggcctctgaggagaaatttttttgtccacacatgccggtggcacaccacatgttcccgcgtgagaacacacaccacatgggagggtctacatgtccgtgaatcttgtaacttttaccacagaggagttccctgaaagaagaattgtgaaaaagagaagacccagagcttgtctgtctttgagaaagcgccagtgcacccagggaggaatttccagggtgaatggactgctccccgctccctggagttctcacatgcttacctccaccctggaggttccacagaacatggtttgcaaggtgtaccaggtgccctctgtgcctattctagccaattccctactgaagaactggagcgctcagcctgcccacggaagactggtttcgccagctccccactgctccaggcccactgaatgggttaggaccaacccctgactggtcttaagaccctttttgcataggcttttaacccagcctggaaaaatggttgatggaaaattaacatccagtttt

SEQ ID NO: 495699 - DNA, 316 bp, Homo sapiens
gctactcttctgtcatactcagttacctcacgtgatccacagtttgatacacatgctcctggtggttcacaaaatgatttcaggtggtcatgtgggtgcatgtttgttacaattgataattatgtgcattcatgttcagggaaaaacctagcatatcagcagttgcaaatttcatgccatcattcatttctttggcaggcaggctaagtcattgctttttcaagcacacacaggtgcacttcaaacaacaatgttcacatgcagtccatcagtcccaacatgtgcagttagcattccttcacagtatcgcagcata

SEQ ID NO: 495700 - DNA, 165 bp, Homo sapiens
gatagggaaatggttttgtccatgttcttggaaatacttgggtatgtacagaaggaagggagggatgatttttctacaaagtaatttatgatttctaattttctaatggcgcttggatatgtgccaaatgatgggaaagaaacagtgaactttatgagtcttgga

SEQ ID NO: 495701 - DNA, 1170 bp, Homo sapiens
  misc_feature (45)..(45): n is a, c, g, or t
  misc_feature (203)..(203): n is a, c, g, or t
  misc_feature (205)..(205): n is a, c, g, or t
  misc_feature (442)..(442): n is a, c, g, or t
  misc_feature (474)..(474): n is a, c, g, or t
  misc_feature (513)..(513): n is a, c, g, or t
  misc_feature (637)..(637): n is a, c, g, or t
  misc_feature (767)..(767): n is a, c, g, or t
  misc_feature (967)..(967): n is a, c, g, or t
  misc_feature (994)..(994): n is a, c, g, or t
  misc_feature (1039)..(1039): n is a, c, g, or t
  misc_feature (1042)..(1042): n is a, c, g, or t
  misc_feature (1051)..(1051): n is a, c, g, or t
  misc_feature (1054)..(1054): n is a, c, g, or t
  misc_feature (1064)..(1064): n is a, c, g, or t
  misc_feature (1168)..(1168): n is a, c, g, or t
ctctatatcattgatcaacattgataatctgaatggtttaaaatntttccatgacattaacaactctaatttacacccttctttaaattactgtcattattattgttgttttctttttgagatagtgtctcactatgtagccctggttggcttgaaactcagagcaatccacctgcttctgccttctgagtgttgatattaanangtatgtgccactattcttgacctgaaacagtattttaagagagaattagccttatcttgctgtccaggcagagggcctatgtgatgtccctctcaattcatgtcacaacaaaaacaaaaaccaaattcacacagtttctggaacacttgatatcctgccagtggagaaggaggatgtcctcaaattctttgcagtaagaacccccttaggtggcaccaatcttgtcttccttatggnacagtaaatcttccaaagacaaagtgagaggntttacgttaaaacaaaacaaacaaacaataacccgaggnggagctgggagatgctgctgctttcagctccagccattactggcattgggaacctgcagatgtcaacttcattgcctccaggaacccctggggccagctagctgtcctgacttttgctcctgcnaaagactttcattactcaaactaagaggacttcaggaagcgatggcttttgctagtcaccaatcccagagctgatccccagcccatcacaaaggtgtcttatgtcaacctgtctgccgttgctctgtgtnacgcacattctcctcagtactattgacattgacattgcatgcaacaagggtactcacccagtgaatcctacttggtggatgttggcttgggaagttctgcacacatgtgacaccatctctggggagcacccatagttctcatcaggtcatgtctaatctctactcctatagggagcctgaagagatggagaaggaaaaanaagtgtagccgaaaaggctgtgactanaaaaatctgtcagtgtggaaggactatacctgctcctgagttcantgntccttgganaangtggaagaanggaggtttgaaggtgtcttctgtgcccaaccagaagttcccagtgaagacttgatgttcagacactccagggactagtctgcaccgctcatgccactgaatcanat

SEQ ID NO: 495702 - DNA, 136 bp, Homo sapiens
cgtatgacgaggaggaagaaggtgacacaggaggatacatagtagaagtagcatatcttgttacgagcgaatcagaggtgtgatgacgcgttattgtctgaggttgacgaaagacacaagttgtgaactaagactg

SEQ ID NO: 495703 - DNA, 865 bp, Homo sapiens
  misc_feature (584)..(584): n is a, c, g, or t
  misc_feature (760)..(760): n is a, c, g, or t
  misc_feature (771)..(771): n is a, c, g, or t
  misc_feature (789)..(789): n is a, c, g, or t
  misc_feature (798)..(799): n is a, c, g, or t
  misc_feature (804)..(804): n is a, c, g, or t
  misc_feature (824)..(824): n is a, c, g, or t
agcggcctgcgtcctccgcccgcctcttttccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactgtcgtggggctcttggctgctgtggctgcgctgctgntcgggcgtggtgtctcgagaggacagtggatgtcgccacaggtggcacgttgctgtgtgccagcagtgtcctcactgccttccttgcagcctttgccctgggggtgctgatggtctgtatagtgattggtgctcaaaagctcgggttcaacccatacaacattgccacgcccattncagccagcctnggagacctcatcacactntccattctnnctttngttagcagcttcttctacanacacaaagatagtcggtatctgacgccgctggtctgcctca

SEQ ID NO: 495704 - DNA, 846 bp, Homo sapiens
agcggcctgcgtcctccgcccgcctcttttccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccagcactggcctgtgtttgtggaggtgaaagaccttttgacattggtgccgcccctggtgggcctgaaggggaacctggagatgacactggcatccagactctccacagctgccaacactggacaaattgatgacccccaggagcagcacagagtcatcagcagcaacctggccctcatccaggtgcaggccactcggtccgtgggggcctctctggcctgccttggtggcctgcgccctgctgttgggcgtgggtgtctccgccgcagggaccgtgggcttgtccggccacggggtgggagtctggcctcgtgttgccagccatgttgttccctcaacgtggcccttccctatggcaagcccctttgccccttgggggttgcttgagtgggcatgtattcgtgcgatcggtgctcggaagcctcgggggtccacccagaaacctctgccacggcccattggccgcccgcctgggacaccttcattcccattgc

SEQ ID NO: 495705 - DNA, 757 bp, Homo sapiens
  misc_feature (476)..(476): n is a, c, g, or t
  misc_feature (652)..(652): n is a, c, g, or t
  misc_feature (663)..(663): n is a, c, g, or t
  misc_feature (681)..(681): n is a, c, g, or t
  misc_feature (690)..(691): n is a, c, g, or t
  misc_feature (696)..(696): n is a, c, g, or t
  misc_feature (716)..(716): n is a, c, g, or t
agcggcctgcgtcctccgcccgcctcttttccgccgccgcctgggaggggacccgggctgccaggcgcccagctgtgcccagatggatgggacagagacccggcagcggaggctggacagctgtggcaagccaggggagctggggcttcctcaccccctcagcacaggaggactccctgtagcctcagaagatggagctctcagggcccctgagagccaaagcgtgacccccaagccactggagactgagcctagcagggagaccgcctggtccataggccttcaggtgaccgtgcccttcatgtttgcaggcctgggactgtcctgggccggcatgcttctggactatttccaggccaacactggacaaattgatgacccccaggagcagcacagagtcatcagcagcaacctggccctcatccaggtgcaggccactgtcgtggggctcttggctgctgtggctgcgctgctgntcgggcgtggtgtctcgagaggacagtggatgtcgccacaggtggcacgttgctgtgtgccagcagtgtcctcactgccttccttgcagcctttgccctgggggtgctgatggtctgtatagtgattggtgctcaaaagctcgggttcaacccatacaacattgccacgcccattncagccagcctnggagacctcatcacactntccattctnnctttngttagcagcttcttctacanacacaaagatagtcggtatctgacgccgctggtctgcctca

SEQ ID NO: 495706 - DNA, 1045 bp, Homo sapiens
gctgggccgagagcgggtggctgagccgggacctcgtcgttgattctcggaaccctgaggagaagcggctgtccggggctatggctgtgactctggacaaagatgcttattatcggcgagtgaagagactgtacagcgaattggcggaaaggagaagatgagtatgccaacgttgatgccattgttgtatcagtgggtgtagatgaggaaattgtgtatgccaaatcaactgcgcttacagacgatggctctctggttatgaactaagctgatactatcatggttctcgatgtgagtgacataaagtcactactgtatggcacagcagagaaaaaagtgggagttcgttgaacacagagttgccagacacgtaagggcaagtgagaatggctaatggagccccgtggcatcacagctgctactacggagactacgaactggaaagctaactaaggagctaggctcttgacaccaatgactcgcaagcccgtttatcgagcacagggcaccgcactggccctcaaggacttgcgacgtgtccaggccacacacgcaccacagtgcccgtggcaagcaacgctgcactctgaacgtagcctcgcgtacactgcactctgccccttccaatacctaacgtacatcggcctactcgcacccaacagcgtcgcagtattcacgcggccacgtgggcaggcacactcttcccgtacctcagtcccggatctggctagcacggggaacctgcgctcgcccgacgcacgcctctagccccacgctaccgtggactccgcaagaccgccacgtccccagaccctcccccctccccctctcgaaacacttcctatccaacccccccaacatcacccctttccacacgcgccacccatcgacctccccttgcaccccacacaaggtcctccaatctgcccacccccatcgcatctcacccacaaccctatcccgcacgccccacccaacaaacaatcccggcccctcccacatccttatcccgcccacccatccccccatcttccaacacgcacaa

SEQ ID NO: 495707 - DNA, 204 bp, Homo sapiens
ataccggcaacacgatagtgaaatcagtaccagagcttgaagaccaggataccacccaggaaaacacacaacaagcccagctggcggcagcagctgaaatagaagaagaaccagtcagtaaagcaaaacagagtcggagtgaaacgacggcacggaaggctatgtccaaacggggtcttcggcaggttacaggagttactagag

SEQ ID NO: 495708 - DNA, 173 bp, Homo sapiens
taatatgcctaacaagacagttctacaccatgtgtacgactcagataatctttctagtagcgacgacttggttcgctatctgattgtcacaatacgcgtatagaaagggaactatatgggtatcttgctctctcgacagtcgtagagactctgaggagagacataggtagaga

SEQ ID NO: 495709 - DNA, 169 bp, Homo sapiens
gtacgagccgaaacgggccctactcctcctaggactaagggtgacgtagccgcgctatgacctaaaagcaagtttcacagcaccaaatctccacctgcatcatcacctctagccaaaaaggcataattaaacttcacttcctctctttcttcttcccactcatcctaac

SEQ ID NO: 495710 - DNA, 344 bp, Homo sapiens
  misc_feature (16)..(16): n is a, c, g, or t
  misc_feature (97)..(97): n is a, c, g, or t
  misc_feature (247)..(247): n is a, c, g, or t
attcaaacctcatctnccctgaggggtcccctggggagggggcttgaaagggctgcatccccccaaagggaggggcatccaagtcttcccctccctnccccaagagatcattgtcttttacccatttgaaagcactttcaccttgttcctcatttgacacccctaagaatcagataacccagagatttttttgatacccgtttttcagttacagaaactgaggcttggcccaggcgtggtggctcanacctgcaatctcagcactgggaggccaaggtgggcagatcgcttgagcccaggagtttgagaccagcccgaggaacatggcgaaaccccatctctac

SEQ ID NO: 495711 - DNA, 1282 bp, Homo sapiens
agcgggcttcgggtccggtccctgtgcggcatttacacttccctcttagaactgcctttagtggcatcccagtagagttggtgaacgcacattaagtagagcctagtagatccttggtggacaaatggtcttcagtgatcttacatcgagggactgtgcgatcttatatgatgaagtgggatctaagagatgctgatccataggagttgaagagtggacgtgccgtgcatgtcgctcagtcgcgtcatgcgcggcataaccgcatcacgtccttcagggagtgctctatgtgtcatatctattgctaccaacgttcgccgtctgggtgcacccggaagagtctctcatgcgcatacagatcgctcatagcccgttgtggaaactcaagagaaaacgcgacatggggattcacacgagtgcatcgaaactttaatcctactagtgagtgtgcacctccttgatgtctacctagccttggctgcatacattgtgtggctcctcattggccagagtctctggctaggcatcgctgcgtgggacccttgcggtgcgcatgatccagggatcctgattgacgcatgtttcccgtgatgctcggcaccagtacccggtcctgcagctttgaatctgccgagcggagacttctaccgcaaaaggccaagcgcgtctcattggcaaagcgggcaatagaggacccatcccgtgttgaacccccctaaggcgctccggggccgtatatgacaattttggagccctcttgcgtcctccgagaacacacttcttgctcaactcctccgggacggagccttcaaactgcttgcgcagagcaaatatcaaccaaggaaacatccaccatttcttatcatgtcatacagggggctaccccttaggtaccgggcccacaacagggacaatcggcgggcaaagttttacgcgtgcacgcccaatagggcatttgacacaccatttctctcgcccaaatacatcgtcccacctcgggtttcagatattcgcccccgaacttcctgacgcttgagtcggcccgagaccttccccaatttgggccccctccggactgcgtggcggacagcccccgcttgggcgcccttgcgggacatctatctgggcggagcgtttttccgcacagcacatttgtcctggtccgtggggcgactggcgcgcttggggcgcccacccgggcgcgccaaccagcacccgattttatgcccgacacttgtgctcccccccgcgttctccgttgtatgccattctcaccgagggt

SEQ ID NO: 495712 - DNA, 681 bp, Homo sapiens
gacggcgatggagaccctcatcaacgtgttcaacgcgccactcgggcaaagagggggacaaggtaccagctgagcaagaaggagctggaagagctgctgcagagcggagctctctggcttcctggaagtgaaagagcttaatgctgtaggccacagaagccctcaagacctttgaggaggcctagaagagtcccataaggtcaaagcagttcctcctcgcgtcatgctttgcctcctgctcctcaaaccatcccccttgcctctgaactcagtgctgtacccttccctatatcacctcccttttcctctcctcccacccaccaggcccacgaaggaatgtggatgctgtggaccaaggtgatgaaggaggctatgacgagaatggagacggggaaggtggacttccacggagtaatgtggtgcttgtggctgctctcacacgtggcctgtaacaaatttcttctgggagaacacgttgagcagacagccaccacattgggcagcgcccttcctctccacccctcccagagcctgccttttccccctgcttccacctcaccccacttatccctttccataaccccacccttgcccaccccacccccacccccaccaagggcgcaagagtacggtccaagcctgcaaatcatctttcattaaaggcttctctctcaccagcca

SEQ ID NO: 495713 - DNA, 707 bp, Homo sapiens
aatctgcgtgagcctgcgggacggctgtgcggtgtgcgccgtagtgcagccgggacagtgttgtacagtgttttgggcatgcacgtgatactcacacagtggcttctgctcaccaacagatgaatgacatgatgcaccaacgatggctgatgggaaccatcctgtagaggtccatctgctgttcagacccagacgatgccatgagctatgacttgggcctgcaggtgtggctgccagaggggagatcagccatggagcagccacagtgatggaagcccctgagggtccgggaagaggaggagaaagacggaatgtgtgcaggaggcatgatatgtgagccccagatgctcaatggtggtgaccacaagcatgcacttccttccagcatgctacacagacctctcccggagctcctcgccaacctcactgctggaccaactgcagatttggcttgtgacgggggcctcatgcggcagcctcaacatggcagtgaccgggtgtgcggggacaaggcatcgggcttccactacggtgtacatgcatgtgaggggtggaaggggcttcttccgtcgtacgatccgcatgaagctggagtaccagaagtgtgagcgcagctgcgagatcagaaggaggaccgaacaggtccagactgcggtacaaaggctggatgggatgtcaaaaggagcggtggcggtcggagctgaaga

SEQ ID NO: 495714 - DNA, 932 bp, Homo sapiens
  misc_feature (685)..(685): n is a, c, g, or t
  misc_feature (698)..(698): n is a, c, g, or t
ttagggttcgtcgaccacggcgtcggaagacgggggcgcagcacacaagaagccctccgcccaccgcccagccggacggcaccccaacaaggcgcggcgccggctccggactcaggcggactcagccacacaaggaggggaggaacggccggcacccaccccgggggcccaagatgccctggggaactgatgcgaaccagcagagcgcggcgggtcaggcgtctgtttctcagccagcgggagccgcgtggcctggttaagccacgatagcaccgtctgcctggttgatgccgacaagaagatggccgtcgcgactctggcctctgaaatattaccactgctggcgctgaccttcatcacagacaacagcctggtggtagtgtgcacgattgcttcccggtgctgttcacctatgacgccgccgcggggattctgagcttcggcggtcggctggacgttcctaagcagagctcgcattgtggcttgacggcccgcgagcgcttccagaatcctggacaagaaagcgagctccgagtgtggcacgtttctggcgcgtgcctatactcgctgcacaagaacagtgtcagacatatttcggtgctcagcggtggcaatgacaagtgctcgcagttctgaaccaatggcatggatggcggcatgagtatctgagatgtgaagagctttncagtcagctttanggactcagcatcaatgactgtgagaatatgttgccttctctaactgtggggaacgggaaaggtaaggagctcaggtcttgataatttttggtttattcaatcccttgttttcttaaagaggacaattggatttctatagaaattttttcaattattttaaaaaaggcttattttggcattcctttacagctaatataaaggctaaaaatttaaatgttaaattttatgttttag

SEQ ID NO: 495715 - DNA, 126 bp, Homo sapiens
tctagagttaaccgcagctgttcctgttcgtctggtaagtcgaatcatctcacacccccaggtcatctgagcgacgatgttgcgttgactttcgtatgctgcccgcgtagatctgtcgtcttgcgc

SEQ ID NO: 495716 - DNA, 730 bp, Homo sapiens
aacgaaaacatctagaagatatgaagtagttaaaaaaaaaaaagggcaaagaaataaatatacaccaaaaaaaaaagataaattgtagctataaatataaaattaaataaccagtaaataaaactataacagttctaatacaaaccaaaaccagcctgaaagacccaaccttaaaaaatagctaaaaaattaagggcataaatactagcataatatatggagtataaatattccatatactactaccctataccctctagtaatagtaatagcttaacctagatactgcctctagagggctaatacagagaaaaccgggttatccgagtttccgaactacaaataaagacctccaaatgtacctgaaccaaagtattcggtataatctagcagagggtaatattgagtaaggaaggctaatagaacatacattattttcaactaaattaagtaaattaaagatccgtaagcgcccaaatttaaaattcttccattggaatataactaggaaatgaatataaccctaattaccgtgcctagcccttgccaagaaataatgtataaacaaaagaaaacccaaatccaccccaatgggcttaaggagatactaatccttaaaccgaaccgcaaagctttggaaactcataacctaggccgaaacagactttgacttaaattcgtccgggagaattaatgtaaaactagtagaacccttggtaaaacatccaat

SEQ ID NO: 495717 - DNA, 681 bp, Homo sapiens
  misc_feature (359)..(359): n is a, c, g, or t
caaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccaagattctcacccacatcattgaaggctttgttatccaggaaggagcagaacctttcccggtgggttgttctcaagttactgaaggagtctgaagaagccactacagactggccttccgacagggctggactggagaatcagtcaanggtgggccctttggggaagtgggacagcccaatctgctggaggttagataaagaagggcgaaatctcctgaagtgcgagtactgtgggaaagtacgcccccgcaagaagcaagttttcgtggctcctaaagaaggttctgctccatggaacttgcgctaaagaggtacaatgtgagcctgttagccatcaagttcccggctgaagaaggaaaaaaaaatgaaaggaagtttcaaagaaagccaactatggctcgccgttcgcaagggcggtggacccccgccgcagctcctcctggacaattgccccgtgccaaagattcaa

SEQ ID NO: 495718 - DNA, 673 bp, Homo sapiens
  misc_feature (55)..(55): n is a, c, g, or t
  misc_feature (101)..(101): n is a, c, g, or t
  misc_feature (265)..(265): n is a, c, g, or t
  misc_feature (282)..(282): n is a, c, g, or t
  misc_feature (300)..(300): n is a, c, g, or t
  misc_feature (344)..(344): n is a, c, g, or t
  misc_feature (352)..(352): n is a, c, g, or t
  misc_feature (385)..(385): n is a, c, g, or t
  misc_feature (527)..(527): n is a, c, g, or t
  misc_feature (538)..(538): n is a, c, g, or t
aaatcgagctcggtaccggcatgtgctgtaggccagcgatgacgacgaggagggnaggtagaaccttggtccatattcagtactgctgggttgtgtgttgncagaaatggtacatagttcaggtgtcacccagccttatgcttcctgactaacacttcatggttagggaacactttcttcattagtgggaccttgggctgaaaatgttatgaggccaggctcctgtaggggactggggcctaaacctgaatttttctgaatgccnggaaaatctatttggcnatttgctattttactccnttctgaatactattttacttctaaccgtgtgtgttgaaaagccnaatatgcnagattacttcagaaaaaattttttttttttttngagacggagtctcactctgtcacccaggctggagtgcagtggcatgatctctgctcactgcaacctctgcctcctgggttcaagcagttctctgcctcagcctcccgagtagctgggattacaggtgtgcgccaccacaccnggttaattttngtatttttagtagagacggggtttcaccatcttgggcaggctggtcttgaactcctgacctcgtgatccacccgctttggcctcccaaagtgctgggattatagccgtgagccaccgcgctggcctcagcacatg

SEQ ID NO: 495719 - DNA, 785 bp, Homo sapiens
aggcaccatgagccaggacacctgaggtggatatgaatggagtgtggagctgaatgagttagagcccgagaagcagcctgatgaacgcggctgtctgtgtgtgcgtgccatgtccctgtgcgtgtgagcctgagaagaattggtcttggttgaatgatcagagggtgtgctggaatgactgatggctgtgatgtgctgtgcatgcctgctgtgctaatgtttcactgtgtgccttgtaccaatgtgatggatgcttgcttgaatgtgttgtgctatggcatgccctcgtgctggtgtactgcagccctgcttggtgctacttgctttgcttgtctcttcttggctctgtgcttgtgctctgtgcattgcattgcttggtgcctgtgtgtcagtatatcatgtgctgatgctgcctgcctggatgtacgcagatgctactctgtgttgacagaagtgtgttggacacacagtgagacctgcccttactatcctgcatctggcgaccttcagtgccttccatgtggcccatcgtgctgctggtgtcaaaccttgtgctgtggtcttgatatgtggtgcgtctacgatttaaccttgatgctctactgcataggttgaattgtgccttgttgctagggtaccaattcactaagaacactcagaagggatgattgtctgctcagacttaactttgcttgcagatcgacccccaattgtggcatccagaggaagacttctgagagtctcttgcaatcgggttgcaaacacgagcattcctgggtcttctg

SEQ ID NO: 495720 - DNA, 526 bp, Homo sapiens
  misc_feature (79)..(79): n is a, c, g, or t
  misc_feature (93)..(93): n is a, c, g, or t
  misc_feature (110)..(110): n is a, c, g, or t
  misc_feature (113)..(113): n is a, c, g, or t
  misc_feature (120)..(120): n is a, c, g, or t
  misc_feature (132)..(132): n is a, c, g, or t
  misc_feature (135)..(135): n is a, c, g, or t
  misc_feature (156)..(156): n is a, c, g, or t
  misc_feature (168)..(168): n is a, c, g, or t
  misc_feature (224)..(224): n is a, c, g, or t
  misc_feature (244)..(244): n is a, c, g, or t
  misc_feature (250)..(250): n is a, c, g, or t
  misc_feature (253)..(253): n is a, c, g, or t
  misc_feature (265)..(265): n is a, c, g, or t
  misc_feature (267)..(267): n is a, c, g, or t
  misc_feature (274)..(274): n is a, c, g, or t
  misc_feature (289)..(289): n is a, c, g, or t
  misc_feature (292)..(292): n is a, c, g, or t
  misc_feature (294)..(295): n is a, c, g, or t
  misc_feature (307)..(307): n is a, c, g, or t
  misc_feature (312)..(312): n is a, c, g, or t
  misc_feature (319)..(319): n is a, c, g, or t
  misc_feature (325)..(325): n is a, c, g, or t
  misc_feature (345)..(345): n is a, c, g, or t
  misc_feature (382)..(382): n is a, c, g, or t
  misc_feature (387)..(387): n is a, c, g, or t
  misc_feature (396)..(396): n is a, c, g, or t
  misc_feature (406)..(406): n is a, c, g, or t
  misc_feature (423)..(423): n is a, c, g, or t
  misc_feature (446)..(446): n is a, c, g, or t
  misc_feature (448)..(448): n is a, c, g, or t
  misc_feature (455)..(456): n is a, c, g, or t
  misc_feature (460)..(460): n is a, c, g, or t
  misc_feature (462)..(462): n is a, c, g, or t
  misc_feature (497)..(497): n is a, c, g, or t
  misc_feature (499)..(499): n is a, c, g, or t
  misc_feature (502)..(502): n is a, c, g, or t
  misc_feature (510)..(511): n is a, c, g, or t
cagggtgccttgaaatgaaaaaaggagttggacccgtccgcaagtaaaagtttaaaattcggggcgtgtgttatggggncacaggcaccaaantccgccaaggccccttnaanaaggggngttacaatgttnagngccagaagaccatcggggtcnccaagccttgcncccccaagaccaaagcaaaggccaaagccaagaaagggaagggaaaggattaaacnccaagcttggatgccaaggngccccnggngtcaaatggggntnggcccangccctccttttcccnggncnnaaatgtgacccnccagngcctttngttggntggttagctttaaaaataangcccggccttgtccttttcattccccagccccccccntaagngcccaaagnggggaggganaagggattttgggaagnttgagcctcccccaaagaaatgngngtcccanngccngnttttgtttttccccccaattccattattaaaaaananatnaaaaaaanngattttttcccccca

SEQ ID NO: 495721 - DNA, 133 bp, Homo sapiens
tcatttctagatctgtgtcttaaccttggcactcactttcactctccccttacgttattgccattgacttgcttgtctctgcacccgcccttgcgcattcacattcactctctcaactgcagtggccaactgt

SEQ ID NO: 495722 - DNA, 467 bp, Homo sapiens
  misc_feature (7)..(7): n is a, c, g, or t
ccttaancctccttatacatgctagtggtaatgtaaaatgctgcagttactttagaaaacagtctggttgttcctgaaaagattaaacagttaccatatgacccagcaattccactccttagcaaaataacataagtgcctaccaaaacttatacattaatttccctagcagcattattcgtaatagccaaaaatggaaacaactcaaatgtccttcaactggttaatgaattaaagtggttattatccatacaatggaatattatttgggagtaaaaagcagtgatgtgatgattcatgctatggaaatggattgacctagaaaacattatgctaaatgatagaagccagacacaaaaagctacatagtctaggattctctttgtatgagatccctagaacaggcaaatctatggagataggaaataaatcagagtgggttagagggaaataggtagcgactgcca

SEQ ID NO: 495723 - DNA, 341 bp, Homo sapiens
gatagcctgatgtgtgatctatctccttcagcaggtcctatcttgtagaggaagagtgatagatagacgtgtctgtgaaccacttgttgttgcagatgctatcgaatagcttcatgctctcatgcatgcggttcatctcctcgtcctccgctagcaccaggtcataggtgctccctgcttcacagaagatgatggctgtgacgccctcaaagcagtggatccacttcttccgctcagaccgctgaccacccacatcaaacatcttgaagtgtaggtccttgaaggtgaagtgtgtctccacgatccccgtggtctttacgcgggtccatctgacccatctt

SEQ ID NO: 495724 - DNA, 311 bp, Homo sapiens
gatgcatgggtaaagaaaatgggagctgggcacagtggctcatgcctgtaaatccccgttctttggaaggctgaggcaggaggatcgcccgagcccaggaatacaagaccagcttaggcaacatagcaagaccctatctctataaaaaaataaaaaaaattagctggtcatgttggtgtgtacctgtggtctcagaatctcgggaggctgaggtggcgggattgcctgagccttagagggtgaggatgcagcgagctgtgatcacatcactgccttccagcctgggtgacagagcaagaccatgtccaaaa

SEQ ID NO: 495725 - DNA, 429 bp, Homo sapiens
ggcaaatggtgcgtgcggaacacgatctgaccctagttccatacggggagcctgtaagagctgaggccctacttcacggaccgtggttggcctatgcaccggcccctctagacgtgcaccacatataaaggctaatacccatcccctcagctgctcatcaacagttatccttccctgcgcccatcccaatctgggcatcgtcaagagacacttcgataggatagccgtgggacccagaccccagcacctgagtccatggtggcgtatgtagtcacatactgtggaggctcctaagctctggccaactgcggccctatattcaggacaatccttttcccaagcgctaagggctttgatcttcgcataccaccctactcatataagcccagcctggggctgtgccgtccacacgagttgacactggtcttg

SEQ ID NO: 495726 - DNA, 277 bp, Homo sapiens
cactgcaacctgaggaggatgacgatgaggatgaagaagatgatgatgactgatctcaggcctatgatagctcagaaagggacttctcactcattgatgatcatatgatcctagctaactcagacaccagtgaagttaatgatgagtgaagccccagcatgggccccattcaataggcggctactatattttcatgtaatctggccgatggactatggaaacgtgggaggagcaggggagatgtgcagaagtccaggactccaggaggtggaaagga

SEQ ID NO: 495727 - DNA, 1153 bp, Homo sapiens
gaagctggactgggcccgcgagagtgcttgagcagcaggttaactgtagagccaatgctgtttgcggcagtgatgagatgatcgacagatcatacggggtgacacaagggcgaaaggctatcacacatgagggtcaccgagtcgtttggcacacttaacgatacgctgccccgtcatagacccatcgacggcctgctgcgaaaggttggcctgtgatatgtggagcatgcgtcatccgtgcgtcagtgtagtcctttctgctgatagtgcaacggcgctggggcgtgataacggggctaccatgtcgcaccgacacttgacgactccatgatagaaccgactttagtacaggacttcggcccgagggtgccgtacccgtttatttcagatgggaccggggcaaaggccttgtttccagacgatacaacagttgggcttccaatcttgaactaattgaacgcgtaatcctagagcccagaagaaggtcaacttcaagacacaccattcgtggcggatggggccttttgtgaatccccatcctgttaggtgaggtggaaacggcttggaacaccaaaaggttgaaccgttaacgttgtctgatgccagtttgcgacaccaggcattggctgagttggtagtagagggaagcgcccaagggggaagaggccagggtgtatgccgtacaacaactcgttttcgcggaccaagagggttcaccctacagtacattgggtgtctgtgaccaagaaaccggcaagagtggcaggttggtaagctgtgaccgtcctgtggggacagggacacgtaacttttgtgaaccccctttataagacgatattcacaattggcagcgaatcacattgccaatttaccaagatggatagatgggtgctcccaattggagacccctgacaacaatcgcccgagccaagccgaactgggccaagagggaagacaactgaagacaacggccacgtacacaacaggagtgacaacccaagacgtgcgcgcggcgggaccagagggaaccaccggcacagcgttaggcaaagaaaacggaggaacacgcacacaggggaacaccgttacatagctgtggcccatgaggcagcagccaacggacatttaacaggccccaggcgctagtagcggc

SEQ ID NO: 495728 - DNA, 137 bp, Homo sapiens
tgcggctcagtgagaataagcaggtaagtgccagcccttcctgccctgaggcgtgcaaactcgcctgcaacccctactccatagccgcgtagttagatcgagccgcgtagtcagatctgagccgcgtatgtcagatc

SEQ ID NO: 495729 - DNA, 203 bp, Homo sapiens
ctctctatctgtctgtctctgtctctctggacctctctgtctctctgattctgtgatgcaacagtactcaacattattaggcacataagaaccttaggttaaaatatgtaaaaagtccatatacccggacatataaacactcgtggtcgtttgagattctgcagatgtacaatctccagcattccccctcaaacctaaaaaaa

SEQ ID NO: 495730 - DNA, 268 bp, Homo sapiens
ttttcgagacagaggattgctctgtctccaggctggagtgcagtggcgccatctcggctcactgcaacctccacctcctgagttcaagcgattctcgtgcctcagcctcccaagtagctgggattacaggcacgtgccaccacacccagctaatttttgtggttttagtggagaaggggtttcatcatgttgcccaggacgttcttaaactcctgaccttgtgatctgtccacttcgggcaaaaacagacaaggtcgacgcggccgca

SEQ ID NO: 495731 - DNA, 226 bp, Homo sapiens
  misc_feature (44)..(44): n is a, c, g, or t
  misc_feature (82)..(82): n is a, c, g, or t
  misc_feature (87)..(87): n is a, c, g, or t
  misc_feature (148)..(148): n is a, c, g, or t
  misc_feature (164)..(164): n is a, c, g, or t
  misc_feature (197)..(197): n is a, c, g, or t
gaggacagtctaccaattatcctgcacaatcccttccacgggtntatgaaagccgcacgatgcctccaaagtggcactgaanggaangagccctgtacggcataaccgcgttgggtacccaggtacgtaatgcacgccacccgccttnctctcctcttctccanttgcggttcctcaccaatcggggccttaggtcnatatgttaggactcaccaaaatgatagta

SEQ ID NO: 495732 - DNA, 267 bp, Homo sapiens
acatcaaacgtaaggggggatcttagaggaaggtttcgtcggatgaatttcgatcgttcttcgggaacatagtcacaaacacaggaatctgatctgttaccacgtacacatctttcactggtgcgaggggaacatatgcccgtccatgtcttctgtagacagtcactttcatgagtcgaggcccaagtgtcacatgggtgtgtgtcacagaaactctcactgaacatcgtcccaagtttctggaaatactgaccaggtgggtaccga

SEQ ID NO: 495733 - DNA, 211 bp, Homo sapiens
gaaaaaaaacaatttttcccggggtgtttttgtttttccaaaaaaaaagacttttttcccccggggaacaaaggggtttaaacttttttttggggttttgcccttaattttttttttaaaaaggccttttttcccccaaatttttaaaaattttccccccccttttttttttgatttttttttttttttttaaaaaaaaatttgccccgga

SEQ ID NO: 495734 - DNA, 163 bp, Homo sapiens
ggtttttagtaatttgattacaacaggtctggatctagttttctttgatttatttgtttggagtacactgaactttttggatctgtgaatttatgtctttcatcaaatttggagagtatcaactgttatttctttatgtttttcagcagccattttttccctc

SEQ ID NO: 495735 - DNA, 100 bp, Homo sapiens
attcaggtgattcgccacttggctcccaaagtgctaggattacaggtgtgagctactgcgccctggctaatggttgtatttttttgtggacatggggtga

SEQ ID NO: 495736 - DNA, 139 bp, Homo sapiens
gtgtgtcgagataagggaggatactgcaacctgtagaggtgctatgatttggtaatcattttagtcaagttcgattcaggcaagaatcatcagtggatgctacatccagtggtgtgggattcaatgatcatgcaggcta

SEQ ID NO: 495737 - DNA, 268 bp, Homo sapiens
  misc_feature (155)..(155): n is a, c, g, or t
cggcacgagcggcacgagctcagagccaacatcaaggagtagctgaagggctgggcgcagtggctcacacctataatcccagcactttgggaggccgaggtgggtggttcacctaagctcaggagtttgagaccaccctggccaacatggtgaancccatctctattaagaatatttttaaaattagccaggcatggtggcaggactgaggttgccatgagccgagatcacgacattgcactccagcctgggcgatatagtgagactc

SEQ ID NO: 495738 - DNA, 170 bp, Homo sapiens
ggggcccccggttttgggggggcctttttttttttcccccgggggggggatttttcccttttttgggcccccccttgttttttttggggggggggggggggcaccccccccccccctttttttttttgtttggggggttcccccccccctggggggtggggttttcccca

SEQ ID NO: 495739 - DNA, 1040 bp, Homo sapiens
ggaccagcaccattgcggttggcaacgaacatgcgccttacgaaaggcggtacaaaagggagccaagaagaaatgtggttgatccatttctcgtacagaggagattgcgtcactgatgtgaatagcaccatgcatactgttctagagtactatacgaagatcattcgcgaagggaacggctctgtcagcgcgacggactccaatgggaacccagaaattggcactctgcatggtctcataggggttcgtgtgtttgacaggtgacgtctcgtctgatttgcgagacatgaatgaacgattgcatttaggaacacaatttccacagtctgacttactgcatagtactgttcatgggatacacagacactgtcctgacctaatctgtccatggccactgagatgcattacccgcgttgtgatcaacaaactggtgttcccactggctcaagagagaactggtccggaactacgtgagttcgatacgctcacagttgatcgtcaagcactgacctgaatggttcacttagcttccgtctttgtatctggtgttcgagttgttcactcaaagagaacggcagagcaatcaagataccggaagacctacttatctgctcggtgccaatcaggtccgcctaaatccggaagaatgatgatggaaatctatgtaccccgagaggtgcagacaaatgacttgaaagaagtggtcaataaattgattccagacagcattggaaaacgacatagaaaaggcttgccaatctactttatcctctccatgatgtcttcgttagaaacagtacacactgcttgaagaagcccaagttttgcctttgggaacagctcatggagcttcatggtgacaacggacacgtagttcctgggaaaaaggccactgggggacgaggacagggtgctaaaagttgaacgaagcctgactggcatattgaacccaccagttccaagaaatctgtttaaagcttcaggaccttcaaatcagtgggcaaataacaaacggtgctcattcgtgaacacacccatca

SEQ ID NO: 495740 - DNA, 387 bp, Homo sapiens
  misc_feature (69)..(69): n is a, c, g, or t
  misc_feature (87)..(87): n is a, c, g, or t
  misc_feature (259)..(259): n is a, c, g, or t
  misc_feature (291)..(291): n is a, c, g, or t
  misc_feature (349)..(349): n is a, c, g, or t
agaaacccatggatccaacaagcttttccccccgaaatttgagaggttttacccgagatatatcgaaanacttccaacccatctggnccataggttaagggcctggatgtcccaaagtttgtaacaaaccctttgcatataatttaacccggggaccacatgccctagatttatgtcagaaatatctgttggttttccaagggttgttaacagatgaagtttatgtgcaaaaaagggtaagatataaattcaaggaagnaaaaaagttgatagctaaaaggtagagtgtgncttcgatataatccaatttgttttatgtcaaaatgtaagtatttgtcttccctagaanacctcagaatgatttctataataaagttaatttcattt

SEQ ID NO: 495741 - DNA, 150 bp, Homo sapiens
tctcttgtgtgcttgacgacgactgacgctggggtgactctagctacttcctgatgttgcccatctcatccttcaggctgtacatctcgagggaggttcatctcaggtaggccagtatggggcaggtcctggatctgttttaggtaccgc

SEQ ID NO: 495742 - DNA, 141 bp, Homo sapiens
ttccattcctgccatctagctgctggaactctgaaacttttatgcctctagccaagtagttcccgcctctgggtgcacaggtggaaccatctggggcattttcaaaaactcgtttggccctggcctggacccccaagaatt

SEQ ID NO: 495743 - DNA, 284 bp, Homo sapiens
aaacctaattacgccactgagtggaagccagagatcaaatattgcatcctcacgaattctgtgtagggttctgcatctttttaccttcccaccagcaatgcacaataattccaatttctccacatcttagcccacacatgtgggctttctgtttttatttttctatggataaccatcccagtgagtgtgacatggtgtctcgtggtggttttgatttccttttccccatggtcagtgatactgagtatcttctcatgcgcttatgggccatctgttggtgttcc

SEQ ID NO: 495744 - DNA, 553 bp, Homo sapiens
caaaatgaaaagttgatatcaggaatttattcttaaaatagaaacttatactatttttagtttattcccttaatatctcctttttccaaaatctttaaaggcagttttttggcacaggctatatttattaataattgacacattcttaaaatagagcccaatcaaaaaaaagatgagccctttaaggagaatataggtcaggggcagacctaccgcacaggcaaacagagaaatttccacctcctaaccagccaagaatgtttccatagatttaatttcaccttcttgcccttttcttcactttcacactctttccctcccaatacctggcccaccaaaggagtcggtacgttgtgagagccataggccattttattctgaattcctttacggtagacttggcccagaaacaatttccaggcccttggggtaattccatcccggccctcaaaaatgccaacccaccaccaagggagactcctggactctgcagccaggagccctcatcccaacagcccaagggcatagacgtaggtactgaggagcacaggat

SEQ ID NO: 495745 - DNA, 322 bp, Homo sapiens
ctgtatcttggcctcccaaaatgctgggaggcatcccaagttgctagggattacaggcatggaccaccatgcctggctaattttgtatttttagtagagacggagtttctccagattggtcaagctggtctcgaacatctgacctcaggtgatctgccctcctcggactcccaaagtactgggattacaggagccacagtacccggccttgttttgcttatcattgtgtcctgatgcaggtatgtgatctctttgagggatcaggaccacagcccccaacccaatttatattcccagtgtccatggtgggaccctgaatgaa

SEQ ID NO: 495746 - DNA, 103 bp, Homo sapiens
  misc_feature (36)..(36): n is a, c, g, or t
agtgaatgcgtaaaagttagtccgtattgttcttanaggtggaatcggttcctcctccccaccgcccagacgccacagtcaggttctgggattagaacagcta

SEQ ID NO: 495747 - DNA, 420 bp, Homo sapiens
  misc_feature (187)..(187): n is a, c, g, or t
gaccgcctgacggtgccggcagacgttgctcaggagctcgacaccattgacgttcctgaccagggtcttgccgtggccatccactcgagggtgtggtaatcgccgacttccggcaccatcagctcgtggccgatgtagccgggaccgccatcgaagaggaggcgtttctcccattcgtagatggccnggatcgaaataccaatccaccggtagttgcgtgggagtgcgggcgagacggcgacgttggccaggtcggacatgatgctcgtgctacctccgtgatcgtgagttgaagacagcgggttgcagcggtgcttggggggccgatcaaagcaaaaaggccgtccccgcggtaaacgcgttgtaacggcccttttctcgtcgtccccgggggaaagtacccccaaacaccccccgggc

SEQ ID NO: 495748 - DNA, 384 bp, Homo sapiens
gtaagttacagcgcaggagacgagtcccttataggagtgaagaggataaacttctcctccagaacaagtgcaatacagaaggcagctctgagttcgacctgcttgaatggaagtggtctgaagcttatactggcctcttgtctctagtgggccagcccctgaagtgctgaggtctaagtggttgacctcgggcggatagatggccaacactcttgtgagagtagttctcataagttctagaactggtagctcggtcgtttcggacactaggtggcagacagggaggagcaggtgttcatatccttgatttagagaatttcccctcaagtatgtggcagtaaatacaagaagacactctatgtattaatgtctccattggcttaa

SEQ ID NO: 495749 - DNA, 410 bp, Homo sapiens
ccaccgctctccacagactctttgtgatctgaaggcagtgggggagaggtgacccgtgacataatgcgcctttgctaacatgtggctaggtgtcttgttggcttgtgcatataactttatcataacatagcaatagcctgacacagaagactgcacctgatagttgtcttagcacatctcaaaattaaatgtttatgaatagactactttttcaagacaatgctatttcctgagacgtagtactttttctgctaactccattctttgatgcatactttctgtcagtcaatgctgaggatcctcctatggttgtggtccgaaaatttgtccacctgctggaccaaagtgaccaggattttcaggaggagcttgaccttatgaagattgcggtgtttggggtaccgagctcg

SEQ ID NO: 495750 - DNA, 1216 bp, Homo sapiens
aacaccatcttctggagcccccaacaccacgaactgtccttgggggctccagaagatggtgttggcgggcctgaggagtatgaacggtgccttagcagtttgtggacactttcggcactgcacggtcatgaacatcgcagagcactacatggacttccgacgtcgaatgggatcctactggtgcgctacgatcgtctaccgtctgatgtcctggtggagcctataaggtggacaacgcgtactggcatgtggactttccagggacgcctcctgcagaagaacaacaaggacctgcgttctgccagcatgctgtggcggccccggcctcccacactcctgagccaggaacagatcaacgcaatattaaaacaggatctgaacgaaatactctaagatctttgaacagaaggatcgtttgagtcagtccaaagcctcaaaggaattggtggcgagacaggcgcaccatgatggaagatttccggaagtaccggaacaatggcccaggagctctatatgcgagcagaaacaacgagcgccgtggagtcgcgaggagggcgtggacactgacgagcgtgcgcacaggcaacgtggacgacttgggaacgaggagaccattggagtgcttcgtcactgcgcgaactcattcccctcggggaatcaggagtgaccctggagcactgtgccgtgtgtgctcgtggagccgaggcgtcctgccgggcagccgccgtgactcccggctcgtaccctgtgctctctgcgtctggcctgtgacttgcgcctggatctctgccattgccacacatttttggactttcagcccctggggtctgcacgcggggacttcaggccccggtcgccttctcccttgctaggcagttttctggtttaaacccgcggatcctatgatccgtaagcacctcagcagggctcatgggggaccaccttcctcctgcagcccagggacgattcactggggtgcgcttatcacgaggcaggacaattcgcgagacgcagaactaccatgaggacaagcgacgatacaggaaacaccgatgggcgcactctgatccacccggggtgtgcggttcacaggtagacacaagacctgctgacataaactgcctgagtggcagaggcagcgatcacagcccatggcgaccgcctgtgcattgactgctcggagatacagagtcgctatcactatgactagctatga

SEQ ID NO: 495751 - DNA, 259 bp, Homo sapiens
  misc_feature (154)..(156): n is a, c, g, or t
  misc_feature (158)..(158): n is a, c, g, or t
  misc_feature (231)..(231): n is a, c, g, or t
  misc_feature (244)..(244): n is a, c, g, or t
aacttatgataacaatttatgtctagataattcaaggctgggcgtggtggctcacacctataatcccagcactttagaaggccaagacagggggatagtttgaagcccagaggtgtcagaccagcctgggcaacattagcagaatcttgtctgnnncnaaaaacatttttttttttaattagctagatctggcagcacgtgcctgtactccaagctactctgggggctgangttggaggatccnttgaagcctgggagg

SEQ ID NO: 495752 - DNA, 270 bp, Homo sapiens
ggacctcccggcgctgctcccctgccccgactgcgctgcggagggcaacatggctggcggccccggccctgctcctgccgagccccagcgccgctcggcgcgagccccgcgcgcctgcctgcctgctactggtgctggggccctgaagatggctgggccctggtggctgctggcccggtggaggcctccgggccaagcccgccgccctgcctgatggactgacatgcgactggcgactctttcttggtgctgctggaagttgccgcactg

SEQ ID NO: 495753 - DNA, 162 bp, Homo sapiens
tctctctacgtaagacttcagttctatgttgactcacaggggcgacagtgggcgtccttgccgaggtccagatcttagaggaaaaactttcaggcactccctattcagtatgaaactagctgtgggtatgccatatatggattttattatctcgaggtatga

SEQ ID NO: 495754 - DNA, 460 bp, Homo sapiens
gccattattcaatgctggtttaacaaagtctacatgttatgtgttaatgaagcaatattagatgatgatggtgccgttagctgcgtcaagattctgggctagacaattgaagtgaaatcttccctcgaccctctgcctttcccagtatgtcatatctctagagtgcaaatgtctcctgcccggctttaaaagaatgcagttcgaaagaggggattgttaagaacttttatttgctttgttatttctataagaactagagcttctttatgtaaacgttagggctttaaaaagtcactagatgctacattctagacaaacatttttatttcttcatttatcccaatatatctataaattctgatttcttaatcacgattctatttcctttaaaagtcttaacgcgaaactgttattgttctgtctactacctgctgtttaacaaaagcaaagtgtgcagcat

SEQ ID NO: 495755 - DNA, 271 bp, Homo sapiens
atacatcctcttccccacagtgagcttgtctattcgaagcttaagttcgcatgcaacgtggactcgaggaggctgaaggaaagagatctcgacaaatgccgttcctctgacatgaaggtttaggacagatctatcgaacaaaagtcgttgtctcgtggaagccctcctagacggtggatccccatacctgccctccagagagtattccttatttagcaagctttttttggtaaaatgtgcaactggtcatgtcttcaaccctcttgtgaaa

SEQ ID NO: 495756 - DNA, 929 bp, Homo sapiens
ttcttttcgttgccgtgatcgcgcgccatcatggactcgcattcatgctcccgggatagtggcctgtgccagtcggtcgttatatcctatcgtagcgcagccgttccccacttggcttgaagttagatcgatcatgatcgacgtgagactccagcagcatttacaaacgtggcctactcgatgggccgatactcctctcagaggatcgcgtagtcaagtcctgcaaacgtattgcgactggatgatcgcacattgtaccgtatccgtagagcaggccacataacatagttttcccagcacctttctcttaagtcttcagggcgaactttggtatcctgtatctatgtctgaaagaaatcgttcttagccaattgttacattctacctgcaatatgcccttgtgcattgtttcggataggggctaattcgttgcaagaacggcaactacgtagaacggcataaacgggactgcgtaaaagtgttcgcggtctcgcattacctaagtctggagacaggcccagcgacctctaccaactcggtgtatgagtttttctgaatcatgtgaataagaaggaactctaacgggcgcagtactctaactaccgtctcaccacattatggggcaaaagtagtagtacattcgattcttatcaatggcacgtactgggatccctggggtgctgcattaacagtataggtcctagttggttcacctacaaatgactacatgctcacgtcgcactacgttcaagggcccgtggcaaatttagaaaaagccccaaggaagaattacttccccgttttttccacaggtaaccccaagagactggattgaaagaaaagctttttaaattgtagctcccagttgttgaaaggcgttgctcggggccacaatggaaggcttttggcgctttactggaagggtcccc

SEQ ID NO: 495757 - DNA, 825 bp, Homo sapiens
  misc_feature (137)..(137): n is a, c, g, or t
  misc_feature (154)..(154): n is a, c, g, or t
  misc_feature (162)..(162): n is a, c, g, or t
  misc_feature (185)..(185): n is a, c, g, or t
  misc_feature (278)..(278): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (291)..(291): n is a, c, g, or t
  misc_feature (296)..(296): n is a, c, g, or t
  misc_feature (319)..(319): n is a, c, g, or t
  misc_feature (325)..(325): n is a, c, g, or t
  misc_feature (398)..(399): n is a, c, g, or t
  misc_feature (421)..(421): n is a, c, g, or t
  misc_feature (426)..(426): n is a, c, g, or t
agcggaagtcgcgaggagcgcggacggctgggctgctgctgggcggccgcggggcagcggagggcgccggcactccggtccccgccgctccccgtccccgctgctcctagcccctgccgcgtccccggcggacggcnatgggcgccacccgcgncgcctggnccgggaccgtgtgggccgtgagnatgaggacggctgggagacgcgaggggaccgcaagcccggaagcccctggtggagaagaagcggcgccgcggatcaacgagagcctgcagganctgnggntgntgntgggngggcgccgagggtgcaggccaanctgganaacgccgaagtgctggagctgacggtgcggcgggtccagggtgtgctgcggggccgggcgcgcgagcgcaagnntgcaggcggaacgagcgagcgnttcgntgcggctactccagtgctgcacaaggtgcacaccgttcgtgtccacgtcccaaggcccattcgacgctaccgttcgctgccgagctcctgaaccatctgctcgaggtccattgcccgctggcggtgagaggcagcaagcttcccagagatcttgctggggggacgcccttggcgggggcccacctagagccacctcatctcccaatattgcctgggtccgaccccccagtggccactaacggtggggatccttcagggcgctctcccagcaaagcatgtggccgccgagccgcgggatccacttggccgcagaaggaaaaatgccagcgtggaccagagtggcgcccgcaaaccctcggaagcccggggaatttgggatctcacacagaaataactggc

SEQ ID NO: 495758 - DNA, 398 bp, Homo sapiens
ggtacggaatgaattacaaaacagcaagtcattacagctggcctttcttccacccgtcatccccagtgtgagctctttttttttttgtgagatggagtttcactctcatggcccagacgggagtgcaggggcgccctctcggctcactgtaacctccacctctccgattcaggcaattctccggcctcagcctccccagtagctgggattacaggcacctgccaccacaccgggctaatttaagtagagaaggggtttcgccaggctggccaggctggtctcgaactcctgacttcaggtgattgatccacctgcctcggcctcccagagtgctgggattagaggcatgagccatcgcgccgggcctagattatggaattttggtattaccatgtatg

SEQ ID NO: 495759 - DNA, 298 bp, Homo sapiens
catgcgcgcaaggctgtctttcccctgccacgaccggaagtgtaggagagatctgcctctaccttgcgaccagatccaaccgtgaccgttcaagccgccaggatagatactaattctagttccccaaccgcctcaacctggtaggtccatcaactacatggtagctgacggtgacttcctgatcttctgtgtggtcttggactgagatcggccggtccatgggccccaatataggccgctcgcccctgagctgcagctcgcccctgagttagcagctcgccccctcagttgcagctcg

SEQ ID NO: 495760 - DNA, 993 bp, Homo sapiens
  misc_feature (1)..(1): n is a, c, g, or t
  misc_feature (544)..(544): n is a, c, g, or t
  misc_feature (546)..(546): n is a, c, g, or t
  misc_feature (963)..(963): n is a, c, g, or t
ntctagaaaaacgaccgtcctaggcctggccaattgggcccatgacacgtgacggggctgggaaagagacatcccaggatcaagtggccagagacgttgacggacagggggtgccggtggttggatccgcggccacctccgtccccggccgggaccacgttggggacccgtgggaggctggatccgcctcgccccccacgggcgatgtgggtctggttgaggagcgccagtcgggagggggtccaccctgttccccttgtccaacaacgacgggggtagtaccgccaaatcccaaccggaggatcgacaatgtgaagcaggcggtccggtggtaggtccacaaccttgcgcgggtccaccaccggaagatcaacgtccaaacggcgatggtcaaatccgaggacgacacacatggtccgacttacaaacattattgggactatcaccaaaagatgagagaggtcgaccacgacatactccatcctaacatcaggaatcgtgacattattgttgtgattcagaatcggaccatccgactccatcngntgaaggtgaactatcaaaatcaagagtggtttaacaaacagttccaaattcaactgcacccggtggcaacaggttacagaaggtcaggattctgagaagacaggtacaagaccacctccaaccaatcaccaaacacgtgattgtgatcaacaacgaggatcacgaccaaatccacaacgatgatctcggaactcagttgaatctgaatctcaacctccatagacctgggacccaacatgtcattaacctggtccaccatatcacagaacaatatcacgttataataaacaacaacgatgcacagttccagagttcctataaacaagactgtcgacggatctgggaccaccgacggactggacggagtctcgacacgacagaacctcagatggagcaagtcaacgcgagattggaccnggtccacattcaggtcgaccagactagacg

SEQ ID NO: 495761 - DNA, 563 bp, Homo sapiens
cggggggcccccccctgggggaggggggtttttttcccggggggggggcaatgtgccccggtttaccccccccgcccctgttattagggggggggggggggggcccttttgaacctgggggcttttccccccctttttaaaggggggggggggcccccccatggggggaaaggggcccccatatccatgggggggcccggggggcccggcagggaaggtttttcccccaaggggtctgggcccgccccccccccggggtgggggagggtttttttcccccggggggggggggggccccccccccccggctgtttgggccccccggggggggggggggggctggggggagggcggggggttttcccggggcccccccggccgggggggggggttttgggggggggtttggcccccccccgggggggggttgggccccttttggggttctgggggcccctttggggggggggggttagcccttttttttttgggggggggggggggggggtggttggcccggggggtttgcgtttttcccttttaaagaggaaaaaagggaaaga

SEQ ID NO: 495762 - DNA, 261 bp, Homo sapiens
cttggctcacctgtgatctactcgatatgtcactggatactccttcattcatggtgcaagtagtccttgagcgacacacatctcatcaccagaggcagctgtgtagtaccttaacagctctgaaagcttcttccgattatgagagtcttcgtgatatccacgactttatgatttttacaagaactgcatcatcgcataactagtagtactctttatctaccgcacagtacagaaacgcgttcatcagcatatatagacaca

SEQ ID NO: 495763 - DNA, 922 bp, Homo sapiens
  misc_feature (1)..(1): n is a, c, g, or t
ntcttgagcccgcactttatcacattaggtttcttccgtctcgaattccgggttgctcttctccgcgggtagactatgctgttcgccgccgcgcgcgcgcgaggtgtttagttaatattttcgttcttttcaaaggggacgcaaattgggacgcacgcagaggtgtgtcgcgcccgctcccggcccgcttgttgttgctggcacatgctccgcggcccgcccacatatttggtccgggcgcccacaaaatcctggcggcccccggctgtgttcagcttgtccgcccccgccccttgccgtgaccgccccctgctgtctataggggtttacacaaacacaaccggtcaggccgtatttgacgccctctcgggtgtctgacagcagtgcagcggcaagctgccgaatgtgtgcccctgcccccgctttgggtgtcccgccagctgttggccccgcggttgccggctaccatatggatccacgaagaggtcccttgttcgcggtacaattgccccgactttgcaccgtcgcaacaccccccttttgctgccgccaccgggtgacgccccctgacgagtatggggtccccctggcccccatcccgttgcctgaaattctactattgcccgcaccccgagtgctatactctcctcgctccgggcccactaaacactttggggtaactaaaatggaactcgtagtccgaaacattctggttccaaacttcacgggtcaataaagcctttaatatgcccccacccttcccgccttaaataagagcactcccgcgtggagtcaccacggtgactattcccctcgtttaagcacccttcccgggaggcttccccacaccacatttggtaattttcgttcttggggggcccccccaaacccccaaacccggggccggggcccccaaaaaaaa

SEQ ID NO: 495764 - DNA, 1040 bp, Homo sapiens
agcggggtccgctgtaataccggcccggcgcagaagcgggaggtcggcttctaggggcccaggacggcggcggtgcaatggcctcggcagcatgtggcagcagcctctcgtgaccaagccaacatggtaccgtgcatggaagctcgagagcagacgcggcaggtggcaggcagcgccagggtcctgggcgagggagagaccatcggctctgcaaagagctccacgcagtcgaggcgctgatgatccagctgacatggctgacagggctactccaagaccacgtacgtacatctggggactgtaccggagcggacatgcatggatcaaccttatatgacgtgcccagtgcgatctaccggggtccgcggacacgactcctttgcacagataaatcacgcctttgacctatcctgggctcggactcactaccgagtgtgtgacccttgggtaatccgacatgcctcgcgttaccctcgacgaggtgcaactgcttcacagtcatggggcacgacccttgagtgactgcgctcaggaccacccaagagctggttccaagaccactaagctacatggattacgggagcctccaaccaggggtacggagccccatcttgggacttcgaagttgcttccgcagccaacagcaggaacagtgggtgcacccaaccggcggctgcagcagcgactgtccgagcgcacccccgaggcacggcacacggatagatgcttcgccaataacagcaacggagagcatgggcgggccaacacacaacaaccagggcgtggcgacaccaaacaactgggaaacgtggggttccaacatgatacacggaacgggggacgaggactccgactggaaaaacccaagcaacaacacccgccccacacaactagctcactacacgggccaccctcttgttatgcgcaaaggggacacacccagcataacattgcgaaagcacgcccgttggctggggacatacaccacaggaagcagcgtcgcacagtacagagcgcatcacacactggaaacggcatag

SEQ ID NO: 495765 - DNA, 451 bp, Homo sapiens
tagaggattcactactggatgcaagtgtccaggaagctctctggaatcccccaaccagctggagtaagtacctctcctgtgctctccagtgcctcagacttcccaccattgtgacaccaactctgcctgctgaatctgtctctgtaatcctaccctcaatatctagcatgggccccatgaggcatcagattttgttgaaagaataaatgaggctgggcacggtgggtcatgcctgtaatcccagtactttgggaggcagaggcgggaggatcgcctgaggtcaggagtttgagaccagcctggccaacacggtgaaaccccgtctgtagttaaaatacaaaaaaattagctgggcatggtggtgctcatctgtaatcccagcttcttggaaggctgaggcaggagaattgcttgaacctgggaggtagaggttgcagtgagccaagatcgc

SEQ ID NO: 495766 - DNA, 792 bp, Homo sapiens
tggatggaagtcaacagtgccttatatttaccatctgacgtttagtagggacctggggaaccgattgcccgaggaatgcggcggagaattgtgttggctgtgaacgtggttccaaaattcactcctatctcattagaagaaataggtagcagcatcactcaccagtcttatgccatgacctgctgcttaaacatctcctggaatgtcctgggagaaaacgtttcgttggcttgtcgcccgactctgtcattttggctgtttattaaactctgatgtatagtcatctaccaccgtgcggtcctggccggacgaaacaacccgtgttgcttcctcaggcgaaaagaaacaaccaaaatgctagtgacaaatgtgctctatttggatagcaatataccatcttttatgtcattattctccctatacttgtaaaaggttcttcttcttcacactctcgccttctgaagaccctatgccttcctaagaactaattagttcctaaatctttttacccttcctggagctgcaattatttttgcccttagcgaagtggctcatttacacagctgaaaaccaacagtaattcttgaagatttgctcccacgctgcttggatcgcgcaatcccggttcacggcctcccgatcttggtgcaggcctttcacccatatactgtctggggggggtttccctgaagattaccgaggtgttaaacggcgccccgtcgtcgtttttcccccacatgtcgaaactgccacaacccgtgtcagcctcattaccctgtcacccggtataaa

SEQ ID NO: 495767 - DNA, 407 bp, Homo sapiens
  misc_feature (349)..(349): n is a, c, g, or t
  misc_feature (359)..(359): n is a, c, g, or t
tatgtgtggagggtgtatgatcggggacacacattcctaggactggagctgctgagtctcgggttctatgttagcttttgaggaactaccagactgtttccacagtggacgtgccattttacgctagcatcgataacacacgagggttctgatttctccacagcctcaccaacgcctgttgcggtctgtctttcgtttttttaaacttaccaatttaacttaaggattgttcctttccttaacaattaacatgaccaattttaaacacaaaaagtaactttccagggatattgcacaggagatggagaaggaggccagcaggtgtgacaggtgtggggtcccacaccgncactccaggngggtgctggcatgtttggcccccgtgggctccacgtaggtcgcagggt

SEQ ID NO: 495768 - DNA, 141 bp, Homo sapiens
cccaccagagcgtacccagcctaccgctcaggtaccaccagacctactaggagcacctagtagtagcgctagagaccacaccccctagtagaaagtactagcactatccaacgctagccagccgtaactagaacggagaat

SEQ ID NO: 495769 - DNA, 110 bp, Homo sapiens
ccattatgtagatcttgtagcaagacttggattcaggagtgagatgcaaaacaaaaaaacaaacaaacaaaaaaccaggaacgcttatgtggtgtgggtgatttcagagg

SEQ ID NO: 495770 - DNA, 258 bp, Homo sapiens
cctgtaatcccagtactttgggaagccaaggtaacaggattgcttgagcccagaacttcaagatgagcctgggctcatagtgagcccccatttagacgaaaaatttttaaaaattagcatggcggctcacatctgtaatcctagctacttggcaggctgaggtgagaagatcattggagtttaggaattggaggcggcagtgagccatgagtatgccactgcactccagcctgggggtcacagcaagaccctgcctca

SEQ ID NO: 495771 - DNA, 434 bp, Homo sapiens
ggctgcaggaattcggcacgatagagatagagttagagagagagagagagagagagagagagagagagatagagagagagtgactcctgtgatcgccatctatttctccatctctccctttcctctgtcttctctttctctcgtcttccaccatgttcttcttcctcctgcttttgcatttttctttcttactcgatttctccctgtctctcttccttcttctgctctcttcctcccctctatctctctgtctcatcctcccactgttctgctctattccacccctgaccctctcctcccttctcatcttcccttcctctattctttctgcttcctacctctccccttgtctcctccttgtcttccatttctccctcttttgtccttcttcttttttcccccctttcctccctttctcttcctctttcttttcc

SEQ ID NO: 495772 - DNA, 240 bp, Homo sapiens
tggatttaatgatgaggctgtccaagggtctaagaggtgatagtttgacaaatccctacgtgcccatccatctcctcttgtgtaaagtattccaagggtgccgtcagccagggtctactaacacgattcccttcacgtgtacaatacttgagaatcgaatctttaagtttgatggaatcgtgagacatttcctccactggggctacagtatgaatggacatacaatgcagccattttgag

SEQ ID NO: 495773 - DNA, 281 bp, Homo sapiens
ctaggtggaagcgacgtgtgtgtgtgtgtgtgtgtggggatgtgcatgtgtatgtgtgtggggggacgtgcatgtgtatgtgtgtgtggggatgtgtatgtgtgtgtgtggagatgtacatgtgtatgtgtgtgtggggggatgtgtatgtgtatgtgtgtgtgtggggcacgtgtcatgtgtatgtgtgggtgtgggtgccaaccaagaatatataaagagtcatacttatattcgtgggcatccagcaaggagattgtgttaattcttgcagcataagt

SEQ ID NO: 495774 - DNA, 225 bp, Homo sapiens
gatccttggggtgaatcagtgtagtacaagagatagaaagacagtccgtggctgaaagacaagtctggaatgctccactttttcaattctctctccattcttcagtaggtcaacttcaaggtcggatggatcgaaacccagaacacagtagcatttcagggaaatttggacttgaccagttctgcggctgggatgggagcgaggcggggataccgaagcctcgaa

SEQ ID NO: 495775 - DNA, 680 bp, Homo sapiens
  misc_feature (58)..(58): n is a, c, g, or t
  misc_feature (100)..(100): n is a, c, g, or t
  misc_feature (118)..(118): n is a, c, g, or t
  misc_feature (120)..(120): n is a, c, g, or t
  misc_feature (131)..(131): n is a, c, g, or t
  misc_feature (174)..(174): n is a, c, g, or t
  misc_feature (179)..(179): n is a, c, g, or t
  misc_feature (186)..(187): n is a, c, g, or t
  misc_feature (191)..(191): n is a, c, g, or t
  misc_feature (194)..(194): n is a, c, g, or t
  misc_feature (200)..(200): n is a, c, g, or t
  misc_feature (206)..(207): n is a, c, g, or t
  misc_feature (238)..(239): n is a, c, g, or t
  misc_feature (271)..(271): n is a, c, g, or t
  misc_feature (308)..(309): n is a, c, g, or t
  misc_feature (313)..(313): n is a, c, g, or t
  misc_feature (323)..(323): n is a, c, g, or t
  misc_feature (399)..(399): n is a, c, g, or t
  misc_feature (454)..(454): n is a, c, g, or t
  misc_feature (521)..(521): n is a, c, g, or t
  misc_feature (524)..(524): n is a, c, g, or t
  misc_feature (546)..(546): n is a, c, g, or t
  misc_feature (560)..(560): n is a, c, g, or t
  misc_feature (565)..(565): n is a, c, g, or t
  misc_feature (577)..(577): n is a, c, g, or t
  misc_feature (599)..(599): n is a, c, g, or t
  misc_feature (606)..(606): n is a, c, g, or t
  misc_feature (609)..(609): n is a, c, g, or t
  misc_feature (665)..(665): n is a, c, g, or t
tgaacattcgtgtccagggaggcaaggatggagcccccaatccacgtggaatacagtntctcctgaggtgcagatatcctgatcttcacatcttttgganctagtttcttcacttcantnaggagcctgtnaccaaaacctttgaacagggtagagcctcctgagaggacaatnttagngaaaagnntgcnccncaggtnaatgtnngacttatgaatggcgaacaccaggacctcgnngatgccttcactctcctctccaataatctggnctgaagagcaactcaggggcccggaattgggaaggannaatntaaatggtgntgccatcaggcaggtagtactgagctttctctgtctctagcgtctcatcccttttgggggtttatggataggtaanaggctctttcttttatggccttgacaatctcaaactcagaggatgagtggaagtngtagccctccttacgcaggtagaggcgcaggaagcgagagacgtcccggcccgcgatgtcgatgcgnatnaaggagtggggaatggaaaagnctaatagaatgggnacagnatgggttgaatncatccccagaatccagcaccanccctgtngtnctgcctggtagcgtaaaaggctggagttacagccttgcatgggagaatgaaaagangcgggcacattgaag

SEQ ID NO: 495776 - DNA, 429 bp, Homo sapiens
  misc_feature (156)..(157): n is a, c, g, or t
tcagcgtattacgctgttacttgcaaaataagcccactttgaatggggcccttctaacaaaaggttctagaatctgtcaaattgcaatacagcagacattagtgccctcctgagtctcattcactgtggacaggctttggcacacctcctctcatnngcctcctgagcatctcataggaccacccatgaatggccatggagcttactgatacaataaaacaaaccaaaatccccaagaagcgtgttctccttcagcctcagcactatattgctgatagaagtggcaacgtgctggctgcattccatagcccttctgagagaacggaggctctacacaggccacagtcgtgtggctactttacacgcagctgcccatcatgtgctgggtcatggacggcagcacgctgcagggcaaccacaaaacacatt

SEQ ID NO: 495777 - DNA, 113 bp, Homo sapiens
aattgcggcggcccgcagcgggataaccttgaggctgaggcagtggctccttgcacattagctgcacgcacagaaaaaaaaaagtacattggcggttttcgcagcccgagtcg

SEQ ID NO: 495778 - DNA, 221 bp, Homo sapiens
tgttgtatctgtaaaacaatggataatctgatgttgtcaacaatgcatctaataacgagctggttctgtaccaatgaccctggtgaagaattgcatctgtgctcatctgacatgcacacctgtacctgacatgtggtactgagtcccacatatgctgctgccccttgtggcctgcaagaatgggagccaagactgactccgtgagtgaagacagagatttt

SEQ ID NO: 495779 - DNA, 751 bp, Homo sapiens
  misc_feature (50)..(50): n is a, c, g, or t
  misc_feature (76)..(76): n is a, c, g, or t
  misc_feature (225)..(225): n is a, c, g, or t
  misc_feature (227)..(227): n is a, c, g, or t
  misc_feature (261)..(261): n is a, c, g, or t
  misc_feature (292)..(292): n is a, c, g, or t
  misc_feature (317)..(318): n is a, c, g, or t
  misc_feature (338)..(338): n is a, c, g, or t
  misc_feature (340)..(340): n is a, c, g, or t
  misc_feature (364)..(365): n is a, c, g, or t
  misc_feature (375)..(375): n is a, c, g, or t
  misc_feature (377)..(377): n is a, c, g, or t
  misc_feature (379)..(379): n is a, c, g, or t
  misc_feature (381)..(381): n is a, c, g, or t
  misc_feature (426)..(426): n is a, c, g, or t
  misc_feature (430)..(430): n is a, c, g, or t
  misc_feature (466)..(466): n is a, c, g, or t
  misc_feature (485)..(487): n is a, c, g, or t
  misc_feature (501)..(501): n is a, c, g, or t
gggcaccgcccgaggtgcgggtcgcctccagagatcctgtgccttcaaancctacgagtccatactttaaaacaanaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacntngaaaataaagtcgtggcagatctaggatgtggtngtggagtacttagcatcggaactgcaatgtnaggagcagggttgtgtgtgggattnngacatagatgaagacgcatngnaaatatttaataggaatgcagaannagtttgagtnancnanatattgacatggttcaatgtgatgtgtgcttattatctaacagantgtnccaagtcattcgatacagtaattatgaatcctcccntgtgggaccaaaaataatnnngggacagatatgcntttctaaagactgctggggaaatggcaagaacaggagtatattccttacacaaatcctcaagtagcagaaagagttcgagtatgacctggcaggatcatacaagtatcacaaagaagaaatcagtggacattggaagtggacctaatgcgggttaacgttttaaaagccccggaaacgaaagttcgtgaaagctatgaaagatgaatagaaaaatgggttacagagagaaaaaaagacagaagaaaaaaa

SEQ ID NO: 495780 - DNA, 131 bp, Homo sapiens
cttctctcttggccgacaccaccaggactcggaactacaggagcaacggttgagggtcgtgtctccacctcctaccgagcgaagaatatggaaaccggatcactgtccatggcaacggttccctggacatc

SEQ ID NO: 495781 - DNA, 440 bp, Homo sapiens
gtgccgtttagtttgactctcaacaaaacttgccacatctgcacagacgtgactctgggacgtgggtgtgcagatgtttcctcatggccgagttatccctgaacatctttgtgcagcctttatgagggcaagctattgtccttggagcatcatcttctttaattttccttgctttcatcctagcaaattctgccagttgtttgggatcctgagaggtccaatggccaggtattcctccaggaggaagtttctttcctgtccatatattctgaataatccggaggtgagttcctcctccaatgatctgttcttcaaccaactgtctcatgtcaatatctttttttcatctgaggaccacatgtgaccgagaactcgccctccaggtcttgatctgacctgcttctgctcccacttcttgttgcccgggtcgcgcccgccgc

SEQ ID NO: 495782 - DNA, 1348 bp, Homo sapiens
tcacgcttgaattcactttatttttctggtataaaaaccctatgttgtatcccacagcgggagcctgagtccgctgcccggaaactcgtgggtgtgggtcttgacgagggtggctcagatgaacctccgtgaatagggacaactgggatgaaatacagtctcctttccaaaaggctcgggggctcaggatagcgtgtaggctctataaaaagtggcatcaaagggtggccttgggacgaagtgtgtgcccagggtgtggcaggtgcagcccgcgggtgtgaggtgtgttaccagctacattcgaataccaggccattcattgtagcaggcttcatataggcccagggtgcggaaaacgagtgcacaagtgtgcccgcgggaggtgcaggggaatagaggcgatacccagcaacaagagccgacagggggcctgtggtcaccttgtggagaggggaaaggtggtgggtgcttgtgccagaaatcgtggggtcccaccaaaatagcgccctcgtgcgcgacacgggggggacagacggagaaacgcttgtgcgccacgggaagtgagtggcccccagagggatgtggcgggggtgcccaccatccttggggaggcccaacataaaacaacccaaagacccggaggttggggcacactgggatagagtcccccgagaattacgacaaacaaatatgcgccttatagaacccctgggggttgccagcttggagcccggcaagagggagatcatggaatctactggcaacgggggaacttaaaattcttccaaaaaacctcaatcctttgaagaggaagagccccccaaaaggaaaaacaacagactcaaaatgaggagccatcgtggatatcccactaaaattgtgggcgacgggcgacacaaagaaacaaaaagagaccccccaccacaggaggaaagtaggagaacactctacatgggtccttagaaccaagggggggcacacaaattaggagaaacgcggcactccaaagcgattaatcacatcagggatttgtggcccacgaaaaagccccgaggaggtccaccggggccagcaggcccccggaacagaggggcgaaaaaccccaggccctagtctcgtcagtggagaaaaatccaggggggaagcccacgggggagccccaccacggggggccaacagagtctcaggaggagcccagagtagagcagagggacaccgcaagaggggaaaaacgaaacaagcacgcaagattagcgacggcagaacaccaggagggcactgacaaacaggcgaaataaaaggaagtcggagagctcaccaacacacacgcagcacacccagagaaggg

SEQ ID NO: 495783 - DNA, 528 bp, Homo sapiens
cctgcaagttctgcacatgtatctcagaacttaaagtataataatttaaacaaagaaaaaatgtaaaaaaaagaaattaaaaagagttggagcatagaagaaagaaaagaaatgcaatttgaagggcagtatgtgcagtgtaacaaacctgcaagttctgcacatgtatctcagaacttaaagtataataatttaaaaaaagaaaaaatgtaaaaaaaagaaattaaaaagagttggagcatagaagaaagaaaagaaatgcaatttgaagggcagtatgtgcagtgtaacaaacctgcaagttctgcacatgtatctcagaacttaaagtataataatttaaaaaaagaaaaaatgtaaaaaaaagaaattaaaaagagttggagcatagaagaaagaaaagaaatgcaatttgaagggcagtttgttacactgcacatactgcacatgtatctcagaacttaaagtataataatttaaaaaaagaaaaaatgtaaaaaaaagaaattaaaaagagttggagcatag

SEQ ID NO: 495784 - DNA, 146 bp, Homo sapiens
ggggggccccccccccggggggccggggggggggggcccccctttttttttccccttaaaagggggggggggggttttttttttgtttttaccccccccccccccccccccccccccccatttttcctttttttttgggggggaga

SEQ ID NO: 495785 - DNA, 330 bp, Homo sapiens
tggtatccatctatagttgcaagttgtgtgacaatgagatactaggctagagatcgacgtttcagatgatcatgactgtgcccagagggcacttgacatttaaattgtcttaaagttttggaagtacatcttctggccccttgagtactgccagaggcaaaagatgttggtttcttattcattccactttggtctcctgggatcccttctgtagcctaaagtatggctgggaaatggacttgagaagatgggcttgacttagatcataatcatgtgtgatcccatcatgaattcatgggaattggtgtggcatgtaaggcaatcaagctg

SEQ ID NO: 495786 - DNA, 208 bp, Homo sapiens
ccgggatggtgccatgtgcctccagcctgggcgagagagcaagactctgtctcaacaacgataacgagaacaacaaaataaagaacaaaaccagacatggctgggcaggtggctcaggccggtgacctcagtacttggggaggcaggggtgggcggatcacttgagtccaggagtgcaagaccagccgggccaacatggtgagacccg

SEQ ID NO: 495787 - DNA, 675 bp, Homo sapiens
tctggctaccgtgactaaaagggaagcgtttggggggtcgcggcccggacttgggggggggggtccggccccaggacagtttaaccgctattccgtccactcccgaatctccttcagtggactccgggcgttcgtgcacttatacagaaggtctccaattcacggcggacccagaaaccccagtgggtgaccgggaccctcagtcctcggcgtaaagtccgagggcggaggtggatgatgtgccgaaaacattgcggggactcctagcggcctccgtgggctcgttctccgaaacattcttcctcggcaatatagtggcgagtctcaaacaaacgagtaccagtggcgtggggtgccctctggggcagacataccgccgtgatttcccagttatttgaagcaagtttcctcggaccagatgtgggtgatgtgagtgaggagctctcgggagagagggacacagctaatagctccatagaagcatatcacatcacagggcgtgaccggggccagtgtacagccggcgctcgaagatgaccccttgggtggaacaccagtggtcatcggaggctatgctgatggaagagagcttcctcggtttatgtggaactgctgtggtgtagcctatgatgccccttcgctgggccacgggtttttggggcatacttgggctca

SEQ ID NO: 495788 - DNA, 462 bp, Homo sapiens
aaggtaatcaccgcgagtctctatagtatactgttctagtaagtgagagtgggtgctttgctgcctgaggatctgtagttcagtgagaacgaaggagacaagaaacgggtaggaaatgtatcccctcattgtcttggttcattcgggtcatgatggttctttttcattacaacaaatattaattggttgcttcctgtaatgccaggctccgtaacagaggctatgggttatagtcagtgaataaagccaaggcctctgtcttggaggcacttacattttggtggggcatgtgaatccatctaagctaccttgaagggcagggacggtagtcccctgctacaacagtgtagtacatcagggaccaacctggccttggatagagaaacttgctcagtacattgtggcagtaactagtgcttcagccatttcaggagtgctgctgggtgagcagaatgcatggag

SEQ ID NO: 495789 - DNA, 1191 bp, Homo sapiens
tggaaaatgcgcccttcagctggtttctagccaccgaaaggttttgttgggtcgaaaagtccccacggggggctactcatagccccaacgaggcgccttcacaaagtggtgttgattacaaaaaccgtatgatgtgaacttaggggggggccttttttgcactcacggctgcgctgtgaagaatggtttcaccgacacaaggtgcctaaattttgtcctcgcgtcccacacacaggggggggccacctctctcaacgggggtaaagggggttaatgcaccgtgacaacttgtgtaacatgtcttctagtcgaaaaagaggcctctatttgtttggtgaaccccgcgcgtagggggaccccaaaagctaataagttttctcccgcatctttgttgtgaaaagcatctgccacgcggggtgtgttttgacaacacgctttgggttgaaaaatagggggagtatcactaataattaaaccggtccgcggctaaatacactgcgccctttaagcgggtttgtttgtcgagaggacacaagagcagtgctggttgtgagaagtttttctgatatataaacactctgtagagagatgcactacaggtgttagacttaaatagggggtggtttcacacagggtggtttttatacaagccggggggcgcctctttccaagagacccacacattgttcgccaaacccgtttttctcccttctcctttgtgtaccacgcggggaacacacgaaatcgttgttgtacaaaatggtgattacaagacacggggtactctttgacccttactgggctccgtcggagtacatgctgtccacatatattggggaggtcacccacaccacgaataaatgtgaaaaggagagaaggaggctgagatttgggggatctgaatcaccccagggtctcacaaccacgtggcgagcaatcaaaggtgtgctattggagctcttctctgctgggggaaaaatctgtgcgggaaaatctaatgagcgatattttttaggagagattttggcgaccagaggtctcatattccagggcgccacctgtaaagccttaacgtggggatggggagcccccaccccacactagagagaatcctcttttaactgggggtgtttcttaaaatccaccccttttttaacgggccttttttaaagcaaattctcagaagttata

SEQ ID NO: 495790 - DNA, 248 bp, Homo sapiens
ctgcgccatggtcatgtatgctgatgtgacaacggcgacattattctccctagcaatggccggatgccagtttagtggcatgatgttggcgacgctcctccactgggggggcccctggctgggcggcacgagccgcctggccgagccatgccccccccctctcgcgcgctgctccgactgccggcgcactcagctaagagcatcgagggggcggctgctggctggggggcgggccgtggctcgggggt

SEQ ID NO: 495791 - DNA, 332 bp, Homo sapiens
  misc_feature (17)..(17): n is a, c, g, or t
  misc_feature (234)..(234): n is a, c, g, or t
  misc_feature (237)..(237): n is a, c, g, or t
  misc_feature (242)..(242): n is a, c, g, or t
  misc_feature (321)..(321): n is a, c, g, or t
  misc_feature (325)..(325): n is a, c, g, or t
cactggcattatcgagncctggaagctatggccagaatccaccaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagntcngcgtntgaagccctgtccctggataatgcagtatttcaagactgcctttatgctggatcatgtgctactggtataaagttctgntaanctacctt

SEQ ID NO: 495792 - DNA, 473 bp, Homo sapiens
gcagtatggctaagatgatccagaccgcctcaacctcccacagtgttgggattacaggcatgagccacatgcctggaccaccatacagatctttaagagtgatttatcatacacctgaggatagatgaggggaaactgccaattcatggaacaatgctttcctctttttattcacaataccataatgacttcttacttgatttcatctcatctcagatgtgtgcggttcagggagacagggagtgagaagaggatggtgggtggtaaaggcggtgaacacagcagctggtctgtatgcaagggtataccagggatctggttccaccttcgtttcccgtccatatttcctctataacctcgggtgcagggtgtcagccacactggccttcttgcagacccaggacacagcaaccgttgctcctgcctcacggccttctgctcccaaacgccttcacaaattgcgaccaggcata

SEQ ID NO: 495793 - DNA, 675 bp, Homo sapiens
  misc_feature (14)..(14): n is a, c, g, or t
  misc_feature (137)..(137): n is a, c, g, or t
  misc_feature (145)..(145): n is a, c, g, or t
  misc_feature (157)..(157): n is a, c, g, or t
  misc_feature (165)..(165): n is a, c, g, or t
  misc_feature (174)..(174): n is a, c, g, or t
  misc_feature (186)..(186): n is a, c, g, or t
  misc_feature (189)..(191): n is a, c, g, or t
  misc_feature (214)..(214): n is a, c, g, or t
  misc_feature (217)..(218): n is a, c, g, or t
  misc_feature (231)..(231): n is a, c, g, or t
  misc_feature (244)..(244): n is a, c, g, or t
  misc_feature (255)..(255): n is a, c, g, or t
  misc_feature (268)..(269): n is a, c, g, or t
  misc_feature (271)..(272): n is a, c, g, or t
  misc_feature (274)..(274): n is a, c, g, or t
  misc_feature (294)..(294): n is a, c, g, or t
  misc_feature (296)..(296): n is a, c, g, or t
  misc_feature (308)..(308): n is a, c, g, or t
  misc_feature (314)..(314): n is a, c, g, or t
  misc_feature (323)..(323): n is a, c, g, or t
  misc_feature (325)..(325): n is a, c, g, or t
  misc_feature (332)..(332): n is a, c, g, or t
  misc_feature (337)..(337): n is a, c, g, or t
  misc_feature (344)..(344): n is a, c, g, or t
  misc_feature (349)..(350): n is a, c, g, or t
  misc_feature (353)..(353): n is a, c, g, or t
  misc_feature (356)..(356): n is a, c, g, or t
  misc_feature (365)..(365): n is a, c, g, or t
  misc_feature (369)..(369): n is a, c, g, or t
  misc_feature (371)..(371): n is a, c, g, or t
  misc_feature (380)..(381): n is a, c, g, or t
  misc_feature (398)..(399): n is a, c, g, or t
  misc_feature (406)..(406): n is a, c, g, or t
  misc_feature (415)..(415): n is a, c, g, or t
  misc_feature (417)..(417): n is a, c, g, or t
  misc_feature (430)..(430): n is a, c, g, or t
  misc_feature (433)..(433): n is a, c, g, or t
  misc_feature (435)..(435): n is a, c, g, or t
  misc_feature (441)..(441): n is a, c, g, or t
  misc_feature (447)..(448): n is a, c, g, or t
  misc_feature (467)..(467): n is a, c, g, or t
  misc_feature (479)..(479): n is a, c, g, or t
  misc_feature (565)..(565): n is a, c, g, or t
  misc_feature (572)..(572): n is a, c, g, or t
  misc_feature (586)..(587): n is a, c, g, or t
  misc_feature (672)..(672): n is a, c, g, or t
cataaccacacagnatagacaatgaaagcataattagtcattatacacaattataatttgataaaaaatttcaacatatacagaagtataaagaatgtgtatctatcatgcagcttctacaattatcattccaactnctcgaatnaataaaattgcnagcaattnaaaccctgncccaattccaantannnccccccgtccccgcccttcctcnccnncccccttcccccntcccccctgcctnccccccccccncctcccccccgcnntnngngggggggggcggggtctctntntgtggcccgggntggggngtgttggtntnttttttnttctntgcttcntttgnntcnttngttcttgcntttntnctggtttgnnttcccgggtggctgggnnttcgggntctctcctntnctcttggtccgtnttntntttttnttttgnngttttttcttgtttttttngttggtctcatncttctgatctcaggtgatccgcccaccttggcctcacaaagtgctgggtttttaggcataagctagattgccaagctttgttttanaatttantctttatgctctgnntggaaaggctataaatggagttcaatgaaaggaaaaaacatttaaaaaatagaagttctttctttcttctttttaagatggagtnttg

SEQ ID NO: 495794 - DNA, 751 bp, Homo sapiens
actcacaaccaggcccctgacctcacatgccctgtttggttcatttgtttttttcttcacttgcttatgccccctctgaattgccagtgctaccatttttcagtaaacaaccagagcagaaagtcgagctctgaaccgatactatctcccagacagaggaatgtattcgagttcatacttcgaggaagtaattctctgggaacatgcagtagtgcaggtgatgctatcgaaactggtgaaacctaaaactcctactcactacctgcctgagagggcaggaaatggggccgaggccctttccctacatgctccccctgcccgttttggtctctcgcagtcattactaaacttagcaccgtaatcaaatgaaagctgtttcccagctgtatggccttgggtaagtccctgatctccttggttctgttaccaatacacactcatgcacacatgcacgtattgtgggtacccattcaccacattcacacacattccagagacatctccttcattttcacctcataccgagatgagtctctagagaacagctgctgtcttacttatcctgcaaaacaccagagctacctcctaggcattcagaaagtgtctccagacccagcatctgaagctctgacttgaattcctccacgtcccattgggctcctgggtccatcccatttctcctgcccatccttcacgtaggccctcttctccaaccatttgccgttgcctacattaggcctgtggcactcca

SEQ ID NO: 495795 - DNA, 210 bp, Homo sapiens
  misc_feature (7)..(7): n is a, c, g, or t
gcggtantcgcgacttcgatggtcaacaccggcccatgccgcacgtccagcggccgtatgccgccggagcgccagcgaaaccgcaagcgacagtcgcgataatcccgcatggtgtcgtagcgcagaagcggggtggtcatggaacatcctgcgatgcccaagatcaacccggtcagatcaccctgcccataaaagacgcatgtcccccgc

SEQ ID NO: 495796 - DNA, 152 bp, Homo sapiens
acagagtgtgagtgaacatgacccctgcaatgtgcactgctgaatgtgatgaaaccaccccagtgtgaaactggtcccccaccatgctgtgcctgtctcgcctgtgcactgaaaaggccagtcctgtctcagctgtatactccacctggatg

SEQ ID NO: 495797 - DNA, 92 bp, Homo sapiens
ctgaaattcgtctttgatgcggtcgcaggagtccgaggtggtgaatttgagttgctggggaaggtgcgaggagcccgaatgcctgctttgtg

SEQ ID NO: 495798 - DNA, 124 bp, Homo sapiens
gaggcaggagaagcagtcaaaagccagattatacaggggtcatgaagaataataaaaatttggaaagtgttgtaacaatcagatccgggtctcttagagaatcaccagtctggagtagggggaa

SEQ ID NO: 495799 - DNA, 278 bp, Homo sapiens
atgggggtgcacaccttcagtcccagttactcaggaggctgaggtgggagaatctcttgagcccaggagtttgagattacagtaagctctgattgcacaaccacactccaacctgggtgacagagctagatgctgtctcaggaaaggaaaaaaaaaaaaaggccggagggatggcttaaaaggccccaaaggggggggaaagacataattccaaaatttaaccgttaagcctaaaccgggatattgaaaaaacccagcccccttcgcatggcaattgg

SEQ ID NO: 495800 - DNA, 135 bp, Homo sapiens
tggcacccagaggaaggcccgtacctgttggtctctgtgcttcaagaggccagtggatggggaccgagacaaacaggccagtggtgacgcagtgctgacaccctggcagcactggacactgagagcacacaacct

SEQ ID NO: 495801 - DNA, 145 bp, Homo sapiens
gatctacgtcatgattgtcgctgggcacagggcggcgctggtgcccacggcagctgcaccttctccaccagcccggccactggcgctgcatgtctcccaccactgcctcgtagccccaccactgcctcatgccccaccactgcct

SEQ ID NO: 495802 - DNA, 101 bp, Homo sapiens
caaggatcaaaagacccagctgagggcgatggggcccagcctgaggaaacaaccagggatggcgacaagccagaggagactcaggggaaggcagagaaaga

SEQ ID NO: 495803 - DNA, 395 bp, Homo sapiens
tcataggtcgcaggtggtgttatgcctgcagatgcaccgaagaattaacgttcatgaacctccgcctagatttcagaagatgtatgaaaatgcctggaaatccaggcaaaagtttgctgtgcacgggagcggggggccctcatggataacctctgctagggcagtgtcacagggaaatatggggttggagcccccacacagagtccccactggggtactgccaagcagagctgtcacaaaggggccaccatcctccagaccccggaatggtagatccactgacagcttgcactgtgtgcctggaaaagctgcagacactcaatgcagccagaagggggggccgtaccctgcaaagccacaggggcggggctgcccaagaccctgcgaacctatga

SEQ ID NO: 495804 - DNA, 921 bp, Homo sapiens
  misc_feature (6)..(6): n is a, c, g, or t
  misc_feature (11)..(11): n is a, c, g, or t
  misc_feature (13)..(13): n is a, c, g, or t
  misc_feature (19)..(19): n is a, c, g, or t
  misc_feature (245)..(245): n is a, c, g, or t
  misc_feature (365)..(365): n is a, c, g, or t
  misc_feature (377)..(377): n is a, c, g, or t
  misc_feature (380)..(380): n is a, c, g, or t
  misc_feature (383)..(383): n is a, c, g, or t
  misc_feature (390)..(390): n is a, c, g, or t
  misc_feature (392)..(393): n is a, c, g, or t
  misc_feature (415)..(415): n is a, c, g, or t
  misc_feature (422)..(422): n is a, c, g, or t
  misc_feature (441)..(441): n is a, c, g, or t
  misc_feature (514)..(514): n is a, c, g, or t
  misc_feature (522)..(522): n is a, c, g, or t
  misc_feature (553)..(553): n is a, c, g, or t
  misc_feature (585)..(585): n is a, c, g, or t
  misc_feature (599)..(599): n is a, c, g, or t
  misc_feature (601)..(601): n is a, c, g, or t
  misc_feature (650)..(650): n is a, c, g, or t
  misc_feature (678)..(678): n is a, c, g, or t
  misc_feature (685)..(685): n is a, c, g, or t
  misc_feature (717)..(717): n is a, c, g, or t
  misc_feature (735)..(735): n is a, c, g, or t
  misc_feature (755)..(755): n is a, c, g, or t
  misc_feature (761)..(761): n is a, c, g, or t
  misc_feature (781)..(781): n is a, c, g, or t
  misc_feature (798)..(798): n is a, c, g, or t
  misc_feature (812)..(812): n is a, c, g, or t
  misc_feature (820)..(820): n is a, c, g, or t
  misc_feature (920)..(920): n is a, c, g, or t
tcctcnatttntnggggtnggggactgaagtttttagccagcatggacctaacctactttttgggataaaattctctgttttgttacaggcaaaattctgcgtatggcgtgcaatgccatgggtcattctgaatatatttttttctgtaattttatcattacacgatgtttgcaatacgtgctttgttttttaatttgaaagcaaactttttccattgttgaacagcagcattttttggaacaancttggacccttgcctgagtgattgagttctaagttgaggactgcatcttctcgttttttacagtatagcagcaacaaaattgcacattatgtgtgtggaaaaatgacatatcacattggnaattgcgtgtcnttnggngtgcaananngtggatacaagaaattgagttntcaattnaatttcctaacatgggttngaagaatcaactcgatgcaaacgaaaagttggggggggaaaaaaaaaacaaaaccgtttaaaaaaccctcaantccctcangtatggaaaggtaagattaacaattaaggtngaaattaataaggtaaatctaattgtattgtngctaaatggggggntngcgaaaagaacctttacaagaagcatatttaccctggataaaactgggntgttggtgttttggggagaacaaaactnaataagngatttatttgtgtctcctgagtttggtacctnggggagcaatttgacatngccccctttcaagaaccttnaactgnttagtaagcagtgggctgtnacaacacaaaaccagtngaccaagagataanagcttttnaggccaagctggcctgacggtatggctgcaggaagtgactgagcagtagcggtactcagccagaccaagacggagagggaagagtccacagctttctggna

SEQ ID NO: 495805 - DNA, 173 bp, Homo sapiens
agcagtgggctggcctgtcatgcatcccctgctctatcctggcactgcaggctccctcggtgtgtcttgagaccagctgcagcacctccagcagaggcagagtgcctggggatccactttcctgccccagtgacgtgtgctgtcggcctagtcggggggtaccggagctcgaa

SEQ ID NO: 495806 - DNA, 763 bp, Homo sapiens
tggtaaagcgctgatcctgttaatttgggcacggaaaacgagacaatccatgcagcccaggagggacatggggtgacttaatcctcctacctcgtcagtctccagccccagccccaccctgggcccttctgtggcattcttcctcttcactgcgagccctgggcaggccacccccgtagtggagatgctgcaagagagaatgtcagactgtagcttctgggagaatcacagtgctggacacatgaatgtgactggtgatgttcaccaccatgctatgctggcaccactgatgatgtgcacgcttggcagtgatcagacacgacgagctgtggatggatgtgacttgtgccaagcccagcttgaagacctgggtctcgcagagctgtctctctaagaaaatcctactatctatcagagcccaggatgtaatccagcttcatcttgccctcatccagcaccccaatgcgtgaccagtcctgccgacagaagggacgttgccttctgaacagagcgccgtgggtcctatctacatacaagcgatcagaagatcccggagcggaccttgcgaatcttggcccagggtaaaatttgaccctcacagaccatcactgttggttccgggagccccataatcagccagatacagttcagatttgggtcacaaagaaattctcgaaagagtccccgggggtcacaataagttggcgaaaacccagctccggcctggctgtgatccgatctaaccgccgaatgtgtcaaacag

SEQ ID NO: 495807 - DNA, 440 bp, Homo sapiens
  misc_feature (24)..(24): n is a, c, g, or t
  misc_feature (99)..(100): n is a, c, g, or t
  misc_feature (103)..(103): n is a, c, g, or t
  misc_feature (109)..(109): n is a, c, g, or t
  misc_feature (113)..(113): n is a, c, g, or t
  misc_feature (116)..(116): n is a, c, g, or t
  misc_feature (130)..(130): n is a, c, g, or t
  misc_feature (138)..(138): n is a, c, g, or t
  misc_feature (153)..(153): n is a, c, g, or t
  misc_feature (192)..(192): n is a, c, g, or t
  misc_feature (195)..(195): n is a, c, g, or t
  misc_feature (226)..(226): n is a, c, g, or t
tttacattacaaagaagaaaatcntccaaatgggacggatatgagtatggtttatggttacacacacacacacacacacacacacacacacacacacanntgnggttgngccnagngggggggggggggngggggagngcttaccagcaacgngtactgagagggtaaccttttccaagatgagtaaaaggnggngggtggggtggggagtgctgtttactttgcngaaacaaggtcagagatgacacatcatgaataatcaaaagaaaattattctatcaaagctcagtatctagctgatacataacacttatttgagcacacatataatcactgacttattaaacactattactcattttctaagtgtaatcgtccatttcattctcagaaataatagtataattgaaaaagaaatgatataatctcaagcaagtgga

SEQ ID NO: 495808 - DNA, 554 bp, Homo sapiens
  misc_feature (48)..(48): n is a, c, g, or t
  misc_feature (270)..(270): n is a, c, g, or t
  misc_feature (277)..(279): n is a, c, g, or t
agcaccgtctacatcatggccatggccatgcagatggccacttcgccnatcaattacaaaggcccgcccttcatggagagcctgcccgagaacaagcccctggtgtggagtctggcactttcactcctggccatcattggcctgctcctctggcctctagccagacttcaacagccagtttggcctcgtggacatccctgtggagttcaagctggtcattgccaggtcctgctcctggacttctgcctggcgctcctggccgaacccccnccggggnnnccgggtccctgaccaggttcttcctggggaccccgaagctgaaagtgccttcctgagatggcagtgctggtacccactgcccaccctggctgccgctgggcgggaaccccaacagggccccgggagggaaccctgcccccaaccccccacagcaaggctgtacagtctcgcccttggaagactgagctgggacccccacagccatccgctggcttggccagcagaaccagccccaagccagcacctttggtaaataaagcagcatctgagatttt

SEQ ID NO: 495809 - DNA, 221 bp, Homo sapiens
  misc_feature (36)..(36): n is a, c, g, or t
tgttgggcctaaagccccctcctgggggtttcctgntgtttaggtccttttgggccccccccccatccaggccctttttttgcaccttttttcccccccctttaggctttttcccccccctgcggtgttcggcctaaaggtggtgggggtgagggggggtttggcccttagcctttcatgtttttccccaaatgaaaatgccctgcaaagggcggtaccca

SEQ ID NO: 495810 - DNA, 1331 bp, Homo sapiens
  misc_feature (845)..(845): n is a, c, g, or t
  misc_feature (1021)..(1021): n is a, c, g, or t
  misc_feature (1072)..(1072): n is a, c, g, or t
tggaaacggagtttggttctggttgcccaggctggcagtggcaatgggcacaatcttggagctcactggcaacctctggcctcacaggttcaatgtgggttctcctggcctacagcctcttgagtacgctggggattacaggcttgcgccaccatggcccgggtaatttcggtattttttatgtacagaagacggagacgttggcaccattgttggcgccaggctgggtcttggaattcctggacctcaggtggatccacctggctatcggcctcccaaatgtgctaggatttaacaggtgttgtagaggcacacacacgctctgggctaatttgtggttatttataagagtaagaagatggggtgttttctcacaaaggggctggggtctgtggaatctcccagacctacaggtggatccggccacactcttgggcctcccccagaatgtggctgggagattcacaggcgcgtgtagacgccactcggtggccccgggcctgagatggtatttgctggaatggattatggaaaatatgggggttaaaccagcgctattaaaacacctttaagaactgtggagtttcaaaaatgtatttatttaagacttcccgttgttataagacctcaaagatatataagtgctttagagatagtatacatgtggtaagaccaccttatatataagacacattttttcattgcaaagggttgggggatcctttggaggaattaaaggaattgtgcacaatttgtgaacacaaggtgcggtaacgacattttcgactcagcgaagagactacatcatttaccccccagagagtaaaagcaatcatcttgggccngtcggtgtctaccactgggaacttccttaaaaggggggtcgtttacctcacgggatagccctacaatttttggggcttattcacctttaaacattcacattctattcgaaataattctctttaacaacggctggtgttttgagaccccccaatggtatattgcatcctgattgggngatttaaaacagcccttttgaacaaggatgtcccgccaggagaaatttaancgctataggccgagaccgtcagcaagttttccagagcacaaagccccaaaaacaccaagggagacaatcaaagagcatcgtatggatggtgccccacatatcgagattttctccccggatatctcagtcagtgtaaaccctcagtcaagtacagataatggtctctgacttctgtgggtcgcacacaccaacaagtgtggatggacacagcctcgccacacaacgaatatcccacacattcatggcatcagtcgagcaa

SEQ ID NO: 495811 - DNA, 389 bp, Homo sapiens
atgaaagagcaggagcggcgtggcaccctcctggaggagctgaccctgtgtaggcctggagcgcccacttgcagccgcgccatactttctcctccttatccagtacaaaggccagtcatgtggcccacacctttgcctgcagtgtgaaggcccagaacacacagggcccgaactgtctgcccactgctcctgcctcctggctagcaagatagggccagaaagaccagatcatatcccatataagccccttcaaggaggccgtgattgatcacggggcccatgcccagatcgtccctcttggatccctctctagtcgaggctcccaattcctccactaggaagtggcacgccttgtgcctgggggtgagatgctcaacagacgctccatt

SEQ ID NO: 495812 - DNA, 771 bp, Homo sapiens
agcgaggggtgggggtggagaaaatgagcgatggttaatgggtacaaaaatatagttagatagaattaataaaatctaatatttgataggacaatggagtgactacaatttattatacatttaaaaataactaaaagagtataactggattgtttgaaacatgaagaaagcatcagtgcttgagctgacggatactccatttaccctgacatgattgttacacattgtatgtctctatcaaaatatcttatgtaccccattaatatatacatctaataggtacccataaaaataaaaaataggctgggcacagtggctcgcgcctgtaatcctagcactctgggaggccaaggtgggcagatgacctgaggtcaggacttcaagaccagcctggcaacatggtgaaacgccatctccaccaaaaatacaagttagccgggcatagtggcacatgcctgcaatcccagctactcgggaagctgaggcaggagaatcacttgaatctggggggtggaggttgcagtgagccgagatcgcgccgtgcgctcagctgggcgacagagcgaggctccatctcaaaaaatactcatacactcatgtttatcctgttattaaatagcatattcatgagcctaggcacagggctccgctgtatcggagccttgggaaccgcgcggtaaatcctgaggcagaatcgaaccatggcacatggaaacctctatgaaatacacttgtggttgtggcgacttaccacgtacgagcgggcaaacc

SEQ ID NO: 495813 - DNA, 257 bp, Homo sapiens
attccaattgtcatagaatcatcgatattctgatagtgccttacagcagatttatcgttaatgagaaaattgaaccataactatattgctcaccctaaaaccttacaccgaaccttacaaagtaaaagactaagtgttggtcagacggaaaaggatacaaccatgcatcttccacagggaaaatgaagattgcaagaacgcagaaatgctgaactcatgggtacaaacacacttttctttataagaccgggtaccga

SEQ ID NO: 495814 - DNA, 255 bp, Homo sapiens
tttttttttaaaaaaattagattttagcgggggcttttgactaatgtaaagtaaaagcccaacccccccccttgatagggaggtttttgtaagttaattttttaaaactttttcccaccccaagggaggctttgctttgggttttaactgtttggccccggcgggggggggggcggggggttggtccaaaaacttgaagcggtttgggaaagggcccacccaaaggtttttccttaaaaaacaaaattaccccga

SEQ ID NO: 495815 - DNA, 270 bp, Homo sapiens
  misc_feature (30)..(30): n is a, c, g, or t
agtggtgtgatctcagctcattgcaacctntgcctcccggactcaagcaatcctcccacctcagcctccagagtagctgagactacagaaaaggaagagataccatggagatgtgcccccagaggaaaggccacgcaaggacccagcaagaaggcaactgtttacaagccaagggaagaggcctcaggagaaccaaacgtgtccaccccttgatcttgcacttcccaacctccagaactgtgagcaaataaatgatgttgtttaatccca

SEQ ID NO: 495816 - DNA, 1032 bp, Homo sapiens
  misc_feature (398)..(398): n is a, c, g, or t
  misc_feature (433)..(433): n is a, c, g, or t
  misc_feature (466)..(466): n is a, c, g, or t
  misc_feature (477)..(477): n is a, c, g, or t
  misc_feature (492)..(492): n is a, c, g, or t
  misc_feature (575)..(575): n is a, c, g, or t
  misc_feature (583)..(583): n is a, c, g, or t
  misc_feature (600)..(601): n is a, c, g, or t
  misc_feature (611)..(611): n is a, c, g, or t
  misc_feature (621)..(621): n is a, c, g, or t
  misc_feature (630)..(630): n is a, c, g, or t
  misc_feature (633)..(633): n is a, c, g, or t
  misc_feature (641)..(642): n is a, c, g, or t
  misc_feature (644)..(644): n is a, c, g, or t
  misc_feature (646)..(646): n is a, c, g, or t
  misc_feature (649)..(650): n is a, c, g, or t
  misc_feature (666)..(668): n is a, c, g, or t
  misc_feature (696)..(697): n is a, c, g, or t
  misc_feature (714)..(714): n is a, c, g, or t
  misc_feature (727)..(727): n is a, c, g, or t
  misc_feature (865)..(865): n is a, c, g, or t
  misc_feature (885)..(885): n is a, c, g, or t
  misc_feature (888)..(888): n is a, c, g, or t
  misc_feature (890)..(892): n is a, c, g, or t
  misc_feature (899)..(899): n is a, c, g, or t
  misc_feature (903)..(903): n is a, c, g, or t
  misc_feature (909)..(909): n is a, c, g, or t
  misc_feature (913)..(913): n is a, c, g, or t
  misc_feature (918)..(918): n is a, c, g, or t
  misc_feature (928)..(928): n is a, c, g, or t
cgatcccacgttgccatttgtgtgtccgggcgcaatatgcacaaactatggcttacaacatcacacccctgcgcagggccacagtggaatgtgtgaaagatcagtttggcttcattaactatgaagtaggagatagcaagaagctcttttgccatgtgaaagaagttcaggatggcattgagctacaggcaggagatgaggtggagttctcagtgattcttaatcagcgcactggcaagtgcagcgcctgtaatgtttggcgagtctgtgagggcccccaaggctgtgcagctcctcgacctgatcggtggtcaatcgcttgaagaatatcactctggatgatgccagtgctcctcgcctaatggttcttcgtcagccaaggggaccagataactcantggggttggtgcagaaagaaagatccgtcaagctnggtgtcattgactaaccacatccacaaagcagnaccattaatcnactatgagtcaagtnggggggaatctggtgaagggttctgaatatctccctcttcatccctcccgaaatctggaatacttattctatgagctattacnccagtttnaacaccttcctcgtgtnntgtttaaaanaaataaatanatttaaganaancattttanntnangcnncagttgcagcctggannnaacttaaggtggcgccttatagtatcannttttaggagctttattntggtgcatttaangcaactggtaattgcgagaaatccactttgccgtgtgtaagtgacaacaatatgggactgttatcttgtgggcctatggaaattctgcgctttccagttatatactctaccttcattaattacttctggcgggatgtnctgccttagcgctcagttgnatncnnntcccttntctncctgtncatnatgcnttaattctgngaccatatgagggggtagaaatatatcatcttctgtagaaattcgcacacattgtttaggccaccctttccttacagcgaggccaacttccacactgtcttctc

SEQ ID NO: 495817 - DNA, 157 bp, Homo sapiens
gtacagccgtgcagcgctgcgggaagttctcaggacggcttcccccgacatggagggatttccgaagcctcgaagcttccatgacactgccggcagtagcccccacgctggcccagcctcagacccaccagcacttccagacaccaggaagccacag

SEQ ID NO: 495818 - DNA, 102 bp, Homo sapiens
accgaaaccactgtagttcctttttattctaccataataattatatacataataatctatattatggttgaaatctttatctcagagtaactaaagccacaa

SEQ ID NO: 495819 - DNA, 536 bp, Homo sapiens
  misc_feature (283)..(283): n is a, c, g, or t
  misc_feature (352)..(352): n is a, c, g, or t
tctggtgttttaggaaagacccacagaaacaaggcgagatggggactggaagggtggatggcattgggggatttgtcttctaggaatgagccacagggattagggggagataggaaggactgatggggcaggaagatagtatgttccaggtatgatccacaggttcagaggggagaaaagtatagtggatggtgtttgccatggatgaaccaccaggatggtgggggagacagaaaaggttgatggtgtggtgggatggtatcttttatgaatgacccaaagnggcaaagggaaggcaggaaagatggatgttgcggggatatcatccaccaacaacccagaggtgtagtgnggagacaggaggtgtagatggtattaccaggatatgtcttccagaaatgagccacaaaggcagggataagataggaagagtgaatggtgtggcctggttgcatcttccaggaatgcccccacagtgttagggagtggggaacaagaatggatccctgtgggggtatggtatcttctaggaatag

SEQ ID NO: 495820 - DNA, 354 bp, Homo sapiens
gatcccacatgtcgcctgtattctaagtgcgagagcgagagagcggatcggataacaatgtacagaactagcctgcagaggctatggagaagtgcatgcaagccagatgaatacagtgaatgcattcgatgattccgaggacattcttcaacgatcggctcagcatgtgcagacgatcattgcgtgactatctgatgtgattgtgttagccatgacctccctttacaagtaggctttgcatcatagagattgttagtaccggtcataatgtgctgtatgtggacttactaacagggaagaacgtgacatggacaactgagctagcgatgctgatgatccactctctgagatgtg

SEQ ID NO: 495821 - DNA, 862 bp, Homo sapiens
cctcacctgtggtggtttatgggtgtgatggggtttttaagattattataaccagtaaaaataagaaaacctcgaaaaaaaaaaaaaaaaaaaaaaaaaaaaaaaacaaaaataaaaaaaaaaaaaaaaaaaaaaaaacaaaaaaaaaaaaaaaaaaatacacaaaatcatcaacataatcagcaccctgcaaaaagatacatcatagaagaacatacactaatgataaaacactcagcacatccagcgaccgccccacacacctcaactaacctatcacccactcaactcacaccacaccaattacacccacaccagatccaaccgctccctctcacatagttcttccccactcacaaccacacatcatgggagcatgcacgcgccggaacccgcgggaacatcacgccaacaaccgcggagccacaccatcaggctgagaggcggacgagccggccggaaagataccggggtagggtagagagaggtgcggtgctgtgagctcggacgagagaaggcacggagtaggggaaggagggaagggagggaggtaggtgaagcgtcgccgacggcgcgcggacgaaagagcagggacgcgagagagattgcccacattaatatagagaagcgccgtcgtcacctgctacacacaatcaatcggtaataccccatcaaataatcgctcaggtgtatttattttgctccacaactgcatcatcagacacacgatcctacccacctattcaccaagagaagtcatgcaaaacagacgtcccacgtcactgatgtactacaacccactacctgtacatgaaaccacacaacacaccaacttcacgctgccctccacatacctacaaaa

SEQ ID NO: 495822 - DNA, 196 bp, Homo sapiens
ctacgataaaattacacaacaggatacaaattcaccaaacacacagtgatgctgagggtaataaccactatggggaacacatcccgtaaacctgcctgttgccatgccaatgaagtgcctcgacctggtgactatctgtttgagcatgctttgtgtggatggtcaaatgccaccgatagtgcatacacttagtaca

SEQ ID NO: 495823 - DNA, 357 bp, Homo sapiens
  misc_feature (24)..(24): n is a, c, g, or t
  misc_feature (79)..(79): n is a, c, g, or t
  misc_feature (96)..(96): n is a, c, g, or t
ggctacctgggaggctgatgtggnaggattgtctgggcctggagctggaggctgcagtgagctgtgattgcaccactgnactccagcctgggcaanagggcaagaccctgtctcaaaaaacaaaaacaaaacctgaagcttaccagaccccttacccaccatgatgcctaaccaaccccccgcttcctgttgaccagctcctcttcctcacccctccctaattcctgtttcccacacatggttacatttcttccctgctataaaaatccctaattttagtaggccagagacacagatttgagacttatgtcctgttccccttggctgtagcacccaaataaactttcttccttggct

SEQ ID NO: 495824 - DNA, 381 bp, Homo sapiens
  misc_feature (304)..(304): n is a, c, g, or t
gcacgagaaaaaattagctgggcatggtgatgtgagcttgtggtcccagctgctcgggaggctgaggcaggagaactgcttgagcctgggaggcagaggttgcagtgatctttttttgcaccacagcactccaggctgggcgacagagcaaaattccatccgaaaaaaaaaatttggtgagaggggggagataagtgagtaaagaacttaaaaaagcccaaaaacaattatctgggcatggtggtgtgctgcctgtactcccagctactgaggagacagaagtgagaggattgcttgagcccanaagttcaaggctgcagagagctatgattacaccactgcattccagcctaggtgacagagtaacaccaccctgtctgt

SEQ ID NO: 495825 - DNA, 243 bp, Homo sapiens
tctagagtatccccgtcaacgctgaacgactgtgtgcctgtgtctatactagcagcattatttataatcctttgggtatgtatccagtatatgggatggctaggggtcaaaatggtatttctagattctagagtccctgatggaatcgccacactgtacttccacaatggcttgaaccacctttacagctcccaccaagcagtgctataacgctgttgcctattttcatctcacagtaggttc

SEQ ID NO: 495826 - DNA, 234 bp, Homo sapiens
agacgtggtagtagtgtcgagtctgtacatgtccgggtcgaagtacgcgtatcgatgggcagttgagggggcgcaatattgatcctaggcctataaatatcgggagtataggtaggcggtaaggtaaacaacgggtacctctagaactatagctagcatgcgaaattttaaggcgctgatatcggatcgcgcgcagatcttgtcatgctgatcatgtgcaatgtggttccatat

SEQ ID NO: 495827 - DNA, 209 bp, Homo sapiens
attgctcagttctgtattgtaccgtgtatcatcacctgttaacttttgtgcatcctgaaaagatccgtacagatcggatcttctccagagacgcctcgagatcctcctgactttcccctagagccttgcactgtgactatacctctgtcctgcacttactgtgctcggaagtaccgggcagtactaaagctcataggcgtccgtagcgg

SEQ ID NO: 495828 - DNA, 207 bp, Homo sapiens
  misc_feature (5)..(5): n is a, c, g, or t
  misc_feature (7)..(7): n is a, c, g, or t
  misc_feature (111)..(111): n is a, c, g, or t
tggtntncttttacggggaagcgcttgtgaatagcctattctctgtccttctacaggagaattgaatagatagaaaccgaccggatactccgtctgaactcagatcacgtnggactttaatcgttgaacaaacgaacctttaatagcggctgcaccatcgggatgtcctgatcccatcgaggtcgtccctattgttgataggactct

SEQ ID NO: 495829 - DNA, 540 bp, Homo sapiens
  misc_feature (1)..(1): n is a, c, g, or t
  misc_feature (41)..(41): n is a, c, g, or t
  misc_feature (344)..(344): n is a, c, g, or t
  misc_feature (467)..(467): n is a, c, g, or t
  misc_feature (493)..(493): n is a, c, g, or t
  misc_feature (522)..(522): n is a, c, g, or t
nccctccctgaggaggaaggcccatgtgtggccccctgganctacctgccccccgagactgattgacggggcgccactgcacccatgagaacggtggatctgtggtgccttggagctgcctttgcttaatgagcctcgtctggtgtggggaaccccacccctcttgaagagtcgcactcaccacccattcgcagacccctcatttcgccgcgcgcactttcgctcccaaggtggacctaaagttccccgcttttgtgcccacgggagcccaggacctcattctccaaactgtctcaggcataacccctcggaacggctgcccctggcccaggtctcagcccacnccttgggtccgggccaactctcggagggtgctgcctccctctgcccttcaatctgtcgcctgatggtccctgtcattcactcgggtgcgtgtgtttgtatgtctgtgtatgtataggggaaanaagggatccctaactgttcccttatntgttttttacctcctcctttgtttaatanaggctgaagctttttgta

SEQ ID NO: 495830 - DNA, 350 bp, Homo sapiens
ctcggccgctctcgtgagactggtgtgtaggccaggttgtatagggagagtgttggcgagcagagtgtccaggagaggttttccagagatagggcaggcatgtgcgggaacaaaggaaagacagtagtgatgacagtagtctgaaggcaaggatgctctgggcaaggggtcttatcccgtgtggtagcttttaccaagatggagatacgtgtaactcccatatgcttatccttaaaaatgagacacatggatactcctgtattgaaatgtggggtttatactgtctcctcatggcctgggtcgaatattgtaactgcttcaaccaataggatacagagtctcacggaaag

SEQ ID NO: 495831 - DNA, 935 bp, Homo sapiens
  misc_feature (43)..(43): n is a, c, g, or t
  misc_feature (63)..(63): n is a, c, g, or t
  misc_feature (70)..(70): n is a, c, g, or t
  misc_feature (134)..(134): n is a, c, g, or t
  misc_feature (279)..(279): n is a, c, g, or t
  misc_feature (294)..(295): n is a, c, g, or t
  misc_feature (298)..(298): n is a, c, g, or t
  misc_feature (306)..(306): n is a, c, g, or t
  misc_feature (314)..(314): n is a, c, g, or t
  misc_feature (329)..(329): n is a, c, g, or t
  misc_feature (340)..(341): n is a, c, g, or t
  misc_feature (344)..(344): n is a, c, g, or t
  misc_feature (368)..(368): n is a, c, g, or t
  misc_feature (388)..(388): n is a, c, g, or t
  misc_feature (401)..(401): n is a, c, g, or t
  misc_feature (404)..(404): n is a, c, g, or t
  misc_feature (438)..(438): n is a, c, g, or t
  misc_feature (448)..(448): n is a, c, g, or t
  misc_feature (454)..(454): n is a, c, g, or t
  misc_feature (457)..(457): n is a, c, g, or t
  misc_feature (484)..(484): n is a, c, g, or t
  misc_feature (493)..(493): n is a, c, g, or t
  misc_feature (496)..(496): n is a, c, g, or t
  misc_feature (500)..(500): n is a, c, g, or t
  misc_feature (504)..(505): n is a, c, g, or t
  misc_feature (511)..(511): n is a, c, g, or t
  misc_feature (518)..(518): n is a, c, g, or t
  misc_feature (543)..(543): n is a, c, g, or t
  misc_feature (547)..(547): n is a, c, g, or t
  misc_feature (552)..(552): n is a, c, g, or t
  misc_feature (615)..(615): n is a, c, g, or t
  misc_feature (620)..(620): n is a, c, g, or t
  misc_feature (739)..(739): n is a, c, g, or t
  misc_feature (862)..(862): n is a, c, g, or t
  misc_feature (888)..(888): n is a, c, g, or t
  misc_feature (917)..(917): n is a, c, g, or t
ccttaaatccagaatctccctccagtttccccttacaactccnagccctgtgtcccccgcctnggccacntcttaccccagttagctcctatcatcttttccagctcttttatccttttgcctgaggcctcctntgtctcttcccccagccatcccaacatcctgcgtctctacaactatttttatgaccggaggaggatctacttgattctagagtatgccccccgcggggagctctacaaggagctgcagaagagctgcacatttgacgagcagcgnacagccacggtccgnncgnatcatcgnaggagttngcagatgctctaatncactcccatgnnaanaaggtcattaacacacacataaanccagaaaatctgctcttagngctcaaggcaganctnaagatagctcacttccgctggtctgtgcatcgcncacctccctnaggagnaanacaatctgtggcaccctggactacctncccccacanatnattnaggnncgcatncacaatnagaaggtggatctttggtgcattgnagtnctttnctatgagctgctggtggggaacccaccctttgagagtgcatcacacaacgagacctatcgccncatcntcaaggtggacctaaagttccccgcttttgtgcccacgggagcccaggacctcattctccaaactgtctcaggcataacccctcggaacggctgcccctggcccaggtctcagcccacnccttgggtccgggccaactctcggagggtgctgcctccctctgcccttcaatctgtcgcctgatggtccctgtcattcactcgggtgcgtgtgtttgtatgtctgtgtatgtataggggaaanaagggatccctaactgttcccttatntgttttttacctcctcctttgtttaatanaggctgaagctttttgta

SEQ ID NO: 495832 - DNA, 1484 bp, Homo sapiens
  misc_feature (1280)..(1280): n is a, c, g, or t
  misc_feature (1343)..(1343): n is a, c, g, or t
gcagtgagcctagatcaaactaccacgctccagcctgggcaacagagtgagactctgtctcataaaaaaaaaaaaaaaaaaaaaaaaaaatctccaaagagagattgacccttctcccctttttttttttatattgggaggagaggagggagggagtattgcgccttaagagacgctcctaaacgcggggccgagggttaacacaccggggaacaaaatttttttcccaaatatttttctttttccctcttagagaagcgagagttcccttctttattatatgcgctgtgcaacaacttttcccaaacaattctattaacccgcgctggtttcttctgtgtgcttgtgagaaaacccctatattatttacagaaacccccgcgtctttgtggtgttttgtgcggcgaagctttgtgcgaacactgtgcggagagaacggacgagcctatctgggggagccatctacatcttatatatgttaaacccctttttttttgttcctcaacacactctttctttagagacacctttcataggagaccaccaacattttttctctccaaacatcttgtttgtgagagagaaatcctccaggggggacgacaaacgcgcgaggtcttttttaaagaggagggcggccctctttttttccccacaagaagaatatatcccacgcttttaaattttttgtgtgtgagggacgagcgcactcattcctctctcctatggacacgatgtcttcaaacagtatgaggagatacaacagactgctgcgcttaatatgagcaccccctttggattatttgttgggcacccccattaatatcattttatttgacgcgacaacccgcgaggaaagagaaaaacgctcccccgaagggtggcttgtttgtgacactgaggtgatgaactccccacaagacaagaggtgggtgggggaccccctcaccgaagagggctctttctaaaagattttgccagagcgtttccccccctataaggaggggctgttgagagaaaactatatatggcggctaagtacaactatctcctcttgaggagagacgcacggggcgcgtcttttcccacagcagtgcgtcacacagccccaccagctgctgcttcgcctgatgaaggaggaggcgaacacacctttttcttgtcagacagaagcacgcaggcttatattttggacgaaacgaatcgtctttcatccacactctttgttagacaaaacccccacccactttctgttgttctaggagcatttgttgtggcgnaccaccaacaccaatcctactttgcttttcatataagaagcggcgggccacaacgagtcgatnctctcttttcggatggtatacaacccgcctgtggagagggggagggagacaaccactcctcgtggggaggatacgggggggacgcaccatcaaaagagggagatcacacccacccagtcagcgagggttatacaggtcggt

SEQ ID NO: 495833 - DNA, 99 bp, Homo sapiens
agacaccttagccaaaccatttaccaaataagtataggcgatagaattgaacctggcgcaataatatagtacgcaggatagatgaaaattatacccagc

SEQ ID NO: 495834 - DNA, 322 bp, Homo sapiens
ccggcctgtgcagacacagcatgctggccatttttttgtagagacggtttcgccatgttgcccaggctggtctcgaactcctgagctcaagcaatttgctcaccttggcctcccagagtactgggattacaggctatgagccactgaacccagctgacttctcttttttttttttactctttaggggccgtacttttgtttttctttgtgtgtgtctcataatttttttggttgaaactgattttttagagtgttattttttttttacatacagtcagatttatcattgattaatataaccttaagggttttttgtttgtgc

SEQ ID NO: 495835 - DNA, 955 bp, Homo sapiens
tgtgcgggcgcaagtaggaagtggtgacgttcgagaagttaagatggccgtcgcttgatccctgtgcctctgtccccgatactgttcaattagcatacagattcatctgaggacggatcaggaacatgaatgatgcggataccctgtggtggattattgactgtcgtctatacgccttggaccaggactgtagtgaagatcgatagctaaaactcctgaatgtcgcaaacatttttatcaaagtgaagtggatcagttagaagctctacgcgaagcagttggcttgataactgaaagctattactcaaagaaatacgctgggctgtgcccatttggggaatcatgctttgagaaaagtgtcttttgtactggcagacaacatgaatgatcggtgctggacgatttcaccaacatacatgatcaagtccttctattactgcaaaggtcttcagatagaatgtcataacgaggtattcggagaactcactgaatgaaaattgtgcaacaccaaggtaggtttgccagatgtgaaggcaagatacatccataagcgtggttcacagacctggggagactcctcacgcaggcccctgttgcaactcgcggagacctacgcgctttgacgaaatcaccctcgctgaaaccagactctctgccaaaccaacaaccacaccatcatcttaactttatggcccagcaactggcattcggtacccatctgaataacgattggccgggtgaccagccaattatacgccaaattccaagccgtgtgaagtatatatacaccaacaaagtaaccgcataaaacgatgaataatcaggcagtggtacccaaatttcaccaatcaaaacagacacataacaccgtcaataaaccataagagcaaacctgcaagcctctacatgcttgtttctcttttttatatattttgctcccacacaaccaacaaac

SEQ ID NO: 495836 - DNA, 134 bp, Homo sapiens
atggacaggaaggcgggctctacgggcggctgaatggtggggactagatggaggattgccagccgacatcacatggtccggctgtactcgaagccactcttggaaaagatgcccgaccatggaaagaaactgca

SEQ ID NO: 495837 - DNA, 319 bp, Homo sapiens
  misc_feature (36)..(36): n is a, c, g, or t
atgtcgtctcggtcactgcaactctgcttcctgganttcaagcaagttctctacgtcagccccccaagtagctgggattacaggcggctgccaccacactcggctaattttgtatttttagtagagacggggtttcacccatgttggccaggctggtcttgaactcctgacctcaggtgatctgcctgcctcggcctcccaaagtgctggaattacaggcgtgaaccactgcgccaagcccagtccaggttttcatggtgtcctaaccagatgtctgcaccgtggctccccggcgctctgtccagccattgcactccgg

SEQ ID NO: 495838 - DNA, 890 bp, Homo sapiens
gagcgtcccccacaccacagacccgaggcggccgaacatgtttctattttgtctatgtatctatgttattgtgttcttctttttcgtacaaaacgtggtgcactcctctctctgcggccagcaggggtggcaaggagcaggcgtccgtacatccagggagccaacgagcagcatgcaacgctccgccggagttaaaatctcccaccgcaggcacatgacacaccaaacagggtgcgtgcgagagataaccgcggtgctcttgccgcgcctagtggaatgacgaccttcttatgtttatctacgtcggccaagagaggagtgctatgctagggagtcgcttcccagggaggcgtgtgttgacatagacgcctcgtggaggcaggagtgcgagggtccgtcctgtccagcaggcagccagggcggtccatgacatattaaaccgggcattgtgaggcccccacaggacgcttctcactacagaatgagagcagacatggattacttgtttgacagtccttcacttatttttttaacaaatgtattcctactcttgcctgggaaaaaaagcagttgctgagtagcaggcgagaggggcagggctggtcttacacaacaaggaggggtgagggatttttcgagacacggcgggcgttataactatcgaattgccaaggaagatttacagcaaggcgtgcggccttcacaggtcctttggcaggcggcgcgaacggcccttttctggtaccgaggtctccaagttctcgtgtgcaaggacacttgtctcctttgcaccacctttcatatccttcttttgcctaccaatgtgtcttttgaatttcccaaatctaatgtaaattctggaagggcagcctccttgctgaccaacgacg

SEQ ID NO: 495839 - DNA, 309 bp, Homo sapiens
ccatggacctcccaaagtgctgggattacaggtgtgagccaccctgcacttgtggcatgtatttgtatttatggacattagactagggttgggaaacaattctgtaatggagccagagagtaaatattttcagctttatgggccattagtcatagccattcagctctgcctttagagcaggaaagtagacgtggacgatatataaatgtgcatgagcaggtatgagctgcgaggtgagcatgcgtattcattgggtggcaagaacctcctcgcgcgcgcatgcttgctaaagaagttacatatgagggg

SEQ ID NO: 495840 - DNA, 420 bp, Homo sapiens
tagatgtagctgaaagcttatctcgtgataaataatcactgtaatttaggggaagaatgtcctgtagcaaaaggatactcaaagctgcaatccccaaggaaaatcatgtattagtatggctaaatgagggtctgtatcttcttagtttggagaggtggctagatgtttgctgtaaactggaatgggataattatattcgttaacgtttacgccccctataagcctaaagccatctatctggataccctgagagagacctactacgactgggctctagggtatacaatccgtcatctgatcatatacctgacctccccccgagtccaacctaaatgtgctgactcagcacataactctaaaacattatcatcacagagtgcaacatgctacgatccactcaacatcaagacagattctgtc

SEQ ID NO: 495841 - DNA, 505 bp, Homo sapiens
  misc_feature (120)..(120): n is a, c, g, or t
  misc_feature (236)..(236): n is a, c, g, or t
ggggagttccgtgtgggccgtgaaggttctccagtgctgctccactgccccatggcacaaatgtgtttctatccctttggacaggttttcccaaaaacccagcgtcctcccggcttttcncgtgtcccaaaagcttagattgggaaaaaaaacttttggctttatgtcctggaggaagcctatacccccaaaccttggctggtccggataaacaaggtaaagggcctggataatcnaggcttgtccagggcattaatgtcccggcccgcttttatttgtttcgcccctgggccccccccctttagggccggggaaaattttttttttttttttttttaaaaacccggttggaaaaaccaaactggagggcccccaaattgtttggaagttttttcttgggccggatggggtgggcccaaaaaaattatttttttaattttaacccgggtccccaaaaaaaagtcctggctttcccttgggccattaaagggggggatttttttta

SEQ ID NO: 495842 - DNA, 295 bp, Homo sapiens
catgtgttcagcgtgctaaagtcgttggaactcttgctgtgtgttcattgtcgtctgtgctgttaccacgtcctgtcatgtttgacaggggccatgggagattccatccggaggtccaacctttgcatccagtggcgatggagggcttgagtgacagcgccatacgtgtttgtctgaggtttaaaacaattcaattacaaaagcggcagcaggcaatgcatgcccatgcatgcagccctcccgaccgcccctcgtgtctgtttgtgctgtacggaggtgttttttacatttaaga

SEQ ID NO: 495843 - DNA, 122 bp, Homo sapiens
aaagcccccccccccccctggccccctggggggtaggtttccccttatccttttggtccagggcaaggagggggtgctttttggggggggggctgtttttcccttaaaaaaaccccgggcca

SEQ ID NO: 495844 - DNA, 986 bp, Homo sapiens
  misc_feature (619)..(619): n is a, c, g, or t
  misc_feature (641)..(641): n is a, c, g, or t
  misc_feature (735)..(735): n is a, c, g, or t
  misc_feature (851)..(851): n is a, c, g, or t
ctgctttcgccaacattcgcgaaaatgggggcacaatttcacggggtaacaccctgcgggcacaagtcgccaaccacacaaacctttcgtgtgagaaaatgctttgaagccaataatgacattaacgcctaacaggcgttcgggacatgtgggagggtttcccgcccaaggaccatgcttttagcaatcggggcttctaacccccctaacgaccctgggagcggcaccttaggggggttcatagggccaagttcccaactaaggcctgcatcggtcaagggaaccaccgcgtcaaatgcctattctagaccctagggaacaagacccccaccgcccctcttccgtccccctcataggggccatgtcagatagccctggggaaacgctctgtccaagcgcatctgggcacagtggttgccccctttgcaagccattacggcgcaccctcagagctgataggggccctgtgacgagaagaccagtacggcggtcttgacagcggtatgacgatgggaggtcacgattacctattctcaggtatggcaaaggggataggacggccagagtctcccagtggctgatgctctatggctgctggccttaatcctaccccctcttnaaagaagagtgggacttggagngaaaggctccatgcacccttcgctcctcctctcatcatttgcattgggcattagtgtccccccccgttgcaatacctccaagcagactccagcncctggacccctggggtggccagggcttccccatcagctcccaacgagcctcctcagggggtaggagagcactgcctctatgccctgcagagcaataacactatatttatttttggntttggccagggaggcgcagggacatggggcaagccagggcccagagcccttggctgtacagagactctattttaatgtatattgctgcaaagagaaaccgcttcttggtttaaaccgtttggatgagcaaaataa

SEQ ID NO: 495845 - DNA, 436 bp, Homo sapiens
cctccagctccagggctcagcgatactccgggctcagcctcctgagtagctgggattacaggcacctgccaccaagccggctaatgttgctatgtcatcgtagagatggggtttcaccatataggccaggcgggtcttgaaatcctgacctcaagtgatccacccgcctaggcctcccaaagtgctaggatacagtagggagatctccctactgtatcctagactgattactgccagactggaggtagggttgaacatggcaaaattctatgaagttcagatagagcattcatatgtacctatagtttgctttggtataagagacagggtcttgctctgttacggcagccgcaaactcccaggctcaagttatcctcccacctcagcctctcaactatagccgcatgccatcacacccagctaatttggacttaat

SEQ ID NO: 495846 - DNA, 658 bp, Homo sapiens
  misc_feature (34)..(34): n is a, c, g, or t
  misc_feature (96)..(96): n is a, c, g, or t
  misc_feature (99)..(99): n is a, c, g, or t
  misc_feature (106)..(108): n is a, c, g, or t
  misc_feature (110)..(122): n is a, c, g, or t
  misc_feature (126)..(128): n is a, c, g, or t
  misc_feature (130)..(131): n is a, c, g, or t
  misc_feature (134)..(136): n is a, c, g, or t
  misc_feature (140)..(145): n is a, c, g, or t
  misc_feature (147)..(147): n is a, c, g, or t
  misc_feature (152)..(152): n is a, c, g, or t
  misc_feature (158)..(159): n is a, c, g, or t
  misc_feature (169)..(169): n is a, c, g, or t
  misc_feature (173)..(173): n is a, c, g, or t
  misc_feature (175)..(176): n is a, c, g, or t
  misc_feature (182)..(184): n is a, c, g, or t
  misc_feature (188)..(188): n is a, c, g, or t
  misc_feature (200)..(201): n is a, c, g, or t
  misc_feature (206)..(206): n is a, c, g, or t
  misc_feature (215)..(215): n is a, c, g, or t
  misc_feature (227)..(227): n is a, c, g, or t
  misc_feature (230)..(230): n is a, c, g, or t
  misc_feature (235)..(236): n is a, c, g, or t
  misc_feature (246)..(248): n is a, c, g, or t
  misc_feature (262)..(264): n is a, c, g, or t
  misc_feature (272)..(272): n is a, c, g, or t
  misc_feature (291)..(291): n is a, c, g, or t
  misc_feature (313)..(313): n is a, c, g, or t
  misc_feature (407)..(407): n is a, c, g, or t
  misc_feature (523)..(523): n is a, c, g, or t
acaccaagcacacacaacacacacatcatcacanacacacacacacacacatcacgggggtgtcacaccacagcatgggcacaccgtgtctaccanggntatgggnnncnnnnnnnnnnnnnttgnnngnnatnnngtgnnnnnngngtgtngggggnnttgcggccgncctngnnggatgnnngggntgagtgggaggnngaaanttatctcanggagggattgtnatngaggnnagatgttatnnnagtgggtgttgatnnntctgttgnttaatcctaccccctcttnaaagaagagtgggacttggagngaaaggctccatgcacccttcgctcctcctctcatcatttgcattgggcattagtgtccccccccgttgcaatacctccaagcagactccagcncctggacccctggggtggccagggcttccccatcagctcccaacgagcctcctcagggggtaggagagcactgcctctatgccctgcagagcaataacactatatttatttttggntttggccagggaggcgcagggacatggggcaagccagggcccagagcccttggctgtacagagactctattttaatgtatattgctgcaaagagaaaccgcttcttggtttaaaccgtttggatgagcaaaataa

SEQ ID NO: 495847 - DNA, 816 bp, Homo sapiens
cccccgggtttcctttctcttgtaggagacaacccccggcccttgagtcccccccgatcccttcctggtccctccgggtgcccccatagcttgtgcacggcttctcctttagggggcccctcccctgtgcccaggctttttcgcggcggccaccccccaggtgtcccctgcctgtgttgtgggggagtctcccccgaggacccccgcgctgttgctgttggaacccctcttcatggtgcgcttctgccctcccgcaccccttgacacgcccccctcgccccgttttgtgaaggtggtcgcgggccacacgggcgttttctttttcgtgaaccattggcggagcttcccagtgaggccccattgagcttctcctcgcccttgtcgcaccctctactcggggtcttggtcacactccttagggggtctagacccctctgctgttggaaaggggaccttctcgcatgtcttgtggagagcacctgctctccgcggccgggtttcaagaccccccgggagattttgtccctagtggggtcccccccgcgactgtgggtgcttcatgtgaactcgcgcagaacccgggggacacctccctctcccctgccgggttccgccgcaagccccccgcccgacccgggaccccggagagctgttggggtcctctgagcgtcgacatttttttgccccgagggtggtttggttattaaacagatttccctggggccccccccgcccctgggaaaccccaaaggcaaagggggcggccccctctgacacccccaaccggccggcccctatttaaattggcccccccca

SEQ ID NO: 495848 - DNA, 160 bp, Homo sapiens
aaggaccctacctggtgcttctaactactgaatctacagtttgaacagtggaaagaggatggactccccatacccaagtcaaagaaacgccccaaccttcagagtcatgggccattgttccaagatcaagctgtatcaaattaaagctaaaaatccctta

SEQ ID NO: 495849 - DNA, 217 bp, Homo sapiens
aggaatttgggagggcgagggtttcggatcaactaaggtcgggagttcgggaacaggctggccaacaacaagaaccaaaaagaaccattgaaccaacttcttccagaaagaattcccagcccgaaaattggttcttgaattttccagcgaaaggggtcttaaacttgttagccccgcccgaaggccagcttggtgggtgggtggtcaatcaatcctt

SEQ ID NO: 495850 - DNA, 166 bp, Homo sapiens
tttcacgtcaaacaacccgcggcacttggccctcgcggaaaaactgtccagcgtggcagaaactgtctacatgatgcaggagtgcaccactgtattcccgggccgcgtcgaggactactatagaaagtctcctgtgatgcaggattacttctcccggtgtcatcag

SEQ ID NO: 495851 - DNA, 132 bp, Homo sapiens
cctagaggatcctcttgctttgggacggcggcatctataacttcattggtgagttcatgaaggcagcgtggattcgcagacctgataggtctaaaccttgtcatgttcctggtatgccggcgatggagagta

SEQ ID NO: 495852 - DNA, 498 bp, Homo sapiens
ttttgcaagaacttgttgttgtgtatacaaggttgagcattgactcctgcaagtggcaatggaaacaccataccaaaaattcctatttcacagataaactggaaaatgcttctgtacaaaattctttgtgcattattagggacacactgaccaaggataaatccaatgctagtctgttgactaacttcaccatttagtgaagcagtctagcctgaacaaactggcatagtatctgcatataacctacgcacatcctcccataaactttaagtcatccctaggttacttatactaccgaatacaatgcacatcctatataaattgtcatcatactgtatttagggaatactgacaggaaaaaaggtttggacatgttcagtatagacacaaccatctttctttccccccaagtatttttgatccacagttcgttgaatttacaagtgcccatggactgtaatcagctcttaataaagttgtatatcatttatgaataaa

SEQ ID NO: 495853 - DNA, 151 bp, Homo sapiens
atgctttctacggcgaccctgatagaagctgccaacgagcgcgaagaggcaaccgcaattgcggtggcgctgcggctggcgcttgaagcgccgggcgcgggcgttcgtctcaggcagcgctgatcacgcccgaccgcggactggcgcggcg

SEQ ID NO: 495854 - DNA, 219 bp, Homo sapiens
gcagtggtgtggcttcctgagtagctgggactacaggaccattccaccacacttggctagttttttaattttttgtagagacggggtctctgttgcccagactggtctcaaactcctgggctcaagcggtcctcctgcttcagcctcctaaagcgttgggattagaggtgtgagccaccacacctggccttatattttcaaattggcattttattttta

SEQ ID NO: 495855 - DNA, 745 bp, Homo sapiens
  misc_feature (1)..(1): n is a, c, g, or t
  misc_feature (12)..(12): n is a, c, g, or t
  misc_feature (29)..(29): n is a, c, g, or t
  misc_feature (241)..(241): n is a, c, g, or t
  misc_feature (606)..(606): n is a, c, g, or t
ntcgtttttgtncatccgcgcccccctgngtggggaccactgaattcggccattatggccggggagggaaattttattttgagagaaagaggcgggtaaatatataatcccaaaacccccttggctcaaatacggactcccaagaaatttacgacaaccacaaaatccctggggactatcacccaaaaccgccaaaaagtgagccgcactaaagccacaatagaaaggcagttcttcttanaaaaaggagggggcggcattaaaaaaaaaggataggactgaaaacaggccccatcctaaccaaatgagtcctagcaaacatgatttccaaagccctggccaacaaaaacctaaattttaaaaaattagtacccaaacttaaggccttcaacccaaactaaaccggaaaagtggccctggccaccctaaacccccaatgccttgggaccggcccaaaaggatccctatttaaaaaacctgtgccgccagaaggaaaacctccaaccaaggtcccagtgtacaacccaatcaacacttttaaaaaaaaaaaagaaatagcagtggtacaatcccaagacgaccccaccctgcacaacaaagagattncaaaaaatcatagaatacacatctctgcagaattttcatgaggttgggccccggtgccgaaaactagtcaagctgtataccttctgcgggctgggcactctcgcatacccatatcatcacttcgggaccccccctcccc

SEQ ID NO: 495856 - DNA, 745 bp, Homo sapiens
  misc_feature (745)..(745): n is a, c, g, or t
ggaatgagatgagatgaaatgagatgaaactgatagatgagataaaatgactgatatgaacatgagatgaatgactgagatgatgacgatgaactgatgaaactgaaactgactgagactgagactgatgaacctgaaactggctgacgactgacaactgactgacgactgaaacctgaaactagctgacactgacaacttgaacataaaactcgacgatgacgatgaaactgactgacgatgactgaacactaaaactgactgaaactgactgagggtgactgacgactgacaatgactgacgatgaaactgactgagcatgacgatgacgatgagcatgacaataactgacaacgaacattgaaactgacgatacagactacgagactgacgatgaaactgactgacgatgaaactgacactgatgacgataacgatgaacaagagttgatgagcatgatgacgactgaaactgaggatgaaacagatgaaatcgatgagatgaacatgaaactgatcgagatgacaatgacggtgacaatgacacttcagatgaaactgtaactcgacgatgacaacgaaactgacaactgacaatgaacaacatgaacactgaacataactggaacatgaaggtgacactcaacactgagactgactgaacctttacatgatgaaatgacactgctgaaactggaacactgactgagactgcaactgcgcatgacctgatcaggatgaacn

SEQ ID NO: 495857 - DNA, 149 bp, Homo sapiens
ccattagactaacataacgcattcttaatttaactatttatattatcctaactagtagcgtattcctactactcaacttaaactccagcaccacgaccctactgctatctcgcacctgggttaggtctacctgggtaaggtctaccggg

SEQ ID NO: 495858 - DNA, 194 bp, Homo sapiens
agaaagggcgggggctccttgatattagggaacaggtccctgagcttttacagcccttcatatttattaggtagagtgaatagggaggaagggataactgtcggtcagctatttgatttaacacgggcccacatgattcctttctttgttcaacaggttctggatgttcctgtgggcccgtgttaaatcaaata

SEQ ID NO: 495859 - DNA, 434 bp, Homo sapiens
taaaggccggcaattatagatttgtgcaattagcgacccacatatacatttaagagataatactgactgtcgaccagaaccttctgatggtactgaagcatcgtgctctataaagttacttcagctttacatgtcaatgagataaaagatccctcaatgggatgtaatagcttattctgcactagatacaagtaatatgtatagatttagaacaaatgactacttttcaccttccaggagcctgtatttattaatacaaaattagataggtgtaccacccacatgtatgcataagtgctactcaaatttacaccgttcatatctgaaatcccacaataaatgcaaataaatggatactagtttatatatttcatattttcattcatctgatatgactgctgctggaaagaaagtcccggaggccaaggcggaag

SEQ ID NO: 495860 - DNA, 314 bp, Homo sapiens
aacgatccccttatgctccctcttcactgcactgctgctaccgacactgtgttgatctgatccagagtaagtgcctctcccaggagaacgctaccacggagctcctcactaagctgtctgtgcacacagtgtggggatgttgaacatgtgacctggagtgtgagctgcccagcctagctataactagctgccgtctacagtcggtgggcctacgggctgctgtcctatttaccccacgctgtagtgctgtggaggaccacataacacttgctgttccgccggggtttacgtagtgacacgccagaaaggtacct

SEQ ID NO: 495861 - DNA, 845 bp, Homo sapiens
gccctgagtgagtctctggcgtcgaaatggcggttcctctcgcaggctctattccgttcgctggttcgccacctcaggggaacgatggccatggagtccacagccactggcggcgtcgccgggtgctggtttctgccgataaaattgaagatgttcctgctccttctacatcgtgcagataaagtggagagtctggatgtggatagtgaagctaagaaactataggagtttaggacagaaacatcgtggtgatagggggatattgcccagcagctggtcaaggcgattcctaggaagcaggtagtcttttagagtaatgaagtatggagagacagcattatgagtgtggagaagccttcttcgactatgggaaatttacttctggagtatggctaagatatggatgaaatgggtgtgtatgggagaatggaccgtatggtaagagtcggtgacatgatgggaggacgcgagatgacggggagataatagatacgagagatgaaatcattctgtgttagacatccagaatgaattaagatttgattgaaggagggtgagggaatgaaggagtaccagacatcaacagtgaagtgcagggccgagagaggaaggacaataggaacccaaagacacaaaaggaaacgaaaggaaatgccgatggcggccatcggccgggacagggatctcacaaccagtgcagcggtgccaaagagcgacgcggtgctcgagacaggccgcctacaagcacagtcagccgagcgagcgcaatcacgccgtcccgtgacccaggacggaaccagggagcccatcgagcactccgcgcacacgccacgagcacccagaac

SEQ ID NO: 495862 - DNA, 117 bp, Homo sapiens
tggctagacgacccaggatcagtaccaatctgggtaacatagtgagatcccatctccgagccgggggttgcagcgcgacgaagttccacctccgctgtcctgggattgggctatcaa

SEQ ID NO: 495863 - DNA, 751 bp, Homo sapiens
  misc_feature (328)..(328): n is a, c, g, or t
ctgggctcttgcctgtgaaatctttctttgctttccccatcttttcctcgcattttttcaccatctttcccttcaatctccaaggagccatatgcgatgacattctggcatcccgacttacacgcgatcgagcgcctgatgactctggggttgcgcagaggtagggatcgactcgtagttggtgattggagagcaccccttcacaggggatctgacatccgtaggtactaccgtacaatgctggaatctgcaggaattcttagggggcctgagccctggggtattgtaccgacttgtgtgggcaccctgccacatgtctggtctgtcnttctagtggcatgctccacatcggttgcgctaaacgcacacttgggtggcattgcggtatgctctttctgggagcagcctttgccacaggctgctgtagctctgtgggtcataagaattgacttcagcaaggctcaggaggaaagtaccgggctgctgagcgtgcctccaggatcatggtcgacatcgacagtcgtgctcccagtgcgggctcctgggcctcatcctctaaccccattttccgccagaacctccgcattgaccttctgggttggggggaaggcctggtctgatgacacaagtcagctgtgaccagatcaagctgcccgggacgttccctcccttgagcagtacgccgaggagcgatgggaagtggtcttgacttcatggtgggctccccgtggagtgtcagccagactggtca

SEQ ID NO: 495864 - DNA, 677 bp, Homo sapiens
  misc_feature (45)..(45): n is a, c, g, or t
  misc_feature (64)..(65): n is a, c, g, or t
  misc_feature (74)..(74): n is a, c, g, or t
  misc_feature (85)..(85): n is a, c, g, or t
  misc_feature (88)..(88): n is a, c, g, or t
  misc_feature (90)..(90): n is a, c, g, or t
  misc_feature (101)..(101): n is a, c, g, or t
  misc_feature (106)..(106): n is a, c, g, or t
  misc_feature (111)..(111): n is a, c, g, or t
  misc_feature (124)..(124): n is a, c, g, or t
  misc_feature (172)..(172): n is a, c, g, or t
  misc_feature (213)..(213): n is a, c, g, or t
  misc_feature (224)..(226): n is a, c, g, or t
  misc_feature (261)..(261): n is a, c, g, or t
  misc_feature (279)..(279): n is a, c, g, or t
  misc_feature (282)..(282): n is a, c, g, or t
  misc_feature (289)..(289): n is a, c, g, or t
  misc_feature (296)..(296): n is a, c, g, or t
  misc_feature (306)..(306): n is a, c, g, or t
  misc_feature (308)..(308): n is a, c, g, or t
  misc_feature (326)..(327): n is a, c, g, or t
  misc_feature (382)..(382): n is a, c, g, or t
  misc_feature (390)..(390): n is a, c, g, or t
  misc_feature (393)..(393): n is a, c, g, or t
  misc_feature (421)..(421): n is a, c, g, or t
  misc_feature (495)..(495): n is a, c, g, or t
  misc_feature (559)..(559): n is a, c, g, or t
  misc_feature (663)..(663): n is a, c, g, or t
ttttttttagagagaagtggggtggtttttaggatggcaaggganttcctgtaacaacgcatcnnatatttggnatgactattanaanancggcaatgtgnaatcnaagtntttgggcatattntgaattttgggggatgctcgctcggaaccgactgctgttaccttcacngttccagtttttaaatcctgagtcaagccaaaaaaaaaaanaaaaccaaaannnatcaaaaaaaaacaaataaagcgatgccaatctcnggttgttttttgcgcaanttnggttttnttaaganagggtgtgangnaacttggttatagtcggnntggaggcttttgtggtggatgttggaggggcgggattcgtcatagtcctggttgntgatccanatntggtggaaggtggacagcgaggccaggntggagccgccgatccacacggagtacttgcgctcaggaggagcaatgatcttgatcttcattgtgctgggtgcnagggcagtgatctccttctgcatcctgtcggcaatgccaggggtacatggtggtgccgccaganagcactgtgttggcgtacaggtctttgcggatgtccacgtcacacttcatgatggagttgagggtagtttcgtggatgccacaggactccatgcccaggaaggnaggctggaagagtg

SEQ ID NO: 495865 - DNA, 967 bp, Homo sapiens
  misc_feature (310)..(310): n is a, c, g, or t
  misc_feature (354)..(354): n is a, c, g, or t
  misc_feature (391)..(391): n is a, c, g, or t
  misc_feature (468)..(469): n is a, c, g, or t
  misc_feature (488)..(488): n is a, c, g, or t
attcgcagtggtcgcttcttctcctggattgttaaggatccaagtaagctcttattggagagaagacgatctgcacttcgcattgtggcatgacatttaattatagggtcctgttatatagaagggagactacatgaatgtgtaagatcttggaggaagacagcagagagagagagagagatcagagatcccagggttaaaagtgggagaaatgtcacagatacagtcatccaaagagaggagtccagtgatggaggcagaggtaaactttggagaggacaggaagatgtcacccaagcgcatagctaanagaaggtcccccccagcagatgccatccccaaaagcaagaaggngaaggtctcacacaggtcccacagcacagaacccggntggtgctgacactaggccaggcgacgtgggccagctggggctgggtgagaatgtgatggagaggaagaagccggccnnggtatccattccggaggangtggcgcagggctgaggctgggggcatgcacaccggtgtctaagcaaaagtggccaggtctattccttcggctgcgatgatgagggtgccccgggaagggagcacatccagggagggctcggagatggtccctgggagagtggagctgcaagagaaggtggcaccaggtgtcagcgggagacgtcacccagcaggccgcacgcgatgatggccgtgtctgtctcggggggctcctccggggacatcacggggcgattggactggtggcgcacgcaaaaagcatggccgcggcggcactgacgtgccggggaaaggggccacgaaccacctcgcgcgccgcaccgaggaccctaacccggcgcggggacggcccacccggggcgagaatcccggggcgcagccacaacgccccacgggcacacggacgccgcaaaacaccgcggcccccccagccggggcccccaacgcaccccccaaaa

SEQ ID NO: 495866 - DNA, 371 bp, Homo sapiens
ctggcccctattttgggccctgctcgtataacaggctggtcatgctcggctggcttcctgcaggtagccgccgccgttgttgcgcaggtcgatgaccacgccgtcgactttttccttctgcagttctgtcaggattttcttaacgtcgcgggtggtgctcttgtagtccggatcaccggcgcggaacgctttgaagtccaggtagaacgccgggatcaccaccacgcccagcttgtagtccttgccatcctgcttgaggttgaggacttgcttctggacggcctgatcttcgagcttcaccgcttcacgggtgatggacacgatcttgctggtctggtcgttcggtgcgttggtgtgcggaatcacttcca

SEQ ID NO: 495867 - DNA, 222 bp, Homo sapiens
acaagcagatcttattcaaaaaaacaaaaaaaggtgcaggcgatagagctcactccgggtactcccagcaacttgggaagcgccaaggcaaggcggaactaaggaggtcaggagatcgagaccatcctgggctaatttggtattttaagtagagatggggttactccggtgtaagatgaggctgatctcaaactcctttgcctctggggggtactccatccg

SEQ ID NO: 495868 - DNA, 623 bp, Homo sapiens
caataaattccaaccgagactgttcctttcgtgtccattctatttgactgcattccatttgagtccattaaatttctgcacattccattcctttccattccattccattccattcctttcggtgccattccattccactctactccattcaagtccattccatttgagtccattccattgattcgatgccattacattcaattctattccattcgactccattgcattccattcccttccaaacgattccattccattctattactttctattccaatccattccattccgttccattcgtttccattccattcgagtccactccattccagtccattccattcgagtccattccattccagtccattccattcaagtcaattccactccattccattccattcgatatctttcgataacaccccattccattctgctccttagtattcaattcaattccattccatttgattccattccatttgattacattccattcgactccattccattcgactttattccattcgagtccatttcattccattccattgcattccggtcgaaatcctatttcattccattttgttactgtccattccatttgagttcattccacgccc

SEQ ID NO: 495869 - DNA, 125 bp, Homo sapiens
acgagagaatgagccggtaccgcttctgcttctgccctcaccaaaaccctgcttcacctccctgtacttatgaattcgaacagcatacccccggattccgctacgaccaactcatacacctccac

SEQ ID NO: 495870 - DNA, 387 bp, Homo sapiens
aagcatttcgggggtagtagaggggaggcaagagggaaactgggtaggctggggagctatctaactgcccaagacacttgaatcctaaacaaacgggaactaaatgagaggtgggagggacatagtcttttctgacgggaactgtctgtgactcattctctttcaggagtcagaaactccaaaacctgtgggagtggggaggggcgagcagtgcggtttttagagaggtgtggagttattatagggactcttaaaattcttctcccttgctcagtgtggtgactcataccggtaatcccagcactttggaaggcagaggcaggaggtttgcttgagcctagaagttcaagaccagcctgggcaatgtagcaagaccccaactgtata

SEQ ID NO: 495871 - DNA, 296 bp, Homo sapiens
gaaaaaccaaaaacccccccccccaccctggatttaaaaagaaacaaaaatgcccccgtgaaatttgcctctgtcccaccatttcacccgggggtatgggaatgggggggaggggggaaacccccccgttcttctttttaaatgggggggttgtcccattttggtttgttttggcccccccccccggggggttggggtggggaccaacccttttgggcctgttatgattttgaccatttgccttgacccccaagtgaatttttttcctggggacccaaaaaaaagaataattttta

SEQ ID NO: 495872 - DNA, 470 bp, Homo sapiens
tggatgatagaagactgcactcactgcatttgtgagagtggccaggtcacctgtgtggtggagatttgtcccccggctccctgtcccagtcctgaattggtgaaaggaacctgctgtccagtttgcagagaccgaggaatgccaagtgattccccagagaagcgctaataaaagttttgtgctgttgagccccaaatgggaaatttctcaggaagagacatttaggacttcagaacttttaacttgtagtcacattgttgatatggaaaccactgacttaagcaacttagttcagtggtttccatatcaacaatgtgactacaagttgatatggaaaccactgacttaagcaacttagttcatctaatcttacatatacttacgatcttttattttttcattttctaacataccttgaaataattcaaaactaaaagcaataaagtgcatatgaagtgtttgatcataaa

SEQ ID NO: 495873 - DNA, 1277 bp, Homo sapiens
tggaaaaagtcttggaggccatggggttggtttgaaaccagtttgggggggttcaattccttcctttttggtctaaatttaatgtatatacgggtttctccgaaatgtgtgtgtgtggataggggtggggggcactccattatagctcacctccgaggttaagtggagggttctctctcatactattataggaattttctcgctttcaaagccaaaggctctctcaaattcagtaaaaatttatttaaatataacgtggcgtgttagagaaaaaattagaatgtgacccttacgagaagtgatataggagtgtttcacatgtgtgtgggtgatagtgcattcggggtatatctccgaagttaaccgttcggggggcaatttcgcggaatataggccgaaacacaagtgtttgtggtgggagaacaaaaaagttttagacactttatagcgccgcggaatgtaaaaattagtaatatagtgtacaagagtgggcattttgtggggggcgtataagagtgtttggggcctacataagggagtgtgttataagcccctgtgagagaaaatttgaggggggaaacaatctcaagtagtgaaatatgttgaagaggtctctctccatatgttatatgtgggaccaacaacatattaaacgaagggtctccctataatgtgtcgcgaagatgacgggggcaccattattatgtggtggagcacaagcatggtgtgggcgcctataaccaacagagcggtgtttataatatcagcagtgatgtctatcggcgcaggtattacttcacacccagaaagttgtcatcatactaaggtgatgacatactagaaaagatctttgggaggcctactaacatacattacacacaaatgtggcgaccaccacgattctacggaggaacggcccaccacaccacataatcaagaggggtgttgtcaaaacaacaacgagagccaactaacatgactcgttagacaatatctccacactaagaaagggggggcgtctcctaccaaaggacaatggaccccacagccgttagccgcccgcgccgacgaagagaacaaacatcacattcctgtttctcccacaatatatgttgtgcggctctactaccccgggatggagcacaaactatctagtttttgtgccacaaacgagttctcagcaggctcttaacagcgaattcacctttttgatacaagccgcctccggtgatttggggggaacaatatagcgcgccacgtacgcattatcagggcgg

SEQ ID NO: 495874 - DNA, 165 bp, Homo sapiens
ttgagaggcaggcacagaaagacaactaccacatgtctcactcatatgtgggagctaaaaaagctgatcccatagaagttgaacccacagaagtagagaggagaataatgtttaccagaggctgggaagggtagaggagttaagcaggaggaggctgtggggaag

SEQ ID NO: 495875 - DNA, 196 bp, Homo sapiens
tcaagcttctaacgatgtacggggacatggcgaaaaccctacagagtctactaaaaatacaaaaattggctgggcgtgctggtgtgcacctgtagtctcagctactcgggaggctagggcgagagaattgcttgagctcaggaggcaaaggctgcagtgagccgagatggtgccatgcactccagcctgggtgaca

SEQ ID NO: 495876 - DNA, 528 bp, Homo sapiens
gcagcgtagtaggtctgtagcatcctgatgcatatgcatattcaaacccaacaaaaaaaaagggcatcagcagtctggtgtatatcagtggagcaccaatattggatatatcggctttgaaaaaagcaagtcccactaggactggggcattccaaaataaagtgagcagaatcacccacatgtgcaagggcttcacacattaacccaccccctgtagcatgtttaaaaactgggtccggggcttgggaaagagctagggccttagggtctaggagttcccatctcagctaacgtatatggtatccctactattaggacatcaggaacgcaggtgatctagtccgggtctgaagagccagtgtacttgaacagacataaagaatctgtccctataagaaatatcatttctaacaaagcctactgagaccagccgtgaagaggcgctagctgggttgactcctctgggtgagttgcttggggtcttggcccggagtgcttggagatcccattttgagctgtggtcgctcg

SEQ ID NO: 495877 - DNA, 277 bp, Homo sapiens
tcacgtcccactcaagctgaaatcaaagtgaataaagtaggctgggggcggtgattcataatcccagccctttgggaggccaaggcgggtggatcacctgaggcaaggagttccagactaccctgatcaacatgctgaaaccccgtcactactaaaaatacaaaagatgcacggcatggcgacgcacacctataatcccaggtacctgacatgctgatgtgggagaattccttgaatgtcggagacagagaatgcagtgagccgacatcgcgccatt

SEQ ID NO: 495878 - DNA, 205 bp, Homo sapiens
cgtgtactgaataccgagctatagcatgatctgtattgggcaatcccgaggagagctgtattaggcctcacgagtgaaaggtgccttttctatcaatttaagaactttacagaaaggagccgcatgcattttggaagagacttcacttgtctcttgaggccattctttcagactcgtagaagtccactctcaggagatccttgga

SEQ ID NO: 495879 - DNA, 553 bp, Homo sapiens
  misc_feature (553)..(553): n is a, c, g, or t
aaaatgctgcctatttctttgctgctcccaagctggctggactttgcataggagcaaactacagatgcatagttgaagagaaaggcctgactgattctaggatagaggtggcaccacgagcacgaaccaccatgctgaagtaactttttgtatttttagtacaaacagggtttcatcatgttggccaggatggcctcgatctcctgaccttgagattcgcccgcctcagcctgccaaagtgctggcattacaggcatgagccaccatgcccggacaataaaggtattttttttaattagcagatcaaattattgttgatgagtcagttagcacacctaaatacttgggtaaaccttcttgaaagggtcctaaaacaactgtcaagtaaaagactactgcaccgaaacgctcataataaacagagaaaaatcctgggaaatattgatcctaaaagcctccttaagaatccccctttggatttgtggaaaatttgccgaaaaaaaaatgtacaaatttttacaatgaaagactggcatacttggccaaaataatn

SEQ ID NO: 495880 - DNA, 170 bp, Homo sapiens
taataaacagagacacaatcggatttggtggcccaggtgggttgggaattctggggcccaagaaatcctctcaccttagcctcccaaaagggcggggataacgggcttgaatcattgacccgggcccacccaatttcctacccagaaaaccgggggggtgtctaacctct

SEQ ID NO: 495881 - DNA, 148 bp, Homo sapiens
gatatgttcagcgtacacttactcagatgtccaccttctgctgcctggtagagtcattgctttggatcctgatgctagtatacacatccagcacttggcaggctccagtgaacactgcaagcccgtggaggcttataactcgctgtgc

SEQ ID NO: 495882 - DNA, 118 bp, Homo sapiens
tacggtcggacgactgatttgcactgtcaggacctgtactggacctcctctgtgcttccagctcctctgtgctcctcctctgtgtgtccagcctctgtgctgtcctcctctgtgctgt

SEQ ID NO: 495883 - DNA, 488 bp, Homo sapiens
agatcctccagacaggactgatccttaattgaggacaccgagatactgtacagtgccatgtatcgtagccgggccaacttggagcgcaagcgctgtcaccgtgcccaggtgcattcggactgagggtaccttgtgcctgtcagaagcacaagactcggatgcacacctgttacaggactctacagagccacggacatatcgggtgccatattcagatgaataggttgtggaggtaccttatagccgtcggacacggatgtcgataggcaccaaggggcttaaagtcaagctctttgatggactgagccgctcagacctgactgccaagctgtgcactcggaatcgctcagctgaggagggagagctggctgatagccagtcgagccatacagtgtgcggggtacagcgattgaaatgctgtatggtcccaggactgtgaaagcccctcacgttaccttccaagccagagtactcaaggtcactgatcg

SEQ ID NO: 495884 - DNA, 175 bp, Homo sapiens
  misc_feature (5)..(5): n is a, c, g, or t
  misc_feature (59)..(59): n is a, c, g, or t
  misc_feature (142)..(142): n is a, c, g, or t
  misc_feature (161)..(161): n is a, c, g, or t
gaagnaaccagtaccagtcatccccagagatagatgaagaccggatccccaacccacanttaagtccactttgcaatgtctccacggcaacgaagaagatgacaaggatcacacccacaatgaaagagctccagatgatggngaacatcacttggcaacancacaggaagggacc

SEQ ID NO: 495885 - DNA, 296 bp, Homo sapiens
agatatgcagagaacccaggaggcgaggctgcagtgaggagagatggtgccaccgcactccagcctggtgacagagtgagactgtctcaaaaaaaaaaaaaaaaaaaaaaaaaattagggggggaaccaaaaaaccaatttttttccaaatgggggggcgggaaaggggttccaccccgggatccccgggggaaattagagggcacttgagattccaaagactagctagatggtaaatgcttggggaaataaaggctagcggcctaaacctttcttctagaagagggggggtcctc

SEQ ID NO: 495886 - DNA, 851 bp, Homo sapiens
  misc_feature (70)..(70): n is a, c, g, or t
  misc_feature (153)..(153): n is a, c, g, or t
  misc_feature (168)..(168): n is a, c, g, or t
  misc_feature (256)..(256): n is a, c, g, or t
gggcttggtcaacactaaatcaacaatatcaccccaataattacttcactgcctccaggtgagactgggnaaagcacaacatcgaagtcctagaggggaatgaacagttcatctatgcggtcaagatcatccgccaccccaaatacaacagcntggactcatggacanagtgacactcctgctgatcaagactctccacaccatgccattcatcaatagcccatagtgtccactcatctctctgcccaccaccccntccagcgtgctggcacatgagtgcctccatctctggactggggcaacactactgagttactggctgccgactaccccagacgagctgcatgtgccttggatgctcctcgtgctgagccaggcgtgagtatgaagcctccctaccctggaaagactaccaacaacgtgcttcgcgtgggtaaccttgagggaggcacggatgccctgccagggtgattctggtggccctaaggtgtggaacacacagaccagagaagtagtccactagggcgacggctggcccacaataacaggtgcgaaatccaaacccccgtctaaacgaatccgtaccgtcccacagacaccataactgacaaacacataaagacgccagatttaggacagtctttataccaatcaaacttaccctagagctcactgcgtaaataggaaatatctgtcctcatacgatcctccacatagagatcgtacccgtggtggttaactcacgccagaagctctacaaattaaaaccgacaccacaccacacaagagacaacccacctaccatcctcaactggtttctatttgccattacaaggacttctcatccgtag

SEQ ID NO: 495887 - DNA, 265 bp, Homo sapiens
tgctccattgatgaaactgatgggtactgacaggcctggcgctctatctatttccaatagctgttgtgaggcagcatctcttgtatacgttcccacgtgcaagactgaaagatggaagatcccaggcatcctaggactttgagaggtaccaggtgggaatgtctgcccctgtttcagagtgcttgttggtgtcctatactttagggatcacgcagaggacacaatttgttctgagctctagggaacgctccaactagcctagcag

SEQ ID NO: 495888 - DNA, 203 bp, Homo sapiens
gagtgagttgccttagtttagggacgaagtcgacaccaatatggatcacaaaccagagggcaggacatactagtggtagcagccatatggaccggaacagattaaaaatacataagcagctttcctaactcattacatgcattaacaatagagtccagtttccattatgcaagataagagttagccaacaattagttaaaatg

SEQ ID NO: 495889 - DNA, 443 bp, Homo sapiens
gggggaaccccttctggtttaagtactgccgattcataagttgttctttgctcaaataaaaaaggttatcctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccctgggcccctttggcccaaacatttttaaaattgaaaaaattttatattggggcccaaattaaaccccaattggaaaaatccccctaaaagggggtgaaaaaaaattaaaggggccgtttttaaaaaacgtttgaattggaaaaaccctgggtttcccaaaataaaaccccttaaaaaaaaacccctttttcaaaagtgggattccaggcccccaacttcccctt

SEQ ID NO: 495890 - DNA, 288 bp, Homo sapiens
gctaagcactatgctaggtgcttttcccccaccctgcctcattcaaacctcacaacaattcagtgagatattatcttctctcccttctcctgtgcacccctttctcatttctatatagatgaggaaggtgaggtccagagggttacagtgatttgctctaaaacgagctcaagttggtctgcttacaaagcctgtggtctcttcactgcatggaagatggagatcttgtgtttggagaacagaggtttgtttagctctcctttcagagtaaaaaaagttcttaaattc

SEQ ID NO: 495891 - DNA, 246 bp, Homo sapiens
tgtggcggcgggtagctgagtctcagcgggtggtctggtggcctgctcgcgggaggagatgacttgccatcctgtacctcttccacaatggtacgcacctgacgggtggtcccggttctttcttgtactgagtcacgcatctcgttgaggatgcggctcaggtccacgcctgtggcagcgtccatctccacattgatctcaccacccatctgggctcgcagggggttcaatctcctcctcggctcg

SEQ ID NO: 495892 - DNA, 315 bp, Homo sapiens
aggaacaaagtaccttttctacatgaaaaatacatactcttttcagagggagggtgtacgacttaaactagaaaacaccttgatattaatcattcttctcatatacttcaaattagtactcaatgcctttctactcctggacatcagagagaacacctggttgttctggcagacgtttatatttctccacatcaatttctggaaaaaacgcgacactttcaaagtcttgcgtgatccttgccacaaatagcttaagatgacctgcgtcattcatgacttccatatgaacagaactgccaccaactatccagacca

SEQ ID NO: 495893 - DNA, 104 bp, Homo sapiens
atcgggaatacaacttaagctgcaatattatatatatatatgaaatatatatataaatatataaatatatacagtatatatataagtatgcatctcactatcct

SEQ ID NO: 495894 - DNA, 165 bp, Homo sapiens
tcgtccagcatcaacaaacaactatagaatggcgtctaaaaggagtccgtagccgagagctatggagtgtgtggaatttgagtcagactcttaccctactctaagggcctcacagactaggagaaactcttaacaatctgtgtaaatagctagaagagatacaaa

SEQ ID NO: 495895 - DNA, 437 bp, Homo sapiens
  misc_feature (379)..(379): n is a, c, g, or t
ccactctagagtatccccacgttgacacttcagacaatggaatattatttagcaataaaaaggaatgagctatcaacccttgaaaagtcatagaggcaccttcaatgcacattgctcggtgaaagaagcccatttgcaaaggctacatagcgtatgattccaacaatatgacactctgggaaaggcaaaaccatggagatggtaaaaggatcagtggttgctggggttgaagagagggatgaataggaagagcacagggtattttagggcagtggaagcactctgtatgatactgtgatggggacacatgtcttctttttttgtgttgagacagaatctcactctgttgcccaggctggagtgcagtggcgcgatcttngctcactgcaacctccgccttccaggttcaagtaactctccttgcaactggtacaacc

SEQ ID NO: 495896 - DNA, 248 bp, Homo sapiens
tgggcggggataaatttttcaaaacagggttcccccagggggatggttcccccatcggttttggccagtgggtggaaaaaaggccccccgttttccccccctcaaaaaattttttttgtttttttggaaaaaaaggggtcaagcccccctttcacccctgggatgggggtccccccccgggggggggggtgggtccccccttcagtgaaaaaaaaaccccttttgttttggggcccgcccccccccca

SEQ ID NO: 495897 - DNA, 381 bp, Homo sapiens
atccaaatccccttcccgggcccgccacccgtgacgcacaaaggggcgcgacggggtttgaatgacgttacttgacgctgcggcccacgcccggggtagttttcacagactgacaggcgacgtgtagcccccatgttgagtttgggcaaaacccaaaaaaatacgcctttcccatgggccccattggatatggacatgcccggcggaaatgctgctttcctgctaccatgttttgtgtgggcaaaccgagtttgggaccctcggggccctggggtagcccctaaagcccgctgggtcaggggccgccctttcccctgggggtttccgccggaggaaaggcggttaatttatttttgaaaaaacaaaacctaaccggcggga

SEQ ID NO: 495898 - DNA, 743 bp, Homo sapiens
ctattgtatttttcccttatgaatttgactagatacctcatataagtggaatcatacagtatttgcctttttgtggctggcttattccacttggcctgtcatcaaaattcatccatattgtagcatgtgaaaggattttcttccattttaaagctgaataatattccattgcatgtgtgatatggtttggctgtgtccccacccaaatctcaatttgaattgtatctcccagaattcccacgttttgggagggacccaggggaggtaattgaataatgggggccggtctgtcccatgctattcttgtgatagtgaataagtctcatgagagctaatgggcttattaggggtttctgcttttgcttcttcctcatttttctcttgccaccaccatgtaagaagtaccttttgccccctgccatgattctgaggcctccctagccatgtggaactgtaagtccaattaaacctctttttgttcccagtttcgggtatgtccttatcagcagcgtgaaaatggactaatacagtaaattggtaccagtagagtgaggcgatgctgaaaggatacccaaaaatgtgcaggcaactttggaactgggtaacaggtagagggtggaacagtttggagggtaagaagaagacaggaaagtgtgagaaagtttggaattcctagagactcgttgaatgactttgacaaaaatactgataatgatatggatggggaaaatcaggtgacgttg

SEQ ID NO: 495899 - DNA, 363 bp, Homo sapiens
  misc_feature (85)..(85): n is a, c, g, or t
  misc_feature (135)..(135): n is a, c, g, or t
catgaagcagttttgttctgtaaatcctacctttggatctgagaaccaaatataggttgagatacctggcctaccagtaaccttnagtctagactatggaatttcccttctagaaacttaccctgcagttaaatntgcgcaagaacatgtatgagaaacagaatgcagggtataatgtacgtcatctgctggggactggttaaatatgggaaggctttaagaatgaggttgggtacaggggctcacgcctgtaatcccagcactttggaggctaggctgagttgggagaattgcttgagcccaggagacggaggttgcagtgagcagggatcacagtgagccaagatcgtgccactgcactcc

SEQ ID NO: 495900 - DNA, 153 bp, Homo sapiens
  misc_feature (60)..(60): n is a, c, g, or t
actcaaaaatacatcggaatgtcatcagtgctgccaaggaaaattgctgaaggcaggatnccaggatggacaagcttggccgcaccatttgcagaccattgtccccgactcggcttgcaagcaggacacccgtctggcctaacccctgcaacg

SEQ ID NO: 495901 - DNA, 248 bp, Homo sapiens
gactttcagtgagtcccttctccagatatgtcatatgagtgctgggtttgaataacttgatgtaggcagaaaattttggcaaatcatgtccagccacagctgtgtatggactcacgggttcagcagctgccagcattggggtacctagggaggggcacagcacttgcctccatgaaattcctacaatctatgtatggagtactagtgtgcactatcagttgcccatacaatgcatgtgaatgggaagc

SEQ ID NO: 495902 - DNA, 100 bp, Homo sapiens
tcttgtgcgagcaggtagggctggaccccggaggacccggaaagatcgttctcaatcaccatcttctgcagcccagctgagatgctgctgctgccagagc

SEQ ID NO: 495903 - DNA, 241 bp, Homo sapiens
aaaaaattttgggcccccccccccccccccccgcaagggttggggaaaaaggtgtttcccttcccacccggggcccaaagacaggcctttcctggttaaaaccctttcggccccccctttcttttttggggggggaaatgggttggcctggcccccccccgggcctgggaattttccgggccccaattttaaaacccctttgggtagggtttttggccccgggaaaaggttttttccggga

SEQ ID NO: 495904 - DNA, 512 bp, Homo sapiens
tagcaacaagaactctcgttcctaccctcgaaacgccttaatccccgaaccccgcccccgaccgtacccgagacctgcgaccaggccctgccgaccaatgccaaagtaaacttctggagaccgccgccattccgccaaagcccacagtcccgccgaacaccaggacatataagggagagaagtagtaccgcggcgaccgggtccactccctatatactcttctcagagacgtgcgagaggtccgtcaccttcgaagtcgaacggttatcactcactatctagccgcgtgtcccgaactatacccaagaagtcgtcgcctctagcattcgtaattgcactgagacccacgcacttgtctccctctgccattgtggcgctaaagaagctatcgaacggacgctcaaggcccctcctttccctttccccactctacctatcctagcgccataactggcggtaaacgaccatacgacaaaacgtcaccctcccgttagagaagcgggaccttagcc

SEQ ID NO: 495905 - DNA, 171 bp, Homo sapiens
  misc_feature (30)..(30): n is a, c, g, or t
aaaaaaaaattttggggttttacccaaaanttccattttggggggggttaccgggttttccaaaggtcccccaattgtggggccgctccccttaaacctttttggggttttttttttaaaaaaaaatttaaaacccgttggggtttataaaaatgtccatgtggaacttga

SEQ ID NO: 495906 - DNA, 282 bp, Homo sapiens
gactctaaggatcccgtctgttctgcaccattttttgactctgttctgctggggaagcacagtgatcatgacatggcctgagcaatgcttcccaggagccgctttcttgggtcacagaaatggggatgggccggtagcccgaacaaggccataagaccgaggagtaggagaaggcaacttccattggttgtcttccgttcttgtggcaaataagggcttgcccaggtcagggcttattctaacaatttctttcctgttgactccccattgccgtttgaggga

SEQ ID NO: 495907 - DNA, 786 bp, Homo sapiens
  misc_feature (185)..(185): n is a, c, g, or t
  misc_feature (188)..(188): n is a, c, g, or t
  misc_feature (192)..(192): n is a, c, g, or t
  misc_feature (388)..(388): n is a, c, g, or t
  misc_feature (457)..(457): n is a, c, g, or t
  misc_feature (464)..(464): n is a, c, g, or t
  misc_feature (475)..(475): n is a, c, g, or t
  misc_feature (477)..(477): n is a, c, g, or t
  misc_feature (485)..(485): n is a, c, g, or t
  misc_feature (500)..(500): n is a, c, g, or t
  misc_feature (503)..(504): n is a, c, g, or t
  misc_feature (506)..(507): n is a, c, g, or t
  misc_feature (518)..(518): n is a, c, g, or t
  misc_feature (520)..(520): n is a, c, g, or t
  misc_feature (547)..(547): n is a, c, g, or t
agttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaangantgantcccacagtccctctatcacatatgcatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcnctgggggggttggggtgggcttggacacaggtgttacagcgtgctgtagtggaagttttgtatcatagnatcctgnttccactttgntntactctanccaagattgactgtnttnnannaaatgtgaggntnttggtcaatcggaaacccccgtacacncctttttgtttctctttctttcgtttttactaaacatttttatgaagaatatatgggagttgtccttccacactaatagtgggtccaagcttaactggtcatatttctttttacattcacaataaccctcttcaaatgggggggggggggaaaaaagtttagcctttctcagataaattttggggaaaaaataaaagcccttaattatgaaaacttaaagggttaaaaaattacacgaa

SEQ ID NO: 495908 - DNA, 405 bp, Homo sapiens
agttgattgcactttgtcacaggcgccctaatgcaccaaccatgtatcctttacctcctgctccagatactcacgttgacatctacggagcctttcttttaaaactttgcttcacacacaggagcctttgtgattacgtaaaatcaacttctttctactagttactggatcaacttccaagatctttatactgtgtgacaacatacgtacggccgcgtattgttactttgtccttgggactcacctttggagtttcgggttccaacacgtctagcactcacgactataatgtcgacggtgttaaccccctttacggtacgcacttacctagccctttaaagatttgtagcacacatgaactaaattactgctctccgtaggccattcacttctccacgggtatac

SEQ ID NO: 495909 - DNA, 656 bp, Homo sapiens
  misc_feature (336)..(336): n is a, c, g, or t
  misc_feature (405)..(405): n is a, c, g, or t
  misc_feature (412)..(412): n is a, c, g, or t
  misc_feature (423)..(423): n is a, c, g, or t
  misc_feature (425)..(425): n is a, c, g, or t
  misc_feature (433)..(433): n is a, c, g, or t
  misc_feature (448)..(448): n is a, c, g, or t
  misc_feature (451)..(452): n is a, c, g, or t
  misc_feature (454)..(455): n is a, c, g, or t
  misc_feature (466)..(466): n is a, c, g, or t
  misc_feature (468)..(468): n is a, c, g, or t
  misc_feature (490)..(490): n is a, c, g, or t
agttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctggatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcnctgggggggttggggtgggcttggacacaggtgttacagcgtgctgtagtggaagttttgtatcatagnatcctgnttccactttgntntactctanccaagattgactgtnttnnannaaatgtgaggntnttggtcaatcggaaacccccgntccctgcattgttcatttccctctttttttttgtacttaaacgagtgtatgatgatttaaatgcaagttggtgctcacgaatataaagttgcttttattaaagggcggaggcttaatacgcctgtatcttatttccttcttgttcacttttctcaataaatttata

SEQ ID NO: 495910 - DNA, 223 bp, Homo sapiens
tgcgataatcatgtggtttatagtcatttgttatgtttacacagatagattacggttattggtttgcatatgttgaaccagccttgacatcccaggtatgaagctggcttgatcatggtggataagctttttgatctgctgcaggacttcacgtttcccagtattttattgaggactttctgcgtcaagatatagataggggctcctctacgagtcgaccctg

SEQ ID NO: 495911 - DNA, 100 bp, Homo sapiens
  misc_feature (1)..(1): n is a, c, g, or t
nggaaggaaggaaggaaggaaggaacgaaggaaggaaggaaggaagggaaagggaagggaaggaaggaaagagaggaagacgacgaggaggaggaagatg

SEQ ID NO: 495912 - DNA, 134 bp, Homo sapiens
gactaaatgctgggggcagccaggccctgctctgcctcgtgcttctaaagacaacacagaacttccagcccgctcgtgccccaagccaatcgtcttacgtttcaggctcaacttaggtaaaattctagcctgcc

SEQ ID NO: 495913 - DNA, 160 bp, Homo sapiens
  misc_feature (32)..(32): n is a, c, g, or t
ttacacacccatcggtgaggcaggagtcaggncgatgatgacacaggggggacctgatactgccagattcaggataagtttcagagtgtgaatggccaagacgtggggatcagttggatttgctgcggctcggcagcgacccctgtcgggctagtcgggg

SEQ ID NO: 495914 - DNA, 879 bp, Homo sapiens
tactcggcgcattatctatgctccatgtgcatctggtgtcccttttaatatatgttctggcggccattcctggtgccttccgggactctgtcacgccctgttaatggctgcctgtttcagccggggcctcctgtggtgagccaagccctttgccactataccgggccctaccacgcccctggcggttctcgccatggtttttttccgccctctcgaacccggggtaccataatccggtccgggatcgccccgcgcccccgtgtgtgtttcccgcgccccagcagggaccccgatgttttttagagtggtccctgacgctgccgaggtgccttgcccttttgttaccccccgcgtccctggattggtccgcccggggaaaattggcccctactcccaaaaaacactggggccgcaaaacatttctcgtcgacattcgtgaactcttctcggggcaccccaagaccctacaaagggtcgttttttacacggtgcacgaatgagggaaaactcttggggctgttctcttttttaatcggtcacaacccaagcacgggcccaagggcccactgggaggaagtttttcgaaagctctcgacgtcttgcgcaatttcccacatgcacgaagtcgggtaccaccccaggtgggagaaaaggagtaaagtgtgagcgacccggaggagaaccacccccgcagggagaggaaaggaacacaacgaagagagagggggaatcctaacacggagacaccacccccctggatacaaaggaagcaacagaaaacattgggggccacatccctgccccccccaccccacaagggcccccgttttccccccccgcccccaaaaaattttttgtttgggagccaccccaaaaaaa

SEQ ID NO: 495915 - DNA, 910 bp, Homo sapiens
  misc_feature (27)..(27): n is a, c, g, or t
  misc_feature (62)..(62): n is a, c, g, or t
  misc_feature (104)..(104): n is a, c, g, or t
  misc_feature (122)..(122): n is a, c, g, or t
  misc_feature (128)..(128): n is a, c, g, or t
  misc_feature (151)..(151): n is a, c, g, or t
  misc_feature (153)..(153): n is a, c, g, or t
  misc_feature (159)..(160): n is a, c, g, or t
  misc_feature (182)..(182): n is a, c, g, or t
  misc_feature (186)..(186): n is a, c, g, or t
  misc_feature (192)..(192): n is a, c, g, or t
  misc_feature (200)..(200): n is a, c, g, or t
  misc_feature (212)..(212): n is a, c, g, or t
  misc_feature (221)..(221): n is a, c, g, or t
  misc_feature (230)..(230): n is a, c, g, or t
  misc_feature (245)..(245): n is a, c, g, or t
  misc_feature (251)..(251): n is a, c, g, or t
  misc_feature (255)..(255): n is a, c, g, or t
  misc_feature (264)..(264): n is a, c, g, or t
  misc_feature (270)..(270): n is a, c, g, or t
  misc_feature (280)..(281): n is a, c, g, or t
  misc_feature (283)..(284): n is a, c, g, or t
  misc_feature (293)..(293): n is a, c, g, or t
  misc_feature (295)..(295): n is a, c, g, or t
  misc_feature (307)..(308): n is a, c, g, or t
  misc_feature (311)..(311): n is a, c, g, or t
  misc_feature (313)..(314): n is a, c, g, or t
  misc_feature (317)..(317): n is a, c, g, or t
  misc_feature (320)..(320): n is a, c, g, or t
  misc_feature (329)..(329): n is a, c, g, or t
  misc_feature (331)..(331): n is a, c, g, or t
  misc_feature (335)..(335): n is a, c, g, or t
  misc_feature (341)..(341): n is a, c, g, or t
  misc_feature (344)..(344): n is a, c, g, or t
  misc_feature (346)..(346): n is a, c, g, or t
  misc_feature (355)..(355): n is a, c, g, or t
  misc_feature (357)..(357): n is a, c, g, or t
  misc_feature (365)..(365): n is a, c, g, or t
  misc_feature (385)..(385): n is a, c, g, or t
  misc_feature (390)..(390): n is a, c, g, or t
  misc_feature (394)..(394): n is a, c, g, or t
  misc_feature (396)..(396): n is a, c, g, or t
  misc_feature (398)..(398): n is a, c, g, or t
  misc_feature (407)..(407): n is a, c, g, or t
  misc_feature (416)..(416): n is a, c, g, or t
  misc_feature (419)..(419): n is a, c, g, or t
  misc_feature (421)..(422): n is a, c, g, or t
  misc_feature (428)..(428): n is a, c, g, or t
  misc_feature (438)..(438): n is a, c, g, or t
  misc_feature (449)..(449): n is a, c, g, or t
  misc_feature (452)..(452): n is a, c, g, or t
  misc_feature (455)..(455): n is a, c, g, or t
  misc_feature (466)..(467): n is a, c, g, or t
  misc_feature (511)..(511): n is a, c, g, or t
  misc_feature (516)..(516): n is a, c, g, or t
  misc_feature (518)..(518): n is a, c, g, or t
  misc_feature (538)..(539): n is a, c, g, or t
  misc_feature (541)..(541): n is a, c, g, or t
  misc_feature (547)..(547): n is a, c, g, or t
  misc_feature (550)..(550): n is a, c, g, or t
  misc_feature (558)..(558): n is a, c, g, or t
  misc_feature (565)..(565): n is a, c, g, or t
  misc_feature (592)..(592): n is a, c, g, or t
  misc_feature (611)..(611): n is a, c, g, or t
  misc_feature (614)..(614): n is a, c, g, or t
  misc_feature (643)..(643): n is a, c, g, or t
  misc_feature (679)..(679): n is a, c, g, or t
  misc_feature (723)..(723): n is a, c, g, or t
  misc_feature (830)..(830): n is a, c, g, or t
  misc_feature (896)..(896): n is a, c, g, or t
atgaacaaaaaagaaggaaggatcggnccggaattccgggatgtgaaaacaacaccaaaaanacaaaaattggaaaggaaaagaatcaaattaaaattgtcgtnattggaaacgtagattcnggcaantacaaaaatactggcaatctgancnataaanncggtggtatcgacaaaagaacnattnaaaaanttgagaangaggatgctganatgggaaanggctccttnaagtatgcatgggtnttgganaaantgaaagctnagcgtnaacgtggtannannattgaaatntncttgtggaaatnnganannagnaantactatgtnantatnattgangcncnaggaaaaananactttatnaaaaaaatgattataggganatctnaggntnantgtgctgtnctgattgtngcngnnggtgtnggtgaatttnaagctggtatntcnaanaatgggcaganncgagagcatgcacttctggcttacacactgggtgtgaaacaacnaattntnggtgttaacaaaatggattnnantgagcnacnctacagcnagaaganatatgaggaaattgttaaggaagtaancacttacattaagaaaatnggntacaaccccgatacagtagcatttgtgcnaatatctggttggaatggtgacaacatgctggagcnaagtgctaacatgccttggttcaagggatggaaagtcacccgtnaggatggcaatgccagtggaaccacgctgcttgaggctctggactgcatcctaccaccaactcgtccaactgacaagcccttgcgcctgcctctccaggatgtctanaaaattggtggtattggtactgttcctgttggccgagtggagactggtgttctcaaacccggtatngtggtcacctttgc

SEQ ID NO: 495916 - DNA, 172 bp, Homo sapiens
cggggaacccgaggattaaaaaatatctaagagatgtctcaaaccagttacatactgaccttattcggatcctgattaaaacaactacggtaggtattatttaataaaacagacatttatgacaccgggggaaatgcttcctatccaaattaagaagggtttttaaggggaa

SEQ ID NO: 495917 - DNA, 343 bp, Homo sapiens
  misc_feature (93)..(93): n is a, c, g, or t
  misc_feature (173)..(173): n is a, c, g, or t
  misc_feature (194)..(194): n is a, c, g, or t
  misc_feature (252)..(252): n is a, c, g, or t
  misc_feature (328)..(328): n is a, c, g, or t
gcactgcgcgaatcccacgatcaggttgcggatgtcgtcgaccgagccgcgctgattttcctgggcgcgaacgagcacgtcgatcttgcggtngcggaagctgtagcgcgtcgccaccgaacccttgaccttgttgacgacctggtcggccacctgcttcgtggtcaggccgnagccggcggcgcgatcctgancgaaacggatctggatttccggataaccgccctcgacggtcgacttcacgtcggcaanaaccgacgaagcgttcatcaggctcgtcagcttcttgccggccttttcgagcgacgcgagatcgtagccgcgcaantcgatctcgagcggc

SEQ ID NO: 495918 - DNA, 309 bp, Homo sapiens
gggggcattttgaagaaaaccccccctggaataaacccaggttaaaagaaaaaaaaggggaattaaggtttccccctttttgggccgaatttgaaatcaaggtttttgaaaccggtgaccccaaggtttttttttttttttttttttttttttttttttttttttttttttttttttttttttttttttttttttttttttttttaataaagaaccaattttttttttacttaatatagattcatataaaaagaacacacacacacaaacacaaacgtgtcttaatatactctctatagagtctagttc

SEQ ID NO: 495919 - DNA, 176 bp, Homo sapiens
agcgtgcctcaggtgtaaaaaaaagcaacataagcgaagagtggagtcggaggttaaaagtctctggataacttttccaagcgggtggaatgggagctagggtgaggaaagggtgctttgtctcagaaccagtcctttagcttcctgacctctgtgctggactgagcaggcctcct

SEQ ID NO: 495920 - DNA, 259 bp, Homo sapiens
ttgcatttctggacgactgttcaacaccaatgccaggattctggccaccctgaccgctgcctgttgcccacgcactgcccggaagccatgatctgcgtcatgactggtccggatctctttctaccatccccatcacagcataagtttgcaggaatcatggagtgtacaagcccgacaataatcttcggcgtgactatcctgaaccttgtgcgagccaacacctttgttgcagagctgaagggtttggatccagctcgag

SEQ ID NO: 495921 - DNA, 208 bp, Homo sapiens
gacccacgctcggggcctactcctgctggctgtcaggcggcgtgggaggccagcactgggcctgcctgggctataaccatttatagcactcctgagagcctggactgcctcctacttgggcccggaagctagtccctccccctaagaccccgcgcctctgacggggcttggacccacgtcctgcgctggacactccttcttggcttcc

SEQ ID NO: 495922 - DNA, 150 bp, Homo sapiens
  misc_feature (142)..(143): n is a, c, g, or t
taaattcccggcccgtcgacggggggagaaggctcccctctctccctccctcccactccttttctacggcgatttgtctgtgtctctccccccctccctccccaccccccattgttgtctggatgtctctctattttttatnngtctcct

SEQ ID NO: 495923 - DNA, 211 bp, Homo sapiens
gaggagaaagagggagagagggaggagggacggaggaaaaaagaaaagaaaagaggaaggaagggaggaaggggtttctccctcgaccacagggaccccagaagaccccgcttctgccttgtccgcacacccgggcctgtcacccttgcttttccttgcctcttactttgacttgtggattgtgctgtaagactacacaggaattgcatcg

SEQ ID NO: 495924 - DNA, 90 bp, Homo sapiens
tgctctcttctccccactgtgcccgtccgcggaccggggacccttccccgtgccctaccccctcccatttagctgctgtctgtgacatta

SEQ ID NO: 495925 - DNA, 245 bp, Homo sapiens
  misc_feature (37)..(37): n is a, c, g, or t
  misc_feature (77)..(77): n is a, c, g, or t
  misc_feature (103)..(103): n is a, c, g, or t
  misc_feature (106)..(106): n is a, c, g, or t
  misc_feature (112)..(112): n is a, c, g, or t
  misc_feature (121)..(121): n is a, c, g, or t
  misc_feature (133)..(133): n is a, c, g, or t
  misc_feature (165)..(165): n is a, c, g, or t
  misc_feature (203)..(203): n is a, c, g, or t
atggggcttgaagtaaaacagcccatcctctgcaagnccatttatgttgtttttaggcattctatctttgcccaaantgttgaaggatggggatttgtttcanggnttttgnatttgagtntaaagcccgttntaacatgataaaggcaatgcattattgggganccccggttttttggaaaagttgatattttaggaattgnatttcagattttaaataaaatttgtttttaaatttcaaagca

SEQ ID NO: 495926 - DNA, 311 bp, Homo sapiens
ctacatgaacaaaagtcattaaaatgcacagtgaggtaacataattattcatatatagctttcttaaggctgagtactgtagtttcgtttattgtataaaggctcagttggtacttagcataatacatctcaagacatccccccttaagtgacccccttccaacagcttaggaaatcggcaaatttcccaggtacatacaatatcatgcatttgaatcccccaaagactgaggagggagcaccctgagcttgcatgcagtcccctcatattgcacaaagtaaaatacaatgtctggagcccccatggtaga

SEQ ID NO: 495927 - DNA, 342 bp, Homo sapiens
tcaacgctttatacttctactagtgtgttcactcccatcatgcatagtcggtgtcgggtccgacccagcagacatccgagtcatcctcctccggcatcaggagaatccacagtgtgcactttctgtcagccagtgggcaacagacaaagtctatccctcagaactggtcaattccgcagggcagcaacatgccgtagtcttgcaagttggtactcttctcacggcatgtctcttaggcgacggcgtgccagtgaagatgcagttcgcatacattcatcctctccgggtgtaagaatcggcacttgtcaggaacgagaagggcatcatttacaaattcaccaa

SEQ ID NO: 495928 - DNA, 353 bp, Homo sapiens
  misc_feature (31)..(31): n is a, c, g, or t
  misc_feature (163)..(163): n is a, c, g, or t
cattagaggaggattcttttagtcagtcttncccctagtgttactgccagtacatgaagtactggttgtctaagaaccaagttgtgctcaggaataaagtgttactagtgaagttccctctggaaaaaattagtgggtttcagatcatgcctaataggagagnaaaactattactgcatttggatgtttggtaattctactctgatcttttttctttaaggtaaatgcataggaccaatgatgtatggtacaaaattactcacagatgttggaaagaatttccttagcatttattcctgccatttgggacacacatgcctctgtatagtcatttgtttgaaaatttgctcttt

SEQ ID NO: 495929 - DNA, 456 bp, Homo sapiens
  misc_feature (218)..(218): n is a, c, g, or t
  misc_feature (220)..(220): n is a, c, g, or t
  misc_feature (227)..(227): n is a, c, g, or t
  misc_feature (235)..(236): n is a, c, g, or t
  misc_feature (339)..(339): n is a, c, g, or t
atgtcacacgacagtcagtgtaacacgcactgccaatgtaactcgagcgtccaatgttaaaggcacggcaatgtaacacgcacttcagtgtctaccacgactggctgtgtacaatgtcacgctctgttgagaagggtggctcctgttaaacgattccgtgttctactgaagcgagcaatatggccagcatttgcggaagtcgagtagacagctcatantnacatcgnacagtttnnggatactactgaaacaccgtatttaatgaagagcatagactgcatccgagccttccgggaagaagccattaagttttcagaagagcagcgctttaacaacttnctgaagcccttcaaggagaaagtggaaattaaacaattaaatcatttctgggaaattgttgttccaggatggaattacctttgatcaccaaaggaggaggcctttggagttctttca

SEQ ID NO: 495930 - DNA, 865 bp, Homo sapiens
  misc_feature (865)..(865): n is a, c, g, or t
tgatgtggtacaggggcagtcagtggagggcgagtggtttcggaaaaaaaaaaagaaaaaaagaaaaaaaaaaaaaaaaagagtttttttttcttccttttgtaaatctgggaaactgggtgaaggggtgctgggcattattttttcccacaggtgggggggggggggtaaaatatattaggcgatgtgtgtttactcctgtggtctatattctgttttaagaagaaattttcggtggtatataaacgaactgtgtgtgtgagcccaagtttttttttagaaaatataagcgtgggtagaggcgaatacacttctttaaaaaagagcgacgagaaaaaagagagggggcgggcataagtgtgtgtggggaatctctcttaacacaaagcgaaaaaatatttatcaccaccgagagaccttttgtttctacaaatctctttttaaactcttcttttaaagaggggagtatttcaacagaagagggcaaacatcctcaaaacaatactggtgtgaggtgcgtgggggggaaacattttttgatacaaagaaaaacaaacaaatatttcttcaaggggggggaccacaaataaattttggttttgttctctcctacagagggtggggtgatgtaggaggcgtagtatatagtattgctcccctttttaataataggaagagggtgtggtgtacaacaactagttgaggcaagcaaaagaagaacaacctgttgtggttgtttatattatattctctccctccttttttttccaaccaacccgagggaagaagatggttgctctcccacaatatcttcccctcttgcggagtttattattgtgcgtccattttttttttttcaccgctn

SEQ ID NO: 495931 - DNA, 305 bp, Homo sapiens
  misc_feature (67)..(67): n is a, c, g, or t
  misc_feature (69)..(69): n is a, c, g, or t
  misc_feature (76)..(76): n is a, c, g, or t
  misc_feature (84)..(85): n is a, c, g, or t
  misc_feature (188)..(188): n is a, c, g, or t
catgtcccacaagatccgccagagtagacccagtagccccgcagccttgagtacgtaccgctcatantnacatcgnacagtttnnggatactactgaaacaccgtatttaatgaagagcatagactgcatccgagccttccgggaagaagccattaagttttcagaagagcagcgctttaacaacttnctgaagcccttcaaggagaaagtggaaattaaacaattaaatcatttctgggaaattgttgttccaggatggaattacctttgatcaccaaaggaggaggcctttggagttctttca

SEQ ID NO: 495932 - DNA, 1570 bp, Homo sapiens
gatagctcatgatctgcctgccatatgggagataccaatacgatgtcgtggcaattaccagcgagatagaacctgataagacgactctatggacatcttggagatacttctaaattgcaagtctgtccaggagcccttttctaccatgtgtgcatttagcggtactaacaaatgggtactggcgaattgggggcctggtcgactcatggatggcgtaaccgtacaaccctcatatggtcttgggcatcgcggtacagtggccgtagtccacatctggtgtgatactgaagcagagggactacttgtctacttgccggagtggtagcaagatgcttccaatgaatgtccaggggggttcggcgattacgctgttcgggtggggttcttctcctatacaatctcaagtaagaactaaactctgttcgatgcctattataggcaagaaatatttcctagtcaagctaactgacgacaagtaggtttgccaatagatatgtcacatatcaataagttgggctgttccgtaaacctctctatttacgggtgtggatacgtagtcccgaacttaattgtcaagtgcatcagcatgtcacgaagctaaagtgcgagggtttgcgaacgatacctacgcgataccattccctcattggtgtggccaggaatgttcttgtggccgtcaggctttggacactatgtgagtaatttggcttagcttagattaacggtatggaatggcaaaaaggatgacaggagtgtaacataatggctgaatggccaagcctatcacaccgtgattgatctcgagaggagaaatacttttagttaacgccccaattcattggaccggcactaagttttcctataaagttcatccacatagtcattcctctaattaagcccgatcatgcacttccttttacacaacatttatcaggaaggctacaattttaagccttgactttttattgaacccaactgcctattggacggtggagtcaccaaggcttatttcttccaacatatcttggtacccaggtactaggcaattcactcgaagtcgcaatcttgtttatatacatgcgtaacacgtcaagagaggtgcaaaggacacaggtttaaagggaaaaaacgcgtataggatgtcgctcaaagattaagaatatgctaatggagtcttacaggagctgggcggaccatcgtagggtcttgtcaacaggcaggtatgtattaccttatacatcggcaacgtgtcagagaacaataatcgcgcgcgaagagaggaaagaaacatagaaggaaaacaagtcggctgtccaggaagtccccccaatggcccagacaaagggacagcgtcaccggaacacgtggacgcacaaggtcgccggcgctgaggaccatacggatcccccgcacggacggaggcacagaagagcctcagtaggcgtgaaggagaccacaggataacacaacgacgggagcacgacacatcaaaggggcgacagagacacaatagtggtgcagcacctagcggcacgcagccacagatgacgagggacagctagagaacaag

SEQ ID NO: 495933 - DNA, 404 bp, Homo sapiens
ccctatttctatgatgcttccccgggcatctacgaggcatggatgtgggtgggaaaaagacaactggaatttactcgaacggtggctgggtccgcacggttgaggattctacgtggttctcttgtgttcccctgtgtgagtgtgtgtgtcaagaaggccgcggctcattagatcaccttcttgagctcgtcgtacaggagcagcactgaaggcgccccccatgcgccgaaggatgttggaccacgcacccttgaaagaaggccttgcccccctcatctctgaagatcttcctccaaacagtcgatggtgcccgtgtacatggatgtcaaggcctcctttgcgcccgggactggatcatcatgcgccgccgcaccgtgttgacacggggtaggacaccacgccgg

SEQ ID NO: 495934 - DNA, 476 bp, Homo sapiens
  misc_feature (81)..(81): n is a, c, g, or t
atttactcccctgacactattattgggggggtccccttttttcccttttccaaaagggggggcctccccctttgtggggangagaattttaaccgaaaggtttgggaggccctaaaacccccccgggcaggttttttggtgggggaaaacacccgggtcaattgcctgggggggatttacaatggcatggttttgggcacagggttttgggaaagtttccccaaattttggaacaaacccccggggcgtgtggggcccatggggatgggaagccccttcccttttgggggggtttccccgggaggaaattcctatcccccgggtttaaggggggccccccccccccccccccaaaattttaaaaggggaagattttttttccttccctttttgttgaaaccaagggcccaattccccttgaaaaaaaaattttttgggggtaaaataaaaaaaattgggctttccttccgggggca

SEQ ID NO: 495935 - DNA, 155 bp, Homo sapiens
  misc_feature (67)..(67): n is a, c, g, or t
  misc_feature (107)..(107): n is a, c, g, or t
  misc_feature (137)..(137): n is a, c, g, or t
  misc_feature (141)..(141): n is a, c, g, or t
gtaaattatcccatagtgaaataatggaacattgtgtcaccgttaaaacggtgggtgacattttggnaggccaaggcgggtggttcacctgaggtcaggagctcganaccagcctgggcaacatggtgaaccccgtntctnctgaaaatacaaaa

SEQ ID NO: 495936 - DNA, 151 bp, Homo sapiens
aagctctctctgttgggggactaggcaacagctcaacccaggagtctggcaggatgggagtgaggaatgccatggatgatcagacggataatgtgctagtgatccagcctcatgaggaagacggatttttctgtgaagatgtacatgtgtg

SEQ ID NO: 495937 - DNA, 896 bp, Homo sapiens
ttgcaaaacagggctaggtactatgcctcgtataagtacggacgaggaatagcgtaatatatacaaagaaagttctaccgctacccagacatagggtaccctacgtgctaacctagcctacggaagcgcagcagcaggcatacgctggtgaaggtagaagagctataccctaaaggatagacccataccaagccggtaccacctacacagcctatacctagggataacaaggctaggccatagactacacatacgtagcgggaagtacgacagtgccgtgataccaaggtagaacaaaaagggaggtaggtagagaggctagtagaccatatgtaaagagacaccacccataggtaggtttgtagggcatatgtgggtgctaactgtaggaaacccctacgaggcctaccgagacctatacaagactagtactatttgctagagcacatacagttgatagacatagcacagagagcgtaatactaataaaggaatattgtgcataaaatactaacagaatgatagggcctttacccaaagttaactagcaaagcacaatagcggcagggatagaaggcgatagtgccaacggaacagcagcttaggcacgcaagggcacttatcgagccacagccatagcaaggaagcgtaactaggccctaatgttaacatacccgttagtacaactatagccacaactacgccagaatagcggcctaagctattaccctacttaagcgcccaggcaagggaaacagggctccgagcctaagattaagagagcatacccgcgggtaggagcacggtgcagagcactttagtggctcggagaaaggctaggaaacttggggcccccgaccaaaaaggctatagagccaacacagggtacctagtag

SEQ ID NO: 495938 - DNA, 1129 bp, Homo sapiens
gggttacacctcttgagacttccgggcatggtaaaggctaacctgattaaccagctgtggaacggtttgcccctttcgcgcctggtaatttcttcatgcgtgggttttccccacttttatctggccgatgccacatctatgcatgtaccgtggccccttatctgtggcccttggtgcttcatctcaggatatactggttatgaaccgctcatggatacaatggatgttccgtctttcgatccagcttcccattgcctgctacttgatcccgtggaccatccgtgttcccgcggggctccatggttcattgaagggagtcgatcgagtagatgcatggtccatccaggagtaagaacatcagctacttcgtggagtggattcccaactatgtgaaggtgtccttgtgcgacatcccgcccactgcggcgctgaagatggcctctcaccttcatcggcatacagctcggccactctcaggagctgttcaagcgctatctctgagctagttctcagccatgttccggcgcaaggccttcctgcactggttcacgggtgagggcatggactgaaatggacgttcaaccgagtcggagagcaacatgaacgaccatggtatccgagtaccagcagtaccaggatgccacacgccaatgacggggacggaagcttttgaggatgaggaacgaggagagtcgatggatagtcggaatagatgccgccctcaactcagatcctacaacacgcaagttccttcttgaaccctggtgcctcgatccctatgggccctgaatggtgcatctggttctaattcgatgttggtgtcaggccgcgctgcacaatatgcagcgcaagctcatgtaacgtagtcatctggaacatagacataaatacaggcagagaattgcgggttactactccagtcagaagataacaccatggagacttgtctagctagaggacttgaaagaggaactgaggggctcacaaaagtatacattcaccatccacttatagtgtttcatagcatgtcccgcaaattaggagggaagttagataacagtctctttcatcatattgtgatgaagcctgtaagtgtgccgtgatactctagagaatatgacaggtactt

SEQ ID NO: 495939 - DNA, 105 bp, Homo sapiens
ctccggtccataccataatcgccgatcttcacgagatcggcgattttgggctgcacaacaagtgacatgaagggagggtccctgtctggaggttcggcgtgtgca

SEQ ID NO: 495940 - DNA, 181 bp, Homo sapiens
gtctttgtcatttgattgatttgtatatggtgagataggctttagcttattcttctgtatatggatatccaccttccaagcaacacttattgaggagactgttctttcccagtatgttttcttggcatctctttaaaaatgagttcactttagatgtattggcctatcttggggtctctat

SEQ ID NO: 495941 - DNA, 167 bp, Homo sapiens
ttttattcttgtgaatgaaggagcagacacggttatttagaggaattcacatacatcacacaagctaactcttggcttttaccaccactgctactctcaatggcgcagaccgtgctgaccaagttatctgaatctgctgcataattggaacatccaacaggtctaaa

SEQ ID NO: 495942 - DNA, 356 bp, Homo sapiens
tttctcacctgtataggttctctgttatataatgagagttgacttacaggacaaaaccttcccacatccactgtatccgtaagatttcattcttgcatggcaagtttttcgatgcttactgagacctgtcttttgggtgaaagcttgttgaccttcattgcatcatagggtctctctcctgtgtgaattggctgatgagtcatgagatataccttactggagaaggccctatcacagtctgagcattcatatgatttatttcctatatgagttctctgatatacaatgagatttccctttgatgtgaaggctttatcacatacattgcatatgaagggtttctcacctgtatgggt

SEQ ID NO: 495943 - DNA, 167 bp, Homo sapiens
acagactagtagagtagatgtgggcttatgactgccaagtacgcccagtacagtagtttattatcactaaaagtaggacacatagatggagtcctgtagatagttatcagtgttagtctacagattttatccacctatacatctgatgcattttctactttagagtg

SEQ ID NO: 495944 - DNA, 247 bp, Homo sapiens
tcccaagtactgggattacaggcataagccgccgtgcccggcctgtcctttttttttgtttgtttctgttgagatggagtctcgctctgtcacccagaggtggagtgcaatggcgcggtctcagttcactgtaacctctgcctcctgggttcaagcaattttcttgcctaaccctcctgaatagttgagattactggcatgcgccaccacgcctgggggtttcaccatgtaagcttggctggcctca

SEQ ID NO: 495945 - DNA, 250 bp, Homo sapiens
tcacaggcactgagtcacatcttctgcaaactcagggtgaattcttgccgaaatggattgccaaaacggtcaccagcacatctcccaggagcttgaagttctcagtgatccacatgcagcttgtcacagtgcagttcactcagcgtgggcaaaggtgcccttggagatcatccagggtgctttatgagcatctccacagaggaagtcagcacgcttcttgcgcatgtcgccttgctcttatggggttgcc

SEQ ID NO: 495946 - DNA, 1282 bp, Homo sapiens
cgggatttggccgccgcggggctccggagcctgctcgctccctgacacggctcactgatgctgctggctgagcatgtggctgcggtggggtgccctgcgtgctccatgttcactaactgcctgtgatcctgcgcggagggaaactgctcaggaggatctgtgtggtgcgctggagtgccgcatcttgtgacccagagaagctgttctttgaggagcggctgctgatggcctgactgatgcgtgcgtggactgctggtgggccgcatacttggcatcccggcattcatctgactgtgcagatcaaccgggtggattttggttgttgacttctctcacagccacggaggacgtgcggttcggcgggttgccctcgtggcccggacggatcctgtctgcactggctgtcacctccttctgccccaccctggtcacttccccacctggacgtgtttatcacagctggtgacggttgttcctcacgatccctgtgcacgacgctggctgggtcccgccaatgggtggacaagggtgtttccatcaggagtgcaggattggcttggacgcattacctacgtaggcaacgtccatctcagtgtgtgcgcgacagcgactgtagatcagcactatgcctcttaatcgatcagaccgtgtagccaggccaagaatcataggcgccaaccatcgacaaccgccggacgtgtgacggtgttggtgctatgacgtgcgaggacagtacggactaccaggcgcgacatgtgctgagttgaaggaggcgagggggctcggcactctgtgtcccgcgattggatggtgcggcatgtctagatgtcgttccgctttacagcgattgaggagcggatgcgcatgtccgttggctgtgcgtccgtcggagggtagggattaacatgctcgtcgtgcggtcctccgcctcggggcccggcgggaaagcgcgggagagggcgaccgcggcaacagggccggcggcaggggggcgggagagcgcgccgcgggacgcgcccctccgggcgaggcggtcccacgcggagggcggggcccggcggcacggcggagccccggccgcggcggaccggccagccaccaagctgcccgcagtaggctcccgccgcccccctgcaccgcagagtcccgagcacctccacccgcggcccggactgttccacgcgcgctcaggccatctctcgccatcgtgcccgctagagcgccgcccgccacacacggctccccgctccctgcagggcccgctgcggcgcgccggcggcgg

SEQ ID NO: 495947 - DNA, 168 bp, Homo sapiens
tgctggtaccccccgttcctgattgcccatggtcagagattgggtggtgggcatatgtgtcttgtggggggtctgtgcgctgcagcgtctccttcctgttctccaggtatctgctgtgagccactccacgcactgtgccatccaggtaggctctcaactgctccgcct

SEQ ID NO: 495948 - DNA, 246 bp, Homo sapiens
  misc_feature (124)..(124): n is a, c, g, or t
  misc_feature (200)..(200): n is a, c, g, or t
cccgatagcccgacagcatcccccaagtatgggaacgtggtctgtcggatgcctggtccaggtcttcttcccccaggagccactcagatgtgacctggagcgaaagtcggactagaactgtgancgcctagaaacttcccgatctagctcgggatgcctcctggggacctgttccccacgatgctgccagccgatccctntctggctagttctggggggtaccgacgctcgacagttctgtaattc

SEQ ID NO: 495949 - DNA, 460 bp, Homo sapiens
gggagtgtaaacaggaggcgatagtataactcgtgtatgggagtaaaagtatggggtcaaaataagggatatggaataagagatatatgtgcttgtaataggtatgtcgtgtcataaagtaattccgctctgtacatatctttcgcttttttactgttactgacatagtatttctgtctgtactctggaccatatcttttgttgattacatgttaggatcaccatcttcccttggtctatgcttcctttatttattttcatgttttctttacaatctcaaacttttaaactacaaaactactgaactcaactttaggtgcctcattcttccctagctaaaggtcataaaagttgtttcagaattttttctacaaacaaaacaaatttgccttttaaatttaggtatttaatccatctggagatgtgtttagtgtggtttttataaggatctagtattttt

SEQ ID NO: 495950 - DNA, 978 bp, Homo sapiens
catttctcccgagtcagcttaccaccctggtgctttccgaggatgctttcgcctgctgtccccaccactgcatgacatgatctctcttaactggagacagcagacaaatctggaactgggacttcacacggcatatggacgtgtttattccatgttcatttgggactgcattctctatttaatgactacagccactacctggcatcataggacaactgttttcataactgtagacctggcattgcgactcttatgtcaatttgagtttcagcaaagcaacacttccagcattcattcattcccaacacagcatccatgcaacagctacagcgttactattactagcggctgtgtgtcatttagctaggtcacttcatttggctcgtgcccttctgcatcaggcgatgtatctttctgcacaattttacttggcatcttatatactcatctgcgttcagaggtgcgttccctatcactgttccgcttgctcgggcatttcatttaccaagcagttgcctcgctcctctgtgcattcccgtcacttacactattcaccctgtcacatttagcatctattcatgtcatgactacaagtatgtgcagcaacagccaacacctcataggtcattcacacaccacggtgacactttgcaggacgtcactcttctcctagtaggtgttagtcctatcaagtcgcttctgcgtgagctatcctgcccccatccacttctattctccatgtacattgtcatgctccatgagccttatcctaggcgttgctcaggcgtctactcacgtaataacaagacgtagcaagccacgcgaacaggtactccgttatatgctacaccctacggactgggtgtttccaggtgacacaccctctgacgtggcgctctattaatgaggcggacagctgtaactacagtactcagatctaccctgtcttatcatatgtatatcttagtgctcgggcgc

SEQ ID NO: 495951 - DNA, 128 bp, Homo sapiens
tctagaggatcccgtctagcctgcgcacgtggacatgctagctcaacatccagaactgcacagaagaaacccaaaaatagctatgccttgacatgcactggctgaggctagtgactgggtacctgagc

SEQ ID NO: 495952 - DNA, 555 bp, Homo sapiens
gagccccacagatctgtgtggtgggcagtggcccagctggcttctacatcggtcccaactacctgtctaacgcacccccaggcccacgtggacatctacgagaaacagcctgtgccctttgacctggtgcgcttatggatgtgcgacgcctgatcaccccgaggtgaatgaatgtcatcaacacaatttacccagacggcccagttctgggccgctgtgccttctggggcaacgtggaggtggagcagggacgtgacggtgccaggagctgcggagaggccataccacagctgtggtgactagagctacggggcagaggaccatcgggaccactgtaaacgacctggtgacggagactgccaggtgtgtgctccgcccgttgtcttcgctgggctggatacaatggcgcttcctgacgaaccaggagcgtggagccagacctgaggctgtgacacagccggtgattctggggcaggggaacgtagggtctggacgatggcccgcatcctactgaccccagctgagcacctgcgagagaacggacaacacgaaggc

SEQ ID NO: 495953 - DNA, 269 bp, Homo sapiens
aatgttttatagacacccctccatttatgtgatgggtttgcatcctgataaacccatcataagttgaaaatatgatcataagttgaaaatatgatcataagtcaaaaatgtatttaatatacctaacctaccaaacatcataggttagcctagcctgccttaaacatgctcagaacacttacattagcctacagtgggcaaaactatccaacacaaaatctatattgtaataaagttataaagaattttgaataaaaattcaatatttg

SEQ ID NO: 495954 - DNA, 449 bp, Homo sapiens
accctgtggtgggaggcatgcaatgaggggtttggcagcagcacgagctggacatggaccagacctactggtaaaactctgtcaaggagaacaactagttgcagtactcccaccacaaacgtgggatccgtgcacgttaacgattactaggactatagcatgaaaccttaggcatatgagggctcttatcatccgtgctaaacagattcagcaaattaggcaacatcaggggtggtgtttctatcttttcctttcccaaagcagcgtcctgccaccacaaacgtgggatccgtgcacgttaacgattactaggactatgcagaaaccttgtttgattttttttttttttttttttgttttttttttttgttttttttttagtttttttttattttttttttttttgttcttccttcttttttgtttctcagcttgttcttagtcttctc

SEQ ID NO: 495955 - DNA, 219 bp, Homo sapiens
atactgatacactcagctctgtacctgatcattcgtgtccccacacgttgtatgcctacggtctactacaaccctttcgctgacgccattaaactcttcaccaatggagcccctaagaacccgccacatctatcatcagccctctacatcaccgccccgatcttagctctcaccgtcgcccttctacttcattccaccccacgatgacacgaatgctca

SEQ ID NO: 495956 - DNA, 354 bp, Homo sapiens
ctcatggctgactctagaggatacactctccctactgtatcctaccaatgacatctagttttctcccaagagaagatctagggccaggcacggtggctcacacctgtaatcccaacactttgggaggcggaggtgggcagatcacctgaagtcagaagttcaagaccagcctgggtaacatggtgaaataccatcgctattaaaatacaaaaattagccaggtgtggtggtgggtgcctgtaatcccagctacttgggaggctgaggcaggagaatcacttgaacctgggagacagaggttgcagtgacccgagattgcgccactgcgctctagcctaggatacagtagggaga

SEQ ID NO: 495957 - DNA, 192 bp, Homo sapiens
ttattaaaaaaaaagggaaaggaaaccaaccttaaaccgggccaaggtaaggccttttttggatttccagggggggtttttcaaggggcccaagttccaatccagtattgccttgccaaagcctctatttcggtctcaaaatggctccaaatgatttctgtcctgcaaattaagcccaattttgggaacttc

SEQ ID NO: 495958 - DNA, 906 bp, Homo sapiens
gatgatatgagattctttatgaaagaacatgaatgtaagttttgtcttgccctggttattagcacaaaacattactatgttagatattgaaataagaaagggaaggaatgagagagagtgaaaaggagagggtaacagaaaaagaggaaagaaaagtaagtcagggaaatattaaaaactgcaagagaaagcaattgaacaacacgacaactaacacgtacgggacgggacacggcgacgacggaacgccaagggacacggacggacacgaacacacgaccacgacgcgacgactcgacacacggggcgacgacacaagactagacacgaaacaactaccttgaacgggagacctccagaacaacctaaagacgaacgaaacggaacagaaactacagagagaacagagacaagaagaaacgagcaaaagaacacaagaacagaccagagagggagacaagagagggagcaaacgggcagagaacacacaacattgtccacacataaacaactcgtaaaagaaactgatcacagacaagtcatggaagacaggaagaaaggaagagagggaagtaacagaggaaaacctataaatattcccacagatagacaaagtcaagcataaaactggagcttgagaaggaaatgaaaggaaaacgaagtggtactttcttttaccctaggagaagacctccatacaggaagacttgtgtgttggggctgggacattagaatcatccgcaagtcactccgaaaactttgaaacttgacaagggtcagagggggaactacgcatttatttaagcattttgccatgtgcccaggcactgacccagacacattataaataccacattgttcaacctgtgtgtggcatctacagaccttagatcctagtgtgagaac

SEQ ID NO: 495959 - DNA, 251 bp, Homo sapiens
gaaaccagaagagccatacagtcagtggaaggcggtggggccctcacctcttcacctggatcccactgggaacctttgtgccttatttttttgtaattggtgacggggttttttttccacccattcctgacctgctgtttactcctcctgctttgcttgcggtattgtcatgggcgcttttggcgactgaatacttgtgttcttgctactggggatcttttgtcctttgctgttggccaaattcatggctt

SEQ ID NO: 495960 - DNA, 195 bp, Homo sapiens
  misc_feature (20)..(20): n is a, c, g, or t
  misc_feature (44)..(44): n is a, c, g, or t
  misc_feature (105)..(105): n is a, c, g, or t
  misc_feature (108)..(108): n is a, c, g, or t
  misc_feature (114)..(114): n is a, c, g, or t
caaaaaaattactttgaatnccttaatatttgctgcattttttnccgtatatataacatgtcttctttcagaatgggaatatatgtgtgcctcctcccccatatnaancccttntgttgtctttatatgtcaaactggttgaacactgtaatgagaataaactgcacagagtttattctgacttaaaaaaaaaaa

SEQ ID NO: 495961 - DNA, 115 bp, Homo sapiens
tctttgaggcagctgtactcggctgagtcgacgtgaagcgccttgagcttctccatccgcatcttccaggagcagggggagaagctcaaggcctacacttgacaaaccgtggaaa

SEQ ID NO: 495962 - DNA, 405 bp, Homo sapiens
  misc_feature (83)..(83): n is a, c, g, or t
  misc_feature (196)..(196): n is a, c, g, or t
gatctagttcccgtatctgagctgggaggccctgacggcgccacggccccaataaggtcacctacaatggctggaggcttgtntgccatgaacagacagtatttcaatgatcttggacagtatgacagtggcatggatatctggggaggagaaaatctggaaatctcatttccggatctggatgtgtggcggcaantcttcatcctcccttgctcaagagtaggacacattttccgaaaaaggcgaccgtacggatctccggaaggccaggacaccatgacacacaactcccttgaagactggcacatgtctgggcttggatgagtacaaaggaagcaatatttttccttaagacctgatttgaaagaacaaaagcttcggggaatatcagtgagcgtgttgaaa

SEQ ID NO: 495963 - DNA, 247 bp, Homo sapiens
agtctgaagagtgtgggaaggacttcaggcagagctccagtctctacatgcatcagagagtccacacaggtgagaaaccctatatatgttgtgagtgtgggaaggggttcaggcagagttcaagcctctgcatccatcagagagtccacactggagagaagccctatagatgttgtgggtgtgggaaggccttcaggcagagttcgagcctctgcatccaccagagagtccacacaggagagaaacc

SEQ ID NO: 495964 - DNA, 204 bp, Homo sapiens
tactagcgagatagcgctgcagtccgtgatgtggtgatgatgactgaagcccgtatgacggcgagcgtcagaaatggtgcatcaccatgcttccagctaacaggtctagaataccagcttgcgaataacagtccccgtggccatccctgtgagggtgacgatagcattacccccaacctcattttagttgccgaagctgggtca

SEQ ID NO: 495965 - DNA, 125 bp, Homo sapiens
atgcacaggtgggagtctttgtatatagtgtaaatatgtctggttatgtcaaaaggaaattttttagacacagtaattgaactgtattccgtttgtatatttaataaatttctgttttcattctt

SEQ ID NO: 495966 - DNA, 318 bp, Homo sapiens
  misc_feature (56)..(56): n is a, c, g, or t
gaggcagtgaatcgaactcggtaccatctcgtgacggcgatatggagagatgtctncgtaatggcagcttttgcatctggaagtcccgccacttatgatcgattgccctgcttatttggcctattttctcagactacttcttgatggtctctttcccctgacaccttactctccccttcctgtcacctttgttctcaggttttctcctctcttgtcacctccatttctttttttcccctcctgctgccacttaaacttttttatcttcctaccaagtttaatcagattttcccttttgtcataatcgccggtcacgag

SEQ ID NO: 495967 - DNA, 353 bp, Homo sapiens
ctcgagctcaggagtgcgaggctgtagtgagctatgatcacgccactgtgctccagcgcgggcagcagagtaagagtctgtctctacagtcccctaaagaagcagacagtgaccgtggagtggcaaatggagacattgcatttgaacttgacagaatgtttttttgcagccaagttatctgtataggcctctaatttcactgtggtgttttattgatgatatgagatgttctttgtctttaggggccttggacaaagggttactgactatgctcatggcgatgccttgcctgctgccaaggcagggctattggcactttcaggtttgacctttgctgggctctgctatattct

SEQ ID NO: 495968 - DNA, 129 bp, Homo sapiens
ggttcagtttgttcagggaatttttgttgaaaaatatgacccaacgatagaagattcctcacagaaagcaagttgaagtgcgatttccatacagtgttatttctcggaattctgggtactgtctagggg

SEQ ID NO: 495969 - DNA, 214 bp, Homo sapiens
tagaggaccgcttacacaggctggctatattactaagaatgatatttaaaaaacagtcactaatgaactctacatattatagaacactcacagggcaatatagattagggtgctactacgacttttacctaacattagtctttctcaatcagtgtatgtacaacggatacgtatatcgatccagtaacatattacagtgtcattagtcttcaca

SEQ ID NO: 495970 - DNA, 136 bp, Homo sapiens
ctgctggttcttaggatttgactcctcataactgaacatgctcagcctgcctcctatacctggtccccgccctgcatctggttttcctgtcctggtggctgctggccaagggagaagtgacagagatgttcagtta

SEQ ID NO: 495971 - DNA, 486 bp, Homo sapiens
cattaacaaaatgaaatctgccacaaatgaccacaccccagtgattttacaggagattgctaccaaaaaagttaagaaacagattatcccaaacttatacaaatgcttccagataaagaacaatgggaacaaacagctcattctataagggtagcataaccttgaaatcaaatcaaacaaaataataaatgagaattcatcctcactcatggctactgaaacagatatcttaaattaaatcagaatttagaaatccacatattcacacatacatgtacatattttttttattgggtttacttcaggaatgcaagcataattttacagtaaaaagctcttacaaatggcacagttgctcgcccctgtaatcccagctacctaggaggctgaggtaggaggaccactggagcccaattgtctaggagtttgaagctgaatgagctataattgcaccctgcacactccagcctggacaccagaaactcc

SEQ ID NO: 495972 - DNA, 169 bp, Homo sapiens
gtgcagcaaaccttggctgctaggtccctgcagctggagcgcaaaaggagagatttcacctcttctgggagttggaaactctacatagacactcatgccttagtgtgcttactggaagacaatgggtttgctactcaacaagcagaaatcattgtgtctgcattggtca

SEQ ID NO: 495973 - DNA, 213 bp, Homo sapiens
tctgctgatgcccccatgttcgtcatgggtgtgaacatgagaaggtatgacaacagcctcaaggatcatcaggcaatggctctgcaccaccacttgcttaggacccctgggccaagggtatccttgacaacttttgggattcgggagggttattgcccacaggccttgcattattgccaaccaggaggtttggatggcccctccgggaaactt

SEQ ID NO: 495974 - DNA, 331 bp, Homo sapiens
atctcaaataaacaaacaaataaataacaaaaaacaaaaatgttgcattaaacttagttcttgtctctcctttccactcttattcttaaatctgaagctcatcgactaagtgaaatatttaaagaagtgcccacacagattagttcatgataggccagcaagaagaagtattatgtagtaccatagttagtaaattcgtaaaccttggaagccattatttggtccacttgcaatttagtgttttgaagtgtgtagcttcattcagatagctctttaaataattaggtatacggcaccacccacctcctactatacaggaaggttaccctca

SEQ ID NO: 495975 - DNA, 242 bp, Homo sapiens
cgttaccctggtgaattttgaagggagacctcttctccaaacacaccccgctgagaagctaagggctgttgcgggaaagttcttactttacttgtgctgaggtccaggtagttagccagcgaaatacaggtgtagatggagcagcagaaagggcctttgaagcttcttgtgttcccaagcaggccattcctgcctgtcatcacaggtatacatcaggaggttgggagttccacaaggggggg

SEQ ID NO: 495976 - DNA, 230 bp, Homo sapiens
  misc_feature (186)..(186): n is a, c, g, or t
tctttgcacgcccatctttttcaccagaatgaggaactccttggaagttactgctaccatcagtgttgatttccaactctttgaaccagacgtctgctaccctttttcctgatatattgaggacactcggtctctagcaatttcttctagtgctcatcctctttagacaggcatggaagattcccnctttatcacgggtagtatcttgtggttagaccgtcgattgggga

SEQ ID NO: 495977 - DNA, 613 bp, Homo sapiens
actcagaggctgtgcatttcagggctatgtggtcctttgtttacctcctaaaccacagctgttgtgtttcacatatgtgtgaattttccttggttctttttaaagagaatgaataaataaagttactgcttttaggtaaaaaaaaaaaaacaaaaaaaaaacaaaaaaaaaaatgttgttgcggcgcgcgccttggcgccccttggaagaagagtttttgtagacacccaattgcgttgtgggcgagcgcggcggccccccgagggggctataggtgggaacacccggggcccaagagcggtggtcccagaggggagagcactccggggcggcacactgagcaggacgaaccgggcgggcggagggaagatctctcttccacccccaaatatataaacaacaaacagcgcgccgcggggagggaacaacaccaggggagggcgtggtcctcgtgagaaaccacaaatctctcccagagagatgtgggggactgctccacgggggggggggcaccatcacaggggggactcatattaccaaacagggggggtgtcacacaacgggacagagccttcgggattatcccaatttttaccgcccggcccggtgggga

SEQ ID NO: 495978 - DNA, 141 bp, Homo sapiens
ggaccggacggagctgtactggaaatatataagtcatttaacacgagaatgctctaaattaaggtctaaaagcattgattacaacaaacactttacctcgttttggtccttgcttttaaattataaatctaacttgtatta

SEQ ID NO: 495979 - DNA, 808 bp, Homo sapiens
ggttgaatgtgggctgctcgcggtcggcgtgccccgatgtacaatgggccgggaaatcgtgggtactgaggctctggaacgttctgcccagctctccttgctagaaaacattcccttcaatataaaaaatgttcccgagtcttaacaccgccagttgagaacgtacgtgatcgttagatgtattgagagtgaataatgagtgacagtaacacctggtgacatcagagaaccttggctttgtgttttgcttgtcgaaatagtatgatgactgtgcctaattataataccggagaaaaggaataacgtggaagggatgaacatggaatcgtcacctgtgacatttatgtaacgtgtttgtgttgaatgtcaacgtgggaactttgtgggcagatgacgggaataggaagaacgaaaggacgttctactggcttgtgctaactaggaacgatattcggcgaaggaacgtgaatagagcttttctaaatgtgaaattgctgttgttttggcagaatgaaatggtgcttcaaatttggactgtgttggcacccccgattgtaaaacgaaagttatcattgtcccatgtggtggactttccatgaggagcaatgttattgttcccagtttttaacgggccgagatttggaggtccaattttgcttggggcccccttcggaacctggtgtcaacattactttccccctcctcaagttacttgataagaagaagtacgtttagcagtgggcaacccatttgggctggggaccttttattgcaacgctaatttccaagcttataacctttttgacga

SEQ ID NO: 495980 - DNA, 178 bp, Homo sapiens
  misc_feature (21)..(22): n is a, c, g, or t
  misc_feature (43)..(43): n is a, c, g, or t
tggaccctatctagggctatnntttctccaaaacccgaacagntcgcctggtcttgtcacaaacttggcctgtgacctgcagcacatgactgtcactcttgggcctcagtttccccatcaaaaaaacagaggtcatgtgaaatgatggtctctaaggtgccttctaactgatacatta

SEQ ID NO: 495981 - DNA, 329 bp, Homo sapiens
tctagaggatcctcatgctgctccctcttcagcctcccaagtatgctgggactacaggcacatgccaccacgcccggctaatttttgcattttttttgtagagacagggtttcgccatgttgcccagaatggtctggaagctcctgaactcaaggggaatcacctgccttgggcctcctaaaagtgctgggattacaggggtgagccactgcaccctgcctacagtaacagattttagccaaaactttattccaatcctgggttttccagcatgtgttgtacaataaacagatggatcttcccaggagagggttatatgtagggatcct

SEQ ID NO: 495982 - DNA, 588 bp, Homo sapiens
catgctagtcgctggtggcaatttgccgagggacacaaggaggaggcgggacaggcgcggtgcagccgcagtctccagcggcggcccggcggcacggacgagaaagccgagcggcaaggagcggcgggatgccggggacaaggacaaagaacaggagctgtctgaagaggataaacaagcttcaagatgaactggagatgctccgctggaacgactaggggagaaggatacatcctgtatcgcaccagtgctggaggaattggcaaggcgattgtttttaacatttcatgattagctgcccaagcctctccaaattttgcgtcaccactatggccaactgaaggaaatctatgagaacctggcccctggggagaataagcgttttgctgctgacatcatctccgtttggccatgaccatgagtggggagcgtagagtgcctcaagtatccggctagtgggctcccaggaggaataggactactggggtcatgagtatgtaggccatatggaggagaagtggtaaggagtggaggagttggatgagcagagaaggtcagccgggagctctgctactcggtgaaggaaat

SEQ ID NO: 495983 - DNA, 367 bp, Homo sapiens
tgtcactattgtggggatcggtacagatgaggaagtggatgagcggtacagagaagcacctatggacaagaaggggaattcaattacatcgagtcacacgcatcctgaaacttggagccaaagacaaagatgactgaaagaactttagcaaaaatcttccagttacatggtcttactctcttttacttctcagacacttcccccaccctcatagaacctgtggcgtgcaattaagtttcacagcttggcctctccttttggatgtatttattccagacctttctgccatttagcactggtataatcagacgggaaagggggatgagggtgtaaatggtatggaaaaagatcgcgaaggggtaccgag

SEQ ID NO: 495984 - DNA, 615 bp, Homo sapiens
  misc_feature (388)..(388): n is a, c, g, or t
gcgctacttctcctcgcagcggcgcccgcgagcgtggtggtggacgcggcgtctagtacatacaccggggttaggtcgactgcacacacacgcccgcggtcgccggcggcggcagcgcggggggcgcattggtcggacggcacgccacacacggcgctcggcgctgcgcacacagctttgttttctcctcgcgccgcggcggcgtgtccgcccactctgtactctctctttgcacaacgctcgcgcacccgcggcgagtgtgactcgcataggctgaccacgctgtgtcttgtctgcttgtgtcagaggagagagtgtttcacattcactgagacactgtgagaggtgggcggggccgacagactacgccgttgtcacacgcacatanaaagggagagctagagaatagaatcgccccctctctgtcttcttgtgtggtattatttgtgggaatattctgtgccaccatacgccgcgggtgcaattatagttgcgcagaaccgcctccttgtcttactctctcgcccacgggcgattggtatgtgcattaacgtccacgcgacacgccgcccacatcattgagtacgaacaatacacacggaaacatacgagaag

SEQ ID NO: 495985 - DNA, 93 bp, Homo sapiens
tctgaagacacggctgtctatttttgtgcgagagatggtaattatgccaactgccacgagtccctaccgcactatgactactggggccaggga

SEQ ID NO: 495986 - DNA, 273 bp, Homo sapiens
gtatacgggatagtgttccggacacttgctgaagtatatcagctgaaggagctttgggctgagactatgggtttattagatatagaattaagtcatctgcaaagagacgtagttgacttccctcttcctatttgaataccctttatttctctctcttacctgactgccctggccaggacttccagtactatgttgaataggagtggtgggagacagcattctggtctggtgtcagttttcaaagggaatgtttccagctttgggttatttcag

SEQ ID NO: 495987 - DNA, 956 bp, Homo sapiens
  misc_feature (590)..(590): n is a, c, g, or t
  misc_feature (652)..(652): n is a, c, g, or t
ggagtattttaagagtaggaagtcggggaaagcagacacgtagcagtcagctatgcagtcctaccttgctgtctagtagcaccagaatcctagatcatagaaggtactagctaacattcaggatctctagcagaactgaccagtattgtcatcgcggggtgtatggttgtctttgctgagggtacatagataacccgacccaggagttgtagaaacgctataattaaaggtcactccatgaatgttgcatgtggaataaagatcattctaaccaaaatgtgtgttcaggccaggcacagagggtcacccctgtaatcctatgtgcttggggagataatggcgcggaggaatcactctatagggctcgagaagttccagtaccgagcgctgtgcatatagtagcagagatcccttgtctcgtactgaaaaagttctaagaaagttagcctgggcgattgtgttgacctacacaggtatcgtagttcccaaggatacgtacgattgatgggtgaacattggagagatgcatctttgaggtctccacggagttatcgaggggctcgcaagtgggagcttgctgatcaacagcncaagctgcaatgtacctaggctttggaatttgaggggctaggcaatgatcccctagttgctnccacataaatccgcatagtggcaagaacccagaatctatatatgaaacgccaagttgacccttaaatgtggtctcatggaaaggttcgagaactttcttaaaaaccttgcgtttctacgtggataccttggttttctgggaaacgcgacggatgtaaaatgggctttggattgcttcccccacggatttccaattattcgagaatataatttctctcgggtgcccattactttactcaatctggtgtaaaaaagaacaaatgctataacattaattttgcaattgggcacaaggttctttcata

SEQ ID NO: 495988 - DNA, 351 bp, Homo sapiens
gctggaggctgtcccccattttaaaggtgcaggtattgaacccccttcctgaaacctagtttaacgggaatagcaaaaaaatgccttttaacaccattagctttgcaaatgggttcatttcagtcaaaggggaattttgctttggccaattgaaaaatgaaaattaaaggagagaaggaaaaaaacccaaaggccctttaaacatgaaaagaattatttatatggtaaaaaaaaatttagcttttcaaagcccaagactgaataaaagggccccttttaagctttttggaaatggtactgttaaaagtctttttacatcagggttaaaaaatttggaatgacatttgatgg

SEQ ID NO: 495989 - DNA, 793 bp, Homo sapiens
  misc_feature (27)..(27): n is a, c, g, or t
  misc_feature (73)..(75): n is a, c, g, or t
  misc_feature (77)..(77): n is a, c, g, or t
  misc_feature (96)..(96): n is a, c, g, or t
  misc_feature (106)..(106): n is a, c, g, or t
  misc_feature (156)..(156): n is a, c, g, or t
  misc_feature (160)..(160): n is a, c, g, or t
  misc_feature (186)..(186): n is a, c, g, or t
  misc_feature (202)..(202): n is a, c, g, or t
  misc_feature (208)..(209): n is a, c, g, or t
  misc_feature (214)..(215): n is a, c, g, or t
  misc_feature (221)..(221): n is a, c, g, or t
  misc_feature (234)..(235): n is a, c, g, or t
  misc_feature (251)..(251): n is a, c, g, or t
  misc_feature (336)..(336): n is a, c, g, or t
  misc_feature (340)..(340): n is a, c, g, or t
  misc_feature (348)..(348): n is a, c, g, or t
  misc_feature (365)..(365): n is a, c, g, or t
  misc_feature (374)..(374): n is a, c, g, or t
  misc_feature (383)..(383): n is a, c, g, or t
  misc_feature (404)..(404): n is a, c, g, or t
  misc_feature (426)..(426): n is a, c, g, or t
  misc_feature (448)..(448): n is a, c, g, or t
  misc_feature (464)..(464): n is a, c, g, or t
  misc_feature (468)..(468): n is a, c, g, or t
  misc_feature (506)..(506): n is a, c, g, or t
  misc_feature (536)..(536): n is a, c, g, or t
  misc_feature (543)..(543): n is a, c, g, or t
  misc_feature (569)..(569): n is a, c, g, or t
  misc_feature (580)..(580): n is a, c, g, or t
  misc_feature (672)..(672): n is a, c, g, or t
  misc_feature (705)..(705): n is a, c, g, or t
  misc_feature (731)..(731): n is a, c, g, or t
  misc_feature (733)..(733): n is a, c, g, or t
  misc_feature (757)..(757): n is a, c, g, or t
acacctccacctgttcctgaggttacntcagttgcagaaagaaaaaaccttgggcgcgagggcgaccttcccnnngngggaggagagacgctggangagcagccangcctccaagccagggccggccgggatcagcagaggtgcaaagtcccactnaganggacccagcccttcccctcccaacantcatcccttccctgcngggggnnggggnngggggngggctcagtggcnnaggaggcgaagatctnctgaggatccaccagcttctccctgggcttccccgtgccctggccccgggccacctcctcggcatccagcttctcccagtatganaaanagactggncggacccctcggctgcngaggagggnctggatggntgcgtagcgaggggtggggcnagaggggagcaaaccagcattnaggtcctgcagcagcatctggncggtgaggaagctgtnagtnatggttgtggctatgacacctgttggtcctctcttcanccagccgctgcagtagagggctggaacatncataagncgggcctccacattggggatgacccnagcttggagtnaaagggcacgcttgggtcgacagggcggctcttatacccaatgctgctgagcaccagcccacaagggaggtcttccatgtctcccgtgggcnctgcacgggtggcctcatcgacaccctccagtntagtgactgctaggcggacacctgcngnccgccgcccatctggtgagggcancccctgctggggggcttcggaaaaagcggaggcccc

SEQ ID NO: 495990 - DNA, 378 bp, Homo sapiens
gagatggagtttcgctcttgttgcccaggctggagtgcaatggtgtgatgttggctcactgcaacctccacctcccaggttcaaacggttttcctgcctcagcctcctgagtggctgggattacaggcacgtgccatcacgccaggctaattttgtatttttagtagagcaggggtttttctatgttggtcaggctggtcttgcactcccgacctcaggttatttgtttgccttggcctcccaaagtgttgggattaaaggcatgaacccccacgcccagccaaagttaaactattattttgtgtcagaatttgtattaaatgtgacttgtcaagttattcagtttttatccttaaataaatgagttatttgaattca

SEQ ID NO: 495991 - DNA, 1047 bp, Homo sapiens
  misc_feature (526)..(526): n is a, c, g, or t
attctctacaaagcgagtagaagacattggaacactatacctattattcggcgcatgagctggagtccgtaggcacagtctctaaagcctccttgattcgagccgagctggggccagcacaggcgaaccttctaggtaacgagcacatcttacaaacgtctatcgtcacaagcaccatgcatttgtacataatcgttcgttcatgaggtcaatgaccacatcatgaatcgcgaggcgtttggtcaactggacatagttacgccctaaataatcggtggcaccctgatatggcaatttcccgcgaccataaacgaacagtgaagtcgttctagacgtcgttaacactcctcgtacatcgttcgctttagcgtcctagccatcgctatcatgcggtaatcaagtggcacggcacggcagcgaaaggaatcccaggttgcaaacaagtgcctactctccttccctcagacgagaggtaacgtgacttcgccgcacccactgagatgccgtcctgtagcacctaacacanttccttcggcctttcaacatctgcctacgcatgggttgtaactccttcctaaattcgtatgagcgtgcgtcgcactccaaaattatctactagtgcatccatagccaactttattcgaaatcattacaagagcctcctctagtcgattaactctcagaataactcaatagcgtctcgcctttctctcgatcttgactacgcggtccctagatcgacaagacagttccttagcgatcatcgctaattgtctctcctagttcctagtcgttgctggtcatctacctataacttatctaagcagacctgctaaagcgtcatacatcaatcgttcttcgacccccgtgcggaggaacgagacctccatttcgtaataaccagagaccgatttctgcttttggggaaccatcctgaaggttatacttcttaattctaaccaggcttcggaatagatgccccatattgtaccttatttactccggaagaacagagccttggggacctggtttggcctgggaaggaca

SEQ ID NO: 495992 - DNA, 268 bp, Homo sapiens
  misc_feature (82)..(82): n is a, c, g, or t
  misc_feature (84)..(84): n is a, c, g, or t
  misc_feature (97)..(97): n is a, c, g, or t
  misc_feature (99)..(99): n is a, c, g, or t
  misc_feature (107)..(107): n is a, c, g, or t
  misc_feature (109)..(109): n is a, c, g, or t
  misc_feature (114)..(114): n is a, c, g, or t
  misc_feature (159)..(159): n is a, c, g, or t
  misc_feature (169)..(169): n is a, c, g, or t
  misc_feature (193)..(193): n is a, c, g, or t
  misc_feature (195)..(195): n is a, c, g, or t
  misc_feature (216)..(216): n is a, c, g, or t
  misc_feature (223)..(223): n is a, c, g, or t
  misc_feature (255)..(255): n is a, c, g, or t
  misc_feature (264)..(264): n is a, c, g, or t
gaaaagtataactcgatttcttgatctttgagcatgttttgtgtttcttgtgttttctaaaagaatattagatatggttaantncattacatctaananatttattntnttttntgtatgctcaggttccccacacccatacccaccctaacccctgtnatttacattnggtggaactttaactggtaaccangnaaaagtacattttgataatgngtattgntaatcctcggggaaactagtgggtatatgggngcccctttnacct

SEQ ID NO: 495993 - DNA, 407 bp, Homo sapiens
ccatagcctttatagattgagaccttcacagtctgaatggctagatctaagacaatgtatatgggcttaagtagatgtaagagagcagacaaacaaaacatatagtaaaagtagtatttgccagaagcaatttccattctcttcctttcttcctgcaaactggtgtattatctttacgagttctctgtcattccataagaaagctgaacagtggttaacacatccagtttgcttgaattcctgagtgattcagattccagtgagcttgagggtcattcataacagttacaatgctggtgtggtaaagggagaacaaaaataaactgggtttctgcaggtaagtgagaagacaaaatgaagaggaataaggttgtaaggcagtatgattaggcttgtgagagtgctat

SEQ ID NO: 495994 - DNA, 252 bp, Homo sapiens
ttagccgacgtatatcatggtgtaatactgtatgactccatttatatgaaatggcagaataggtaaattcagaggcagaaaatagataatttgttgccaggggtttggaaaaagagtgaacagaaagtgactgctaggagttcctgttctggctcagcagaaacgaatctgactggcatccatgaggacgcaggttcaatcccaagcattgattagtgggttaaggatccggcattgccgtcgcataatttt

SEQ ID NO: 495995 - DNA, 134 bp, Homo sapiens
ccattgactgcgccaatacacccttctcatgtcaagatcaattgtgtgcccactttacgcagaaccacaaatatcaatacaggaagaaccatcatcataaccattgaattcattagaaagtctgtccagcccca

SEQ ID NO: 495996 - DNA, 495 bp, Homo sapiens
cataacaaagaatgggagcccctgctaagggccaggggtgtcttaccccacaatttactcaaataccttgacaatgggtataaatgaaaggccaaggaatctgccacagatgctacctacagagctttggaaaagtctcattaagaaaatccttggggctacagccttgctgcaagccttccctgcattggctctgcagatttctcatctgtcctgacatgcagttttcctgtcattggaagtgggagatggggtaggttgtaagaaaatgatattaaaatgtaagcatggatactgtgcataaggacaaactatttataaaatgtatatgctatttattttatatatttatttatttcaaaataataattttatttttaatgagagatgcgatggctggattttcatcagaaagaataaggtcctactgaaacaggataaaatgagttattaaaggcttttactgacaataaaatttgtctttatattgtaaaa

SEQ ID NO: 495997 - DNA, 796 bp, Homo sapiens
tcaccgccagcacgcgcctgcttcccgtctagcgcgagtccacgcagctccccaggcccttcaccagcacagcagcagcaggcatggcagcaagcgtggagcagcgcgaggtgcaccatccatggtgcagggccatggccctcttcttccgatgatggccctgtccctggcagttgggcatggctcgcgttctactgtatctgtctgctgcagtggtattctgcttctcctccgcatgacctggctagaacctgggtacactgcacagtgctgtgcccatgtgctggctacctgggctgtggccacttgacctgccaggtctggggcactccaatggatcgccgcacgcccctgcccctataggggagctggcccctgtgcagcttcctggcggctgtggtggatgccttggacgctgggccccccggttgtgatcagtccatcactgatgtggccatgtactccctgcccttcctcacggtccctggtctcccagctcccgtggctttgtgccagtgtgcccctcatctgcactgtctgagtcaactgctgccaactattgccagtgtgaagagtctcagctctgattgtctactggcacgcaccatggaccccatggggtcactgacctggcgttgagctcctgaaggtcaggttgcgccaattgcgaccgggttagcctggactcagttgaacggcgggcctggtgctgcccccctggtaagcctgggatctattcgcagatggaggtgcgccgtttcacgggcttgcttggactttccttgccggggtttcc

SEQ ID NO: 495998 - DNA, 179 bp, Homo sapiens
gtacgagcctctccaaaaacataaaacaaaaaacaaaaaaaaagaggagggacaacttctaactcattcttgaagacagcatttccctggcgctcgttacggaggcgctcgttacggaggcgctcgttacggatcgttacggagggctcgttaggcgctcgttaggcgctcgttacgga

SEQ ID NO: 495999 - DNA, 176 bp, Homo sapiens
  misc_feature (6)..(6): n is a, c, g, or t
gccgtncgactgcagccccaagcatctttccacataggccccatacactttggtcctcagggaaaacagggtacggggcaggccggcgcttttctccccacaccaagcccctgcgcgtgttcactctgaatcagcagccacttcctgggagccaataaaatgcatttttacaggcc

SEQ ID NO: 496000 - DNA, 1455 bp, Homo sapiens
  misc_feature (250)..(250): n is a, c, g, or t
  misc_feature (641)..(641): n is a, c, g, or t
ctcgcttctgcttatattggaggccggatcatgaacatgttgatcactctatctcctcccttacctgggcaactacgtcaccagcccttgtgagctcgtccaatagaccataatccatcgttcatctcattactagccatagtcgatggctgtcatccatcgtatcgttagagggccatcaattgttcatctagcaatcaacttatctaattgattatagatagccccacgtggctcaatttatattccncaaaattcagctcgagagagcggacgcactcgtcctctgcggtcctggagtactcggcttcgctttatagttcagcacggcgaagattccatatcgttttcttccttcaattctccgtacacacaagatacacataaagactagcgctggcgcatcagctactaactaacttaacccagtcaccgaccgaacccctacagactatccaagccatttcctcttcgaaactctctctgtctctgtgcaccgagaacgggtagtaacccccctatattccgtaagtacccctaaactactctataatttccctcacgttttaacatcgcagtcagccacaggcgcttgtatacatcaccatcttacttcctatcacagttcgggctacactcanaaaggtatatccagtcaacgtagaactactattctagtcctaatctaagtaaactaatctcatctctcattgtcgcgagttgaagcgctgcaaaatatacctacttaagtctgacgcagcacatttccttcttcagttagctttgtagtcctctggttcccgtcaaatgtcgaaccatagtccaagattctcgtgatcttataccttccctgagttctttcattctcactagattgccacttatgcatagacaatgagtcatttgcacccatagttacttagctaaagcagggaaccagaatatacccttctaacacgatctacctctttcctttcagaaccacccaactgggaagtgcacggatgatcccattttccataaatatcccaaaacaccacttaatattcctgaaattctctgccgagtccatcaccccggaaaggatttcatacattcgtctatttcccttactccagtgtctttccgcgcaacataaatcctcttcaataattggcttacctttcactacctcccggaacatcaactaagcaatccactttcgcattacaataaagcatcaaaagctcctagaccccttattaaatatccaaactatgagtttcccccaatacaatataatcccttataactcacacccccacattaattttccacgacaatgaaattatcaatcctttcacaccgcgcaaccattttagacccttctctaccaccataccctcgtattcttccacacgagcatcacacccatctactacaccactccaatccccaaaacacataaacccacac

SEQ ID NO: 496001 - DNA, 535 bp, Homo sapiens
gattgtgtagtaaaggctgttaaagtagaggagaggaatcaggatgaactgcagagagtacttaaggccagatgggtactggagcgtatgcgcaggaaactgaagctgaactgtgtggttgttgctaacattggtgtatccagcactaagcctcagaaataaaactttactgatatctttgaatcccatgtgtgtccttccctgaatgcattgctttgtcacccagaggtaacagctatccagcattcagtgcttatcatccccatgtctttctttattggttttctaaatttggaatatccctggagacaactttggcaactgaagctaaactgtgatggttgttgacctctgatgtgctactttttaatcaagaacttattttccctctttctctctcagctcccacaggcccattctggtgactcatgacttgtatacacagaacaacagagaaaagaacaatagaattagatcaacaagcaggggccacagtgagggctatgtcttaccaagaaccatttttaattgaatt

SEQ ID NO: 496002 - DNA, 1231 bp, Homo sapiens
gggcgtggtggcaggcgcctgtggtcccagctactcgtggaggctgaggcaggagaatagtgtgaacccaggaggcggagcttgcagtgagccaagatagtgccactgcacttcagcctgggtgacagagtgagactctgtctcaaaaaaaaaaaaaaaatcctggaaaagccagaacaatatacaaacaagtatgtggaggcagattggctttattccaagaaggctgtatggagtgtgtgtctgccataagcctccttatagcctattatttctacttgcctgagaagacagtaatatataaccggaacagtgacgggagatggaacggagacgcctatcgtttacgacgcgttcccaatttcatggccttgtggggcgttggcactgtgccgggagactgactctctcattcactctgacaaggccccatccgtgtgtggcagaaacatggggacatctgagtgaccatgataacaccttgaagcacacaggggcaagaacttgttcacctgacagacagaactatgcgggttactgggctggcgcatactggggggccacaggggacaccccctcaagagacaacacgggcaccaggacacaaggaaccacaactacacgcctagggccaagagagcccacacaaggcatagtgacataaaggacgataggaaatcatccaaaaggacaaaagacccaaccactttcaaacacactcttcgtacatcctacggcaaacccccccaaaaaaacttgctgttagaacactttacatgctaaaaacaaacccacaattccacagaactttattcttaccaaaaatgcaccctacaatccacaccacaaattacataacaccttgctctactttcaccacaataattacataactaaatgtgagagaaagcacattcgcgattatcgacacggagcaatgaaacaataaagtggcagagacataaatgtgacacgcgacaagcgcatcacgcaacaaagtgcgatacatataaacgagaaggtgcgccactaataacacaggacagagaaaatggaccctgtgcccccacaaactccagcatccggcgaagaaaagtacgactgagaggagatcgaccacagggatagacaagacaactgacaacatgtccgcgtagcgtggccacatcaaacagacgggaagaaagacgtgagcagcaacaacacacacaacgttgaggacgcaagatag

SEQ ID NO: 496003 - DNA, 661 bp, Homo sapiens
  misc_feature (54)..(54): n is a, c, g, or t
  misc_feature (64)..(64): n is a, c, g, or t
  misc_feature (94)..(94): n is a, c, g, or t
  misc_feature (119)..(119): n is a, c, g, or t
  misc_feature (143)..(143): n is a, c, g, or t
  misc_feature (280)..(280): n is a, c, g, or t
  misc_feature (347)..(347): n is a, c, g, or t
  misc_feature (387)..(387): n is a, c, g, or t
  misc_feature (398)..(398): n is a, c, g, or t
  misc_feature (443)..(443): n is a, c, g, or t
  misc_feature (461)..(461): n is a, c, g, or t
  misc_feature (495)..(495): n is a, c, g, or t
  misc_feature (498)..(498): n is a, c, g, or t
  misc_feature (503)..(503): n is a, c, g, or t
  misc_feature (658)..(658): n is a, c, g, or t
ttattccattttgaattatttgataactatttacttcacctccccacctcaaantgaatctacnactctaaaatgaatctaaaacagccaaggntggccagtactgatcctcattttcntgaagaagaatctcagcctgaaanaatatagagctaggtgacatatgggtggccaaccgcttctcctcaagttccaagagagtgggcaattagtgaaattccatcagtcatgttaaaatatactttcaccaggtagacatccttctttcaatgctagaggncagtgaaaaatgtagattaatgggatctgtaactgtcttctcttaactgtacacccctcaggctgancgcgggggtgctgaacacatgccctcggaagggaccctgnagacccaagtnacctgcaccataaaacccccccgggggtccgccatgctgccagcnctcacggggcagcagggncacctgctgggaagacctgggcgcgggtctgggngcntgggnctggctgcgtcctccacgtccttggggccaggtctacggcagggccatgatcttcttctccagcttctgtggagggaacaggaagtttttcatgatgtcatccagctcttctagggccaactgggcatggggcttgggcaagtaatcgggctccnggg

SEQ ID NO: 496004 - DNA, 382 bp, Homo sapiens
ttaacattcgtgtccgaggatgtgttgaaaggatgtggtgcttctcagatgattgatgtctcgacataagacataacccaggccttgggttagatctctcggtgtctacagaatgaacctgtctgatgtgtgtggtctctggcagttaagtccctggacctcttgagatcactttcttcactggaaggtctagtcactgggttggcttctaagctctgagatttagatagcaattcatagctaagtcttcgatataaaacacaggaaccaaaagtgtgaataaaatcttgactgtgctcaagtgtcctgtgaagtgtcctgtctccactctcaattccattctctgtagggtcttccttcagctgcaacaagggcctgcagt

SEQ ID NO: 496005 - DNA, 1113 bp, Homo sapiens
ggtcccactcttgattatcgtctccttgtgcattgtgtcgatcttctccgtcttgttctcctctcttttgtgttatgttcagttttttgtctctattttccgccgtgtccctgcgatattttatttcttcaattgcccctctctgtcccgtcacgcttcttggtctcttttgctgtcttcttttcgtcgtcctgtttctgtggcccgtgtcctttttgtctgggctaacaccctctgttgctactgtggttctttctggattcctgtcttgggttgttccttcccctccgtgtgtgctccgcgttttcttgcattctcgttgatggagctcgctttctcgctgcttctttgttgttattttctgtcttgtcctgtcccccctctctgcccccccgtgtgcttttcgtgtgctgattgctgtgttgtgtttgtcacttcagctgccctcccagaggcctactttcatagcagcctgtgggttggtcttcttgttcattgttcctggctgctccggtctctgtagggagtcctcgacctccgcctgaccttcggaccctattccccctctgggtggggtacgccctgctcgcacctgctcctccagcgattctgtcttcagccacgacccccttgccattgggatccagctccttccccttccgggtctggggtgtcagacatgagcataggctcaaggctgtgcaggcacatagttctggtggccttgggccttggggctcagccacagcctgacacagtgctcgaccttgatagcatggggccctggcccagtagattgctgtgaccgtgtccatagggccgtgcccttgcccttggagacctgccgtgcctgtgtcctgatggcccctaatgtcagggttctgcttcaggcttcattggaccttggcagcattagtccccatcccgggtttggctgagccatggctggagagctgctatgctaaacctcctgcctcccaataccagcaggaggttctgggcctctgacccccatttccccacaccttccccaatgcatgcatgcagccccagcgtcatgacagggagcattggcacactgattaccacagaggctggaagccacctagacac

SEQ ID NO: 496006 - DNA, 306 bp, Homo sapiens
tttgcccctttttttttaaaaaaacctgttggaaaacccggtgtttaatggggtttatatgaagttaacccggtttggatgcccctttccccccaaaaactggaaaaatagggggcttgtaggagttaacccccccccctttggaaggtaaagaaattggggggcccccctttatattttaatttttaatcagggccggttttgaaaggggatccccctagcccgctgatttttttttttttttaaaaaaaggggggggggaaattaatttaaacggttgtttgccataaaaaaaattccttttta

SEQ ID NO: 496007 - DNA, 944 bp, Homo sapiens
gcaacagtgtgggataaacagagtcacgatcagaggaaccccaggatctggtgatggcaggatggggggagagagagaaaatccacaaattccaatgtcacaaaagcaataaaacgaaactagaaagaacaaaaaggttttacaagaatgcaacaggaaggaaacaacaaaaggggcaaccaaccagctttagaagtctgggcgacttggtaccggagacgggtactacactttatcttaattcttaatttaaaaaccatgtttacaagttacaaccaaccttctatgaacaggttgaaaaggacaaaaaaataaaataaaaaagaggcgggcgcgaggagaagagggagggcgagaagaagaagagctcgagaagcagagagaaaattcccctaagaggttcgagatttaatttgtgggtccaaaagtattaacagaaaaaagccccaccttaaagggttagaagtccccctttgtggttcccccaagaagcgcgagaaggggggggttcccagggaggaaggaccatcgacgggggcacctggggaagaacgcccccggtggttgtgtgggtgctttaacccccgacgatgttagccttcaagggcgggacctgttggggtgttccgtggcgtgtgtcccccccggttcccactttttgtgtccccttctttggggcttctggcggtggacaaagggtctttagacccgccgtttttcgggcccggggcggtcactctccttaccaccatcccataggctagaggaggtgggcctcgccgggggaacaccccgattcgctacgaggagacgccccgtatatccggaagcgcccttgcccccgcaggtgaccgcgcgtgtctgtcctgtgttatgcccctcgtgcgagggaggtgcaggaggtcactcgtagacatctaaggtccttgacgtacgattgtaga

SEQ ID NO: 496008 - DNA, 184 bp, Homo sapiens
  misc_feature (139)..(139): n is a, c, g, or t
  misc_feature (146)..(147): n is a, c, g, or t
  misc_feature (174)..(175): n is a, c, g, or t
cgggctgcaggaattcggcacgaggctgaataaagatgatttaagcttcagagtgggtgctggaagcataagcttcaggtccaggaagatgggtttggatccagcctctgccacttgctctctggacctgaagcttatnttccagnnaccccactcctgagctgaataaagatnntttaagctt

SEQ ID NO: 496009 - DNA, 511 bp, Homo sapiens
ctatagactctcatttttcttagggtattaatgtaaactgcatttgagcatgatgacattccgctggaccctcagtttctttacggaggactaaactgtgctggtgtcatcacttacaaaagtgtcttgaatttaatggtcgttaatgttttatttgttgctcttttaattccatttttccacaaactttttgaagtcctcttgtatttgatgaaggaaagagttgatcaataatgtcagattttatagctcttataatgtgttatagtgatgattgcctatctgggttgtgagctccatgaagacaagaatatttctatatctctatccctaagcatagctagccctgccattagctgatatagtgactttgggtgaatttaggagactgcttttcttccaggtatttttctgctgcttcatagaaaattatgcaagtctttatgatgacaggataaatggcattcccttggagctgtgtaatgcataatttgtatgactctaatcactg

SEQ ID NO: 496010 - DNA, 170 bp, Homo sapiens
aggtaacataggtcgtaatcgctccctttaaatacgccatagccatatgtgacctgcatcctgcgtttgtggccatttttcccttataaaaacctcatatttctttaaaccctcataatacccccaagagaccttttcatgggtactgtgcccatagagatttctaaaag

SEQ ID NO: 496011 - DNA, 208 bp, Homo sapiens
aaaaactgttacttcactatccccctggggcactgtggcagtactcgagtgacgggggtctcggtggtatgcgattagaagaagtcctgctaggagtactgtgtgaggtgatcttggtggtcgtggttaccaagtttgttgtaggaactgtggctgtaactgtggtgaggaaagaggaagaggtgggtcgaagagaggtcacagtgga

SEQ ID NO: 496012 - DNA, 108 bp, Homo sapiens
cgtgtgcctagtacggatgtgtgggccatgtggatgctgaaaggagaactgcgtgcccggatgaagattccaagcaatatgtgggtagaacgcctggcgaaatcagac

SEQ ID NO: 496013 - DNA, 441 bp, Homo sapiens
  misc_feature (390)..(390): n is a, c, g, or t
  misc_feature (393)..(393): n is a, c, g, or t
  misc_feature (439)..(439): n is a, c, g, or t
gcaaacatcagcattgaacaggggaccttatttaaaaaacaccacattccatgaacccctttgaaaaaccctgcaagaatccaaaaataccatagggaaggtccccaaagttaccccaagtgatttaataagccttattaaaatattacaaggcagctgggcgtggtggcttatgcctgtaatccccagcactttgggagaccgaggtgggtggatcacctgatgtcaggagttccagagcagcctgtccaacatggtaaaatcccgtctctactaaaagtacaaaaattagctgggcatggtgcagatgcctgtaatctcagctacttgggaggctgaggctggagaatctctttaacccaggaggtggaggttgtggtgagcagaganttngccattgcactccagcctggatgacaagagcaaaacaccgtctatntc

SEQ ID NO: 496014 - DNA, 332 bp, Homo sapiens
caggaggtggaaccttgcatacatctagagttagcctcacaccggtatgcgctcatggtaccacctttggactcctgaagtggtctgcaggtcggcccaggtcgactggtcgttgcaattcaggatcgaaaaatccgtgcgcttccgggcgacgagccagataaggaaatttccggtggtgggcgccaagctgttgaccgtggactccaactgcttctactgcgacgaggccgtcgactcgcagctcatccgccagtttagctctctgacccacatgttcactcgctttcccgcttcgcagattttgtggcgggcgacagccgccattatca

SEQ ID NO: 496015 - DNA, 276 bp, Homo sapiens
ctattaaggctagcctatgcaattctgtaggaccaatgggtcccaaaggcagtaaacagtgtcacagacaacccctgctccctgtataggagtctcaaaagaaggccaagacaataagtgaaaagagggtctaggtcagtcctatacaggcaccattgttggtggttcagtctatgcgagccactacaagcccaggttagttgattctttgagtgctctttagagtcttctccacataaccacactggggacatcgtagacgcgcccgcgaattta

SEQ ID NO: 496016 - DNA, 243 bp, Homo sapiens
ggcaataagtagctctcagcagccttactcaatggtcagcacatgctggagtagcgaggataattatgattgcaatatctcagaagtcatgatctctatgtggtatagaacacgtggcagatgatccgccagcactagcagtcacgtaggacaacgccaaagctcccatagtgaatgacacagtgaatcatggcagataacgcaagaagacagctgtgcagagtgcatggtagttcgtgtcag

SEQ ID NO: 496017 - DNA, 285 bp, Homo sapiens
tttactctagacggatccctgcgggtctcttcttgaccctgtcttcgccttgggcaattggccgcaccagctgcgctgtcccttgtgggatggggatggggctgctgctattggtcagctcagctgacaggcctggggtttcaggatgatggtgtcgccttccagctcggagctcttgtagcccaggagcagatagtgtggccatcacctcgttgtctctctggcccaccagcgagtcctggactctcttcccgtgttctacacccatggacaccatcacgctct

SEQ ID NO: 496018 - DNA, 320 bp, Homo sapiens
tctctgacgaggagagaaggctatgaaaaccattgttaatatatagttagtgcataatttgaatgacttcctgtaaatgagtttttactaattaatatttttaatagggattctcagcgttcttcagaaagatgactttttttctgccaccgtatgtgtaatgtggcttctctatatttatgacttagagtcatgttttggcctgtgaagcacaataacctttctggagccaagttttgtcagtgctaatacatgccctttacagcccacattccttaattgcatcaaaacactcacctgataggtgagcagtcctcagt

SEQ ID NO: 496019 - DNA, 197 bp, Homo sapiens
ccaagttttccctatggatgatgcaaattccactgctggctgacccctaggaaccccatcccacaacctggtcagttcctgggcgcaggccaagcgcctcccaggcccaccttcctcacttccgtcaagctcaatggcagcatttgccccagagggaaaaggccaaaaccattaccaataaaattgtgaagttttcc

SEQ ID NO: 496020 - DNA, 625 bp, Homo sapiens
cagtactttttgcgcgaacggggtgtctggaatacaggggacttttttcaggtgtacgtgagcacccagggggacgaggaacaggtggttaggtaccatcagtcaaacgcttgggtgagtcacaggattgactgatgcggcgtgacgtcgaaagcgatatatagtaaagctggtgtttaatggtgccagaccacatgagtaaagaatatgttctgcaaggtttagaacagacggtggtcatgcatgccgaatcaactctgaacatactggaggctgacaatagactcgtgcaagtttcggtttctatggcgcacatatgacagaagtctctaacgtggctaaagtcaaagagaagctagttgcagtacttactggataatccctaagagtagatcgtcttactccgaggatgggcagtgacattgtttgtcagagtttggcatcagagcattagggcgtgctgcctgatagatgtatttagtagattagcgcctgacattgattccagcatgaatctatgctatatacgtaatgccatagttatgttccgcggaataaggaagctattgttagtcatggggtcatgctggatacgccttaacaactctgggggtaattcgcattt

SEQ ID NO: 496021 - DNA, 331 bp, Homo sapiens
  misc_feature (36)..(36): n is a, c, g, or t
  misc_feature (50)..(50): n is a, c, g, or t
  misc_feature (92)..(92): n is a, c, g, or t
  misc_feature (111)..(111): n is a, c, g, or t
  misc_feature (139)..(139): n is a, c, g, or t
  misc_feature (161)..(161): n is a, c, g, or t
  misc_feature (193)..(193): n is a, c, g, or t
  misc_feature (220)..(220): n is a, c, g, or t
  misc_feature (258)..(258): n is a, c, g, or t
ttttttccttaagtggagaacctttcacccttttcnccttaaaggacacncttcatgacttcctctttggcacatcaaaattgctaacatgnctactcttgcattttgggnccattattaagttaaataaggattgttncttgaacataagcactgtggtncccaacagttgatctgataatcaagatggctnctaagtgactaactggtaggtagtgtntgtatacagttacagcatggataagctggacaaagggntgaatcacatcctaggtgggatggagtgggacagcatgagatttcatcacactactcagactagtgagcatta

SEQ ID NO: 496022 - DNA, 949 bp, Homo sapiens
gcatctgatctctgcgggatctacagataccgatgcaggaccacctcgattatcatgaccggatcctatggcaactatgtgaacgttcaaacgtgtcgcgactgctctacgtcatatgggattgaggggacttatcatgttacataaatgtgtgaactatttgcaacgcgtgcttcttgtcatacttatactcgtggcccatatacgaaaaaccaacaacctgcagccagcggtcatttcaaagatcttttcatgttcagatactgatgccttcataagtggtggactacctcagaatttgctgcgtcatcattgtgtgatcttcgctgtggatcaccaccttctggatatagaatattacaactagtataagtgtcgatgtgaaccttgcaagcagctctaagtggcattctatactcacgaacactcctgtcataagacaatgttaggcccagtctgggttctggatctgctgtaataagatgaacgatttaagtgagccttaagttaacctgtcctgtgccctagaccttaaggaatatctctctgtaagtaggctgtggttaatattagacttcctgtaacaaccgtgaaaagaactgatgtgttccgatcatctgtgtagggctgtgattgtaattggaaactactagtattctgaaggtaaccacacagatacattcagcgaacgtgggcgtctaccaagtgggggacgggcccgacgagaactctcctgccggttcccacgcgaggggacgcctcgaataggaacggcccgggaagggcgggccagcaacaaggccggtagccggaccgaaacagacttgacaggcccactgggggggccaagacccaaggcgctcggacggaaggtccagaagccccggggggccacacccgtaaagggctggcccaccgggggaagcccaccgaagggccgcgcaaacct

SEQ ID NO: 496023 - DNA, 215 bp, Homo sapiens
tcaagtgcgagacatgggttccatgagtcctcggagaagggaggtttggctcaaatgaatgactcagtggagcaaagtctaggcggggtgcgggggagccaaagtatccgagtgtgtcaggggaaggcacaaaggtacggggcggaagttcgaattggggggttgagggcgatgccttctaagctgatgccaaagatgtcgggggatgggcctca

SEQ ID NO: 496024 - DNA, 188 bp, Homo sapiens
aacaggtggtgcacgggtggtatgtagtgggagtggagagtcgcctgctagcagagtgcacagactcatggacaagctgtgttagggcagtgcacctgtggctttgcaggtttagcccccgagcttgtctcagggactgggctgctgttgagtgcctgtagcttatccacagtggaggtgcaaacttg

SEQ ID NO: 496025 - DNA, 404 bp, Homo sapiens
  misc_feature (331)..(331): n is a, c, g, or t
  misc_feature (344)..(344): n is a, c, g, or t
  misc_feature (359)..(359): n is a, c, g, or t
  misc_feature (387)..(387): n is a, c, g, or t
  misc_feature (400)..(400): n is a, c, g, or t
atggcataacattacaagacgaggcaaaaatatttaacccccaaatatatttctttgccctaccttgaacttgccctgcagagtctcttgtgaggagaatccacatcctataaagaagcccctttcccctttgttttccttcctttctttccagtccagggagatcatcaactaagagccagggcaccccttttaagtcgataaggaaacagtttacaacctgctctctctctctctgaagtctgctgaggagcttcccctggcacaataaaacttgggcctccacaatcctttatctttaacctggaacattccttttccattgatcccnggggctttcaggntaaggttcaacccanttgtttcaaccagggaaatgttttaaantttacccacagangggg

SEQ ID NO: 496026 - DNA, 369 bp, Homo sapiens
  misc_feature (325)..(325): n is a, c, g, or t
acagcggcagtgctgctgcggttactctagaggactccccgctccaacatgtcggttggttaaccctagatcacaccctaaggtcagaggcgggggtatagaacggctatgaattgcccccaaggactctggcttccttaagcccttcgggcttcgtttatggtcttcattaaaagtatcagcctaacttggtcgctagacctagggagaaacctttaaccacaagagtttttactcatggaagaccactactggacgcacccccctacttggggggggactcgacgactggggtgaccctacgacggcttgagacctttcctgnggtgtggtacggacctcggacggacgacactccccgtggacctt

SEQ ID NO: 496027 - DNA, 192 bp, Homo sapiens
ttcaatctctcattgcggtagcctgtgtgttggtctttccatagctggctgtggtatcttgggacccagtggcaggtcaccacctgtatggggctgcagttgctcccccaccccattcctctaagagctagtagtggagagagaaccctggaagagcagcacgtgcttgcttgaaacttctctgaaggtcta

SEQ ID NO: 496028 - DNA, 317 bp, Homo sapiens
taattccttccttcctttggtggtggggcaggacatgtatgtggtggttgctgttcgatcaatcaacacttgcatgtggttcactcgtgtccttcccagttttccttcttaaaaactccatcacagtaactcagtgcgcttctcgtggtggtcacgttatattggggcattcggatagataccaacgtgtctttttcaacatgtgttgtaaacggattgccatttggccattcttttcctcattatttggcgggaaagggtccccaaattaacattaaattaggtaggtattcggcttcctttgaaaaaacaacaag

SEQ ID NO: 496029 - DNA, 135 bp, Homo sapiens
gttctagaggatcccatagcacatgaatgaaaactagaagcaaaacaaacaggaaaccatctctacattttttttatctcaatcgaccctgaatgctacagcattatccagtggcctgcagaaaacacacacggt

SEQ ID NO: 496030 - DNA, 167 bp, Homo sapiens
caacgacgcagttgcgccatctggcgctggtggtgtattaagggctgatcaaattgtaaatcaaaatttaccacctcctcctcctgctcctggatctcctgctcataatactctacaacaacaagctcctgcagctaagccaggcaaaaatttatatatggcaataa

SEQ ID NO: 496031 - DNA, 1504 bp, Homo sapiens
  misc_feature (1)..(1): n is a, c, g, or t
nttcgtggtgtggcgtgtgttgtgggttctgtcgtttgtgtgtggcgtgggctcgtgagtgttgtgctgtggttctgcgtgcggtgggcgtgcgccccgctggtggggtttgtttgtctctcgcggtgacacgcgtgggccgtgtgcgcaggccccgtggccgagacgggggtttgcgccgccttgttttcggtctttggcgggcctgggggcagtttcgaccagggtgcttccactgttggggttccctgcccgtgttggggccctatggcctttggggggcctttcctggtttttgggcgtccatggaccggtggcgtgtgtgatgggccgccggccccccggtcctggggctatcttcctaatgttgcgagcctagaagggtatggtatggggccccctttaaatgtgttttgggggaatgctcctttatatgggtctttgttctctgttagtggcctctgtcattggggattgtcgacatggggttcgcatggagattttgggaggatataatagccaagccaggggctgtttaactcgagtcctaaggggcccgtcgcactggtgtatatcgtcggtattccccggaagaaacatacccgtgggggctcctaagggtattgtttaatagatagagcgctatttttgtggaataaatttgggcccaataagatggaacatgcggtgggcccaaagaattgtggttttgggcccgaataggggtttttatgtggggaggaattctttgtgggattttccaaccttctccagggtagggcccccattggcgcatactcaatgggcgcccgccgaacacattgggtgggggtctcctagttggtgtgtatatagccctggtgatggagtactctggggggcgcacaaaggatgtggggtgttatattgtgatagagatataggtgtaccacacagatatctacgcggtaacacgcctttggggaaaaatttcgctgttgtggcttctgtttgggggggtatatttggggggatgtcgcgccctcactttatagacactcttccctctggggatagttgtaatgtttcgaggagcccccacgctgataactgtcatgtctcgggtgatgtcctcggtgtaggctcgtgaggaaatagggattcctgggaggagagacactgtggataccacctcgtgagatgtcttatgaaaaggggtgaaatgtgttggtggaactctttgttcacagaggtgttgctctttaagtgtcctcgtgaggtggagggaactgagtgttatgagtgcacctctcggagaagagtttgtgataagtgtgtgtataaaactgcacgttgtataatagtgtctgttttccatgaacctcgttatttttgccacgagactttaattcaccacagatgggtttttaacttgtcagaatttttttggcaatcacagacctggggattaaaaccccggatggcactttattatgaggctttttaaagaatcccataattccta

SEQ ID NO: 496032 - DNA, 164 bp, Homo sapiens
cctccaccagtagcgctcactatacatctttggacaacctgctcattgaaccgccagtaaactgccctgctgactgcactctgcagtgttcccaatgctttcactcttatctaccctttgcacttatcttgctttatcaacataataatttatacacttctccc

SEQ ID NO: 496033 - DNA, 187 bp, Homo sapiens
gggtgaccagaggatcccggctccattcatcgcgtcttcttcttcttttcttcttcttctacttcctatcttcttctccttctcctcctcctcttcttcttcttctttttgagtttcactcttgtcgccaggctggagcacagtggcatgattttggctcacggcaacaagagtgaaactcaaaaag

SEQ ID NO: 496034 - DNA, 100 bp, Homo sapiens
ttaacgttccttcacacattcgcctacattcctaagagagttgattacgcttccctcacgtacgttcacgtacgccgttgcctaagagactagtcgacaa

SEQ ID NO: 496035 - DNA, 81 bp, Homo sapiens
ggagctgaaaggccataaattgataacacatccttgattcctctccttcaggccacctctctgtatcaagtccatcagtga

SEQ ID NO: 496036 - DNA, 259 bp, Homo sapiens
agtgtcccatgtggcctctccggcgccgctcctgcctttcggccgcctctcgcggcccagctcctcctgcctccccgtggcctctttctggccccgccccgctcatgcctcccggcggccttcccaagccccgcttttgcctttcggtggcctctgcaggcctcgccacggcccagccttctgcctcccgaaggcctgcacaggcccagcctctgcctcacagtggcctctccacgcacagctagctgttgcttcactg

SEQ ID NO: 496037 - DNA, 939 bp, Homo sapiens
  misc_feature (660)..(660): n is a, c, g, or t
ggacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattggtttactggacacttaaacatgtggaagcccggagagagcctctcgggcgaggcgcggatcgtcgaagaagttagtcacatcgatcgtatctgtcctctcaacttcatcctgttgcctttactcttctcaaccctgatcgagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaaccaaggggtggtggacaatctgttcagtttactgatatgagactttaaagcaagaatcaccaaatggttagtcgggaacgaagatcttcccacaagtagcancttgccccaacccaggatggtgcagagtctgaatggccgatgtagaaacaggtggtctgtggtgggggagataagaggcggatcccagtgggacctggtatagattcagcaaaaccaagggaaaagctggatgggtccagttgaagaccttcttgtgtgggtattcgaagcagcgaagagtttcaggcacttggaaccagttggtgaccggcccgatcacagcacaaagtttctgttcaatttcactttgttggattaagagactccgatctgatatag

SEQ ID NO: 496038 - DNA, 772 bp, Homo sapiens
cgcggttcgcaggtcgttcgcttgagcgtctctgcttagcctgggcgtgtcatgagccggcacagccggctgcagagtgcaggttctgagcctgtaccgcgatcttgcttgctgcgccggtgtgctgttggtgaatgcctgtgtgctgccctgatgtgcgtggctggaattttggctgtgtgccatggatggtttccctgtgcatgccatttgcctggtgcctttggccccgtgggcttggtggtcccctggggaaacccctggggttttgggcccttttggccttggcccaaagtttccatgtggggacaacggggtgtttataagcccgcgcgatgtatagtgcgttttaaagccccctcgcgtgagaccgccatcgggaccctgcggctggtacgggcccttggggtggtcgctgtggccgccctattgcggtctttttgtgggacctaagtgtggggcgccccgttttgctgggcctctttaagcctcggccctttccccacagggtggggggatgggggacacaccggaccacacgaaaaaaaacgactgccgacgaggggtgcgacgcccctgacacacaaagataaaaagcgcctatcccctggagtggtggatgatcgaacgagccccaaaaaagaactatttttgtggcggacacgagacacaacgaccaccacagtgagtgagggtcgacacgcggcgcacgaactatatatgaattttccacgacgatgagactcatttataaaaaacccccagatgattc

SEQ ID NO: 496039 - DNA, 132 bp, Homo sapiens
gactctagtggagccccgctccacccgacggggtggggaaaaccaaaataaaacgtcaaataaattgagttgaagtacgactgtggagaagagatcctgagggggtgctgtctgccatgacagaggaggcag

SEQ ID NO: 496040 - DNA, 479 bp, Homo sapiens
  misc_feature (1)..(1): n is a, c, g, or t
  misc_feature (3)..(6): n is a, c, g, or t
  misc_feature (275)..(275): n is a, c, g, or t
  misc_feature (277)..(277): n is a, c, g, or t
  misc_feature (376)..(378): n is a, c, g, or t
  misc_feature (405)..(405): n is a, c, g, or t
  misc_feature (446)..(446): n is a, c, g, or t
ncnnnnggggtgtgggctacccttgaacaatgatcccctggtaatattgggacctattttcatggtctggatggaaaggcctctgatatggtttgactgtgtccccacccaaatctcaccttgaattgtaataacccccatgaatcaagggtggggccaggtggagatcattgaatcacgggggcagtttcccccatactgttctcgtggtaatgaataagtcgcatgagatttgatggttttataaatggaagtacccctgcacaaatcctttngnctgatgtcatgtaagacatgccttcgctcctccttggcttctgccatgattgtgaggtctgcccagccatgtggaactgtgagtccactaaacctcttnnnctttataaattacccaggcttgggttntgtgttttaccagcagggggtgaaaatggacttaatacagnctccaaagatgataaggcctcccaaaactcaac

SEQ ID NO: 496041 - DNA, 137 bp, Homo sapiens
ataaaatcatgtggacacagaattgatccaaacaatgtaacttcaagaaaatgtagaaaagtttatacaggagtaatgggctttattctcttggatgaaaactcagtattttggtgtaaactctatttgaacaattt

SEQ ID NO: 496042 - DNA, 243 bp, Homo sapiens
tacagagtcatccagcaagtgagagaatctggctctgtagaccaaacatacagtgtgattattgtagtctgagaacacaccaccagatagcaggttacgccatgtcaccgagccccattgattcccagaggatcttagtcctggaaagtcaggccaacaagcaaccgttatgcatcatgttatctacttaacgtattaacaagttttcattttctcaacagtttacaatccatgattatttcc

SEQ ID NO: 496043 - DNA, 381 bp, Homo sapiens
agcaggttcccctctacaatccccacgatcacggcagcccaggcagcgcctgtgtgggtgttgcactcctctgcatgccctattgcagacatcatggccggcagctagtggaatcccactggccacgctggcagccggtcacagcgaagcccaaaggcaccagttcgacagacacattgcccactggtcttttcacagagactgctgagtgccccctcgtggctgcactggcagtgcttgacagcctgtggggccaaagccatagtagccaggggcacagaggtcacagcggcgcccaaccactccaggcttgcacaggcactgaccaccatgagggttgcactcagaactcagtgaaccttggtgatcgtggggttgtaa

SEQ ID NO: 496044 - DNA, 402 bp, Homo sapiens
ctcggtaccgctctccgtgagatcccatggacgaggacggaagtatgcagacaacttgattttcaaaacaggcgagacggcagagtctggaaaccttaaatgcagagcatatgttgatgtttaacagattattaaatcacattttcaaaaagatggattggagtcacttagaaaaagtggagatcagtatctagtattactcatcttcagttgacctcgtttctttttccatagttactgaacaagtgtatctggacatgccatagataggacacatctgctctggcagaatatataacaaagtgctatgtgttctactcaagatggacagatgtgttggagttcctgttggctcagcggtaatgaacccgactagtatccatgagtactctggtttgatcc

SEQ ID NO: 496045 - DNA, 286 bp, Homo sapiens
gggacagtgtctctcacccagtctggaatgcaacagcgtggtctcggctcactgcaacttccacctcccaggttcaaaggattctcgtgcctcagcctcctgagtagctgggactacaggcatgtgacactatgcctggctaattttttttgttatttttaagtagagacggggttttgccatgttggcccaggcaggcggatcacttgaggccagaatttgagaccagcctggccaacatggcgaaaccctgtatcactcttttagacccttctgtcgtcttctc

SEQ ID NO: 496046 - DNA, 124 bp, Homo sapiens
ggggggggggggtttttccccctttttttgggggggcccccccctttttttttagtaaagaaatttacctccccgccccccccaatattaccatatctgtttgagggccccaccctttttttta

SEQ ID NO: 496047 - DNA, 936 bp, Homo sapiens
ggttgctgtgacagtgaacaatggaggggtgtgtgtctaatctaatgtggtctgcaatcctggcctaacagacgtggaatggcctgataagatgtggaaggagagtattctggccgataaatccctggctactagaagtgagcaggacagcagaactgctttgctctgggcatgctcagctggacatacatcaaatagttgaagtgtctttgtagcgacttgtgagtgccatgtagcatatgatcagatagacgagtgcaggtatgtgctctcctgttcatattgctggtttctgctggccgggatgagattgtagaagcgcttcggggaaaaggtgctcatgtgaactggtgtcaattccagtaggaatggctgtactcccttacattatgcagtttcgaaaaatcaggcttgagatcgctgtcatgtaacatggaaggcggggctaagtccagatgctagggaccattatggaggctacatgcgatgccccggtgcagcagcctagggtaacttgcaggatgattcgatttccttctgtactactgtgttgttccacaaatgtgcaagactctgtaaggtagcattcctctacatgttagtgctgtgatgagggagagagtgccaagaaagccaaaactgggggtggtgccaaggacgcaagaatgaccgttggggaataacggagagaaagacacccctgcgaggtgggcaaaggtggctggcgtaatcaccaagagagggcgccaaggtaaccgcgttggatattctaacgtgatgtgggtgtctggcccgggccgccaccaggttgggggcaagaacacactggacgagagaggtcccccaagctaaacaggggctgcccacgggaagcaaccacgggtccaacgaaacggaagcccgggacaacacaaaggggagaacacagagggggcg

SEQ ID NO: 496048 - DNA, 250 bp, Homo sapiens
  misc_feature (3)..(3): n is a, c, g, or t
aanagagacagactgtctcctcaatgtgggttccccgtgactcctgactgggagaaacctcctgagtgggataaacctcctaacagggtgttgacagacacctcatacaaaagggctccagttggcattgggcgggtatcctcctgggatgaagtgtccagaagaaggagaaggcagcaatctttgctgtcctgcagcctttactggtgacacccaggtgaacagggtctggattggaactccagcaaac

SEQ ID NO: 496049 - DNA, 978 bp, Homo sapiens
ggctggtcacgaactcctgacctcaagtgaggtcacccgcctcggctcccgaagtgctgggattgcagatgtgagccaccatgtccagccaagaattagtatttaaagttgtacgatactctttttgtttttttctttggagagacgagagtcttgttcaatcccccatgctaaagtcgcaggggcaatgtttctccgcgcctcactggcatagtgcccgccttctggggtccaagcctatactcctgcctcaagccttccaggtacgtgggatacacaggggtttgtacccaccataccaagtggattgcgggtgttcttccatgtaacacgcacgggggtttcaccggtgttacgccaggtgtgatcttgaacctcctaaagcctcaggtgatcttaacttcgcctcagcctcccaaagtgtcgggagattagcacgattgtgaggcaccgggcccccagatttgtgagtcgctctaaacccttctgatcctatagtttctctctccaaaaatacgtctttctaggttaaaaacaacaagggctctaatattggggcctgtttacagtgcaagggttccaaggtccctcttggctcaccaagtagagaacgggtccctggggtgcccaaggttggtcgtcaacatcctgggcaccaaaaatccctcggtttggcgctgccaaggtgctaggttgatatcggggcggtagccccaaacccgggtgtaaaaagttccttttctcgccccttgtttttacaagtaggcggcgcaaggtgctcgtggaagggcccattcgcgtaaaagtgtatggccgcggttgtagcagtaatctggcgctcgcagacaaacttgtgttgaggtggtctccccgtgaaaacataattccgtgtgcgccgcacctgttgcgcgaacacaacataacataataacgaagtcgatgtatggtagcacgcattagataagatacgcacatgcg

SEQ ID NO: 496050 - DNA, 104 bp, Homo sapiens
gagccggacccggtcccatgcacagttggtgcatggtggtcctctggagctctgttcttctctatggtgccctgggctcccgttggctctatgtagtatgtgta

SEQ ID NO: 496051 - DNA, 373 bp, Homo sapiens
atcaagcatgatatatgggctttcatggcgaattgtattttaactgtgtctatggttgctggaaatgttgcgtttagtttataaaaccatgttttaagtatctacaggaactatagattagaatctaatgttgcattagtcttttcaggtatcttctacctcctgtatttcctactgtaataatgtaatttacggccttccacaatgaacagttcactttattccctgcgttgtctatgaacagttttaaggatatgacttggttaaaaaataattcggtatcaaaattctgtttgccaattaaactggagtatccacagtctcggccatgatttgtgagataatatggcatgcccggagccctgctcatctg

SEQ ID NO: 496052 - DNA, 369 bp, Homo sapiens
  misc_feature (59)..(59): n is a, c, g, or t
  misc_feature (88)..(88): n is a, c, g, or t
  misc_feature (114)..(114): n is a, c, g, or t
  misc_feature (175)..(175): n is a, c, g, or t
  misc_feature (200)..(200): n is a, c, g, or t
  misc_feature (286)..(286): n is a, c, g, or t
  misc_feature (289)..(289): n is a, c, g, or t
  misc_feature (323)..(323): n is a, c, g, or t
  misc_feature (353)..(353): n is a, c, g, or t
  misc_feature (358)..(358): n is a, c, g, or t
tcgcccaggccggggtacagtggcgtgatctcggctcactgcaacctctgcctcccggnttcaagcgattctcctgcctcagcctccngagtaactgggattacaggcacctgncaccacacctggctaatttttgtattttttagtagagacggttttgccatgttggccagantggtctcaaactcctgacctcaggngatccacccgccttggcctcccaaagtgctgggattacaggcatgagccaccgaggcctgtgttagttttatgagaaaaaaatganttntaaaagaggctttaaagaggtgaattgtatggtnttggaattctaatagtgctgttaacaacancaaanagaccaaaaat

SEQ ID NO: 496053 - DNA, 275 bp, Homo sapiens
atttgggttctttttttatttccccaacctctaaccacattcaatccaggacccaagctcaaggaataatgggaaaaatggggtaaactgtccctggaactttatcaatattgccttaaaaaacaaaagctcatcaagggtggaaataagggatccttcagttaactttgctttcctaaaaaaaattttcaggttttgataagtcatccctatttttatcttggatcaagggcttttctacagttacataataaaatgaaatgctgtccaggaaa

SEQ ID NO: 496054 - DNA, 166 bp, Homo sapiens
gtacctgtggggagggggaggttgggcacctcttggagggacctcctgctgaagggtggtcagcctgcctgacaattggaaggacattacttgaatggggagcagggtatgtgcttacatttgaaaaagagctgatgttaaaactcatttggtgaggtcaacgttg

SEQ ID NO: 496055 - DNA, 190 bp, Homo sapiens
ggatcccaggcaggagcgtcatgtcagtccaggttggtcagtcactctatagacatcaaagcatggacatggcatcgaggcccttggggatctagatccggaatcctcatctttattttttgtattttttatttttctctttaagagacagagtctggctcggtcgtacaggatgaggctaggggcgcgg

SEQ ID NO: 496056 - DNA, 128 bp, Homo sapiens
tgtatgcagaggtgctctctgcggatacgtggagggccgcgattgctgtggttgcacctccaagaaggatgctccacagaattcatgagcacatcccgtactcgtggacatgcagttcctctattgcc

SEQ ID NO: 496057 - DNA, 444 bp, Homo sapiens
  misc_feature (380)..(380): n is a, c, g, or t
cgcatagacacaaagggagtacatcctgctttaaagatgatttcagtagacttgcgggatgcaagattgtcacaaaacttcaatttttaaaaaatgcactatttgggaagcacaataaatcaaagtggtataaaatgaggtatgcccttatacatacagtggaatattattggccacaaaaaagtgatacttccatttgtgacaacatgggtgaaactggaggaaattatgccaagtgaaataagacaggcacagaaagactagtatcatatgatttcacttacatgcagagttgtaaagaattaaactcgtagaagctgataacaaaatagtggttgactagtgttcaggggtgggagaaatggggagaagttgttcantggttgcatattttatggtttatgatgaggtcagatcttgttcagcatgggtggtgattgggtc

SEQ ID NO: 496058 - DNA, 2634 bp, Homo sapiens
ggtttatcctaaattactcaaccccttgtagccttgacaaattttaccttaaaaccaaaatgaaacacaaaaattaatccttaataatgatagcaagtgatctttctttttagttttagccttcctttttcaatagtaatatttaaacccactcttgaccaattgtttgcccaaatattcttgtcatttggagtcagtggaaaatccagcacaccaagcaccagtcttcttctgaggcaaaagaaaagtgttgtcattttcactctgttggagctgcacactttttttctttttctttttttttttttgtcgtgtaagaaggatgctggtcagagctgcagaaaatatgaggcaattaaaagtctttagctgttagcaaacctgttagttttacttctgcattgaaccagcctcagaagctacttactgctttatgtactctttgggcattaatgccttctctgtaattatatctcgtttttgcttgacagtgacctagccagtaattgcatcgtgcattgccatgaaaggtaaacacattgtgaactgaacttaccaagcagattctgtaagaaagcgctggttgaggctgaacactgttgacacatcatttttattggaagagtattaactggtgcctcttctgaaacacaccaacccatattcctctgctcccccaaagctgtttctgatcctgctgggagcaactaactagttattatgcacatctgctccagacccagctctttaacttcacggttttacagcttgttttttctttttcttttcttttcttttttttttttaaaaaagcacctttttttgttgtttccccttaataaaagaggtttctaatttatgtttctctaagatttcctttggttgtatttagaaacacaaatagttttataatcaggattgcatttgtgctgggtaaaagaggagagctgtgctttctaccccaaagttgttggtaatggagccggtctgcccttcctacaaactcaagaggctcattgttcaaggtgtaacaacatttaattgcatgtcctctaacgctttgaaacctttagagggaagatcctcattttttacaattttgttccttttcatcatagaaaacatgtttaagataaaatacaaactttacctaccccaaattcataaagtacatttagtgctgtatagcactaaaacttagagatacagacactgtacttactttttaagaattagagacagtaactccaaaaataattgtccttttttctttctttttttttttttacaataaggctcttgaaaattgtcattacttgtgttttcctatacattcatctgtgtgaaagcctttttcttctttgatttaaaaaaaattatacagttaatggtttagaacttagaactacttagaattaatgctaaagtgtcaggaagaaattaatttagcttcaataattgtgactggcctcaggaattctcccttccacacctgcccacctcacctcacctcacctcaccgcaccgcaccgcaccgcaccgcaccgcaccagagccagagcagctgcttgtctgcagcaggacacggttcctacatacgtttcagttctttcatggtaagctcaatggacctttgaattgtttacagtgctgtatgtccaattgttaaatgtaccattctgaacgatgttaaagcaagtgtggtttatttatggcatgaaccatgtaacttgaaatatgaacttacaaggaggggcactcattaggtaacaagttcttacaccaaacttccttgatgaaataagccaaaataatcctaaaattcattagaagaacttgataaaagactcaaataaatgttagaaagagcccataattttaggactcctataaaattcttccttgtttgttaatgctattaaaactcagattcaagggaaataccagcttccacttgagtcactttgaaatagttaattcaacagcaccatgttagaaatatattggcagccaagactctgaactctgcagaaacatttgtttcacccagacttcaaactctagccctgactatgatgcccctgtgtgcatttacaataaagactccaacggagggagcctgttggtgttaaattgtttacatttctttatacaaataatgtgctttcagtgccttagttacagctccctttctgtttcttgttccaaggattctgtagtatgtagtgtgtttcttaggtaaagtctcttttgctactgaaagggaaatggtctctaaacactggtcactgtagcaggtaaacactactctaacgtggagaaatgagcttcatgctgaggtagtggttgccttagagctgttatttatgctgtagaaaacgaaaatggttttgctacctgataagcttcagattagatatagccctaaagttatcctgtacctgcattaaattttcattttagaagagaatcttggttttggtaattcatttttttttaagatcattatgtgcaaaacaccaagttttaaaaataactcacagaatggccttagttttcaatgtctgatggtatatttgtgagttgtgttatctgtaatatacatcccagaataaaggagtgaattaaatagtt

SEQ ID NO: 496059 - DNA, 212 bp, Homo sapiens
  misc_feature (121)..(121): n is a, c, g, or t
ccccccatttttttaggggaaaaaaaacctaaaacctggggaaaaaaaaaaaggttagggtttaattaaattttggccggttttttgggaggtttgacccggaatttgcccctttggtttncaagggtttccaaaaaaggggccccccccaacttcagggggggggaggttttttccggtggccaaaaaaaccttggtaaagccttttggga

SEQ ID NO: 496060 - DNA, 660 bp, Homo sapiens
tgggcagatcacctgaggtcggaatcatagtcagggctagagtttgaagtctgggtgaaacatttgtttcacccagacttcaaactctagccctgactatgatgcccctgtgtgcatttacaataaagactccaacggagggagcctgttggtgttaaattgtttacatttctttatacaaataatgtgctttcagtgccttagttacagctccctttctgtttcttgttccaaggattctgtagtatgtagtgtgtttcttaggtaaagtctcttttgctactgaaagggaaatggtctctaaacactggtcactgtagcaggtaaacactactctaacgtggagaaatgagcttcatgctgaggtagtggttgccttagagctgttatttatgctgtagaaaacgaaaatggttttgctacctgataagcttcagattagatatagccctaaagttatcctgtacctgcattaaattttcattttagaagagaatcttggttttggtaattcatttttttttaagatcattatgtgcaaaacaccaagttttaaaaataactcacagaatggccttagttttcaatgtctgatggtatatttgtgagttgtgttatctgtaatatacatcccagaataaaggagtgaattaaatagtt

SEQ ID NO: 496061 - DNA, 102 bp, Homo sapiens
  misc_feature (16)..(16): n is a, c, g, or t
tgtgggtagcagcaancagcataggggttaggagatctacagaccagtcacgacctggcctttcattatcaaaagtcccaagcaatataaaaacctttcttt

SEQ ID NO: 496062 - DNA, 1214 bp, Homo sapiens
  misc_feature (445)..(445): n is a, c, g, or t
atgtattgtaccaccgcctgtccgatcgtgccgtccggctcagttcaacgtacactgtcgacgtcgatgtagattggcactgtgtgacaatgcaattcgtcccgcacagagatcggaggtcggcaacttctgtcccacaagcactgcaggaccatcgacacttggcagttgtgttggctagtatcagaccccgtggaatagcacatgtagagactaggacacagagcattgggagttcccgtcccggggacatgagacatcaacgctccgcatgtgtaaacactatactggcatatggtgagagacacaagggcacgtgatagatttccgaggcgactgagcacatgacacgtgcgggcttgatcacacggacgtaacgctgttgcggtgatcataatgcacgtgcacagagagacctgatgctaatgtacttgcttccacgaangttattcgcacctttatcgggtaggcccgaacgtaggggggctacgcccacaggaggtcattcaatacgcacggagctctactattagctcaaacttacgtgccagtttcgtttctgaagctgttggggtaaggcggtttccttgagacacatctggtggtgcaaagtagtaactaagagcaaattggagtccttacacattcgcgagtctcaagacttatctcccattggataatccatttttggggtacagtacctatgacttcttacttcgccgacatgtggtggacattcactgggggttttgacccctgttcaccaagaaaaccacatttggtttgggcggaacccactttgaaagttacccctacttaattggcgaatagacctttaatatgccacctgagggacttagattatatcggcaaccatgcacaagtctatacttggataaatataggaacctaatttcatagattcgcatgatatcctttgaagaaatggctaggtttccgtggactttatccttaccaaagctatggaatgccgttttacaccggatacaaccaccgtccatggataaaatcgcgtccctaatcacactccccaaatataccttgggcgttctgagttactatgttgtatatataatttaccctgtttacaacaaactcatctattttgccccatataaacacttgcatcccacaaggattcacccttccaagtatattgaacaccacctaagaaacccaccaatttatcccgg

SEQ ID NO: 496063 - DNA, 108 bp, Homo sapiens
gacacagcttatccaagagagagatgatatagtgctgcaacctaacgatatgaatacaagtcagctggaatcgagcagattcagctagctgaaaaaatatattcaatg

SEQ ID NO: 496064 - DNA, 915 bp, Homo sapiens
  misc_feature (59)..(59): n is a, c, g, or t
  misc_feature (61)..(61): n is a, c, g, or t
  misc_feature (89)..(89): n is a, c, g, or t
  misc_feature (94)..(94): n is a, c, g, or t
  misc_feature (96)..(96): n is a, c, g, or t
  misc_feature (277)..(277): n is a, c, g, or t
  misc_feature (279)..(280): n is a, c, g, or t
  misc_feature (284)..(284): n is a, c, g, or t
  misc_feature (300)..(300): n is a, c, g, or t
  misc_feature (307)..(307): n is a, c, g, or t
  misc_feature (313)..(313): n is a, c, g, or t
  misc_feature (315)..(315): n is a, c, g, or t
  misc_feature (326)..(326): n is a, c, g, or t
  misc_feature (337)..(337): n is a, c, g, or t
  misc_feature (353)..(353): n is a, c, g, or t
  misc_feature (362)..(362): n is a, c, g, or t
  misc_feature (366)..(366): n is a, c, g, or t
  misc_feature (399)..(400): n is a, c, g, or t
  misc_feature (407)..(407): n is a, c, g, or t
  misc_feature (418)..(418): n is a, c, g, or t
  misc_feature (423)..(423): n is a, c, g, or t
  misc_feature (428)..(428): n is a, c, g, or t
  misc_feature (431)..(431): n is a, c, g, or t
  misc_feature (441)..(441): n is a, c, g, or t
  misc_feature (492)..(492): n is a, c, g, or t
  misc_feature (534)..(534): n is a, c, g, or t
  misc_feature (546)..(546): n is a, c, g, or t
  misc_feature (553)..(553): n is a, c, g, or t
  misc_feature (564)..(564): n is a, c, g, or t
  misc_feature (566)..(567): n is a, c, g, or t
  misc_feature (580)..(580): n is a, c, g, or t
  misc_feature (582)..(583): n is a, c, g, or t
  misc_feature (588)..(588): n is a, c, g, or t
  misc_feature (591)..(591): n is a, c, g, or t
  misc_feature (606)..(606): n is a, c, g, or t
  misc_feature (608)..(608): n is a, c, g, or t
  misc_feature (611)..(611): n is a, c, g, or t
  misc_feature (624)..(624): n is a, c, g, or t
  misc_feature (628)..(628): n is a, c, g, or t
  misc_feature (641)..(641): n is a, c, g, or t
  misc_feature (643)..(643): n is a, c, g, or t
  misc_feature (648)..(648): n is a, c, g, or t
  misc_feature (650)..(651): n is a, c, g, or t
  misc_feature (656)..(656): n is a, c, g, or t
  misc_feature (659)..(659): n is a, c, g, or t
  misc_feature (663)..(663): n is a, c, g, or t
  misc_feature (668)..(668): n is a, c, g, or t
  misc_feature (671)..(671): n is a, c, g, or t
  misc_feature (692)..(692): n is a, c, g, or t
  misc_feature (698)..(698): n is a, c, g, or t
  misc_feature (702)..(702): n is a, c, g, or t
  misc_feature (709)..(709): n is a, c, g, or t
  misc_feature (716)..(717): n is a, c, g, or t
  misc_feature (727)..(727): n is a, c, g, or t
  misc_feature (768)..(769): n is a, c, g, or t
  misc_feature (773)..(773): n is a, c, g, or t
  misc_feature (778)..(778): n is a, c, g, or t
  misc_feature (786)..(786): n is a, c, g, or t
  misc_feature (794)..(794): n is a, c, g, or t
  misc_feature (798)..(798): n is a, c, g, or t
  misc_feature (809)..(809): n is a, c, g, or t
  misc_feature (818)..(818): n is a, c, g, or t
  misc_feature (851)..(854): n is a, c, g, or t
  misc_feature (861)..(861): n is a, c, g, or t
  misc_feature (876)..(876): n is a, c, g, or t
  misc_feature (879)..(879): n is a, c, g, or t
  misc_feature (900)..(900): n is a, c, g, or t
ccccctcccatccacttcagtaccagaaaactaaatatccaagaattcctgggtaaaananacaaccactagatagatataactaacgnatttntntaagctgtatagttcttcatcaaatggaaatcggcaaccacatgaaaataacattaaaaattagtgtgggcatgaagtatggaattttaaacatcagtttactatgctgattaagtcaacatttatattttcatcagaacttaataatcccataaataaatagagctctcagttatttaanannatcnagggataacatatgtntttgggnatattngnggcgtaaaggngtatgcttcancacacttattgggggnacgtctganaatnttactacactgaattgcaagggtatccaaaggnncccgacnaagaagtaccncagangaacnacnttacagggantttcaaaaaagaaaagggggcaaataggaaataggcctcaaattaatttgncaaaagtcacagttgtttgccgccaaacaaggtttttctctnctctccacctgnaaaaaanaaaagtctcangnnatagggttgaatnanntaaanacngaaaagttcactccnangtngaaaaaaaatggngaanagcccgctttggngnacggntnncacanggnggangtcgngtnggtatgtagcctaacatttcngcctgngtgnagttaanaaaaaannaatcccgtgnacatgcatgcctgatttccactcaaaggggatgtccggatnnattnacacnacaaccangggagtcntganaagcgtgttgnaacgataanaaaaaaaaagaattgtttgtgtagattgccccnnnnaaaaaancatcattttggcatnganattcaagttttccacttttcncaatttttctttttt

SEQ ID NO: 496065 - DNA, 185 bp, Homo sapiens
  misc_feature (16)..(16): n is a, c, g, or t
gccctataatcacatngcagtgcctgggcaagagggcccgaggaaacgtcttcatgtaccatgctcctggaagaactacgggcatggcatgaaatccgaactacccttatgagttctcagggaaagtacccacagtttgcatacccccgggcctgactttgtaccccgtgctggtggagagaagt

SEQ ID NO: 496066 - DNA, 113 bp, Homo sapiens
aggggcacgctcctgtcggtcatgatgctgatccacttgggaacatcagttcctttcctcttcagtccgcagcgtcatcagcagcatccctgcagccatcttggtccaatcca

SEQ ID NO: 496067 - DNA, 897 bp, Homo sapiens
ggcgggcgctgctgttgtgtttgagtgtgcgagtgtgagtgagtgtgagtgccgggtctgcctctcctggtgcccccagcagaggggcccggtggcctggtggatgtggcgggcgggctgctcggaggcagaggcagcaagagtgctggcgtgtgtgtggagagcctgagaaggattggaggaggagagagtgaaatgagctggagcgagagcattgttgagtggaaaccttgcaaacaaatgaatgtgcatcctggagtcccacggggagcagaatgagatgagaagtggaagaaggatgagagaagttggaagtaggaagagggggtaggggtaaatggaagggagtggagaggaagaaatgaggtgcgaaggatgtaaaagatggtgagtgagaaaggcatataggaaaaagggaggacagagaaagaggagagaaacagggagggagcgaagaattgggttgagctaaggaatagcgaagagatagatgcggaatagaaagaagatataaagggaaagtaggagaaaggtagaggatgagaaggaaataacagaagtggaagcaagagaaggaaagcaggagagataaagagaagagcgagacgagaggagaaatgggaataaagtgagaggagggcaagagcaacaaggaagagagactgatgaagaaacgagaggcaacggggggacgagggagggaggaaagaagggtgaagaggagggagggtaggagagggaggaaggtgagggcgaagagacggaaagaggggggtgaagggaagaagaagggaagcgcgagagaggaggaggcgaggggtggagagaggaggaggagggagggaacgagaaaggaggggaggaagaagaggggagacaggaagggagtagagaagg

SEQ ID NO: 496068 - DNA, 214 bp, Homo sapiens
cttagagttagaggtgctagctgctgctatcccaagatcctcagcagagattaaaaggaacccggtgtgcacagcagatccccgaaattggtggacttgacctccatggcaaattgctgcgtctttccacttgctgtccaggacccactaaactgctgaaatgtggactgcttacccgcacatcaaagcaacttcattgtgtactacaaaaaaa

SEQ ID NO: 496069 - DNA, 120 bp, Homo sapiens
gtctcagggcaaagagaccatttattacccagaatggtttgttctaatgcttcttgtcggcatgccgccgcatcaggggcgattctgtccagatctctttgtcccttctgtcgtcttctc

SEQ ID NO: 496070 - DNA, 315 bp, Homo sapiens
gggctttatactaaatgggaacgttgtggaaaggccgtgagatttgcgccctccccagtttagttatttgccagctactttaaccagagtggcgacattttgaaatatttcctatgaccctcgctaacagtttcatcccctggtcaccccctgctggcccagggcctgagctttttcaaacaagcatgacatgggttttcttttcattttttctgttctccaaagtagatcgggcttgtgacccctgtgtgtggaccttcccccaatattatctttttggaacggagcagaaaaaaataaacttccattaggtga

SEQ ID NO: 496071 - DNA, 265 bp, Homo sapiens
ttaatacgtcgatgagcgctaatcctggacacacactgagtcccaacttgttcacatactgagccctgtatcctggacacacactgagcctcaaccctggtcacacattgagccctgatcccagtacacacaccgaaccctgaccctggtcacacagagccctgatcctggtcaaacagtgagccccaaccttggtcacacacttgagacctgaccattggttacagtacttaaccctgggggaactcctcttagaagtcgacct

SEQ ID NO: 496072 - DNA, 1200 bp, Homo sapiens
gcggccgcccttttttttttttgtttggacagatgtggggcctttatattattgggggtccctctatatgtggaacaggggacctccccaccccaagcctagtgtgcctcgtggcacccccataaccagatacacaagtcccgtgaagagatccccttataaaatcactaatagtaaaaaaggagcgaaggagggaaggccagaccggcccaaaggctggggaagctccggtgtcggaagacagggccatgggaatggacacgaggggcgcgtgggcattcggccgcaggaaggcacatggcgtccccagccccgggggcgctcacccgatagccgggagaggcggagatcacacaaaccgccgggagactggaaagacatggtggtcagacgcatagtggcgtataatacgtatcaataggtcagtgcaggcgcaatggccacagagccagagatgggatagctgagaagtgggggtggcgccctacctgggaacgtgagggagacacaggggacgaccaccaataccacggatcggcagagagggagagaaacccacgagagagggcatgtggccccggagagaagggacacagtgccacacaaaaagcggacaaagtatctcgtggcgctttctccccgtggtcgcctttgtgcggccacaaagtagcgaagataggcgcgcggcaccccagcagaggcgagagactcacaaaaatccccccaggaaaagccccccaaagtggcgcccatgggcggcacgcccaaggggggcccaacaggcggggacgcccccaaagcccaaaccaaaagggattcaccattgggggcaccaccgcgggaacaaccgcccaaagacaaattaggacaccaccgcaggaaccagtcgggagaatgagagcgacactatgcgggagcaaccagggaagaacagaaacccggctggcgagccaaacacccacaagacgaaaaaccaaccaacgacaacccacacaaaacgccggccctctgttacccccgccagctaaccccatgccagatgggtgaacaatcccacccaaacacgcggcccacacaaacaagcgcgcgcaacaccgagtagtgacagcaaggaccgccaaaggtgagcaagaagcacaaataggaggaccccacccgacggggaggacaatgaaacaacaataggaaatagacacaaag

SEQ ID NO: 496073 - DNA, 91 bp, Homo sapiens
aaaccctttttttccccttttagccagggcttttcaaaaaaccttgggcctttttacctaaaaaaaaaattttgtttggcccctttgggga

SEQ ID NO: 496074 - DNA, 196 bp, Homo sapiens
aatacccactatgtgtttgctctgctgtcatgggatggagaggcaggctgattacatgtgctcggcacttgtgctaactcctttactgacttctctcatttaattcacatgacaggaggttctgggaagtgcaggacacagcgagggccttgatgcctgcttctccgcgcgtcgttagacagcgacgctcatacca

SEQ ID NO: 496075 - DNA, 179 bp, Homo sapiens
ccgagattgcgccactgcactccagcctgggcaacagagcaagactccatctcaaaaaaaaaaaaaaaaaaaaaaaaaattcctctgggtggggcccgggggcccgggcttgtatccccagcttttgggggggccaggggggggggatcacgagggtcaaaaattcggagaccatcctt

SEQ ID NO: 496076 - DNA, 1129 bp, Homo sapiens
cgcaatggaattgagtcctcaggggacgtcaagacgactcgaatcaaccaggtgcccacggttcggcccggattttacgggactgctgtcgggagcgttcccgggaccaccgcgttgcctggccgccgagggtgtttctctgcatacctgtctttcttccaaacatccactggtttaacgacgccttcgcgatcctttcccccttgccaatcgcctttacgggggccgcgtttacgaagggccgtggccatatgttgcgcgtgccactgagccttttgggtttaacccccacccattctttttcctcttccgcatgtccgtgtgggaaaagacctgggaagggctagccgccccatcgactgcgctgagcctaggcggggattcgtagggaatgggcgatgcttaggtgatttgatacacttgcgagcggaatcaacgggttgcctgcggcgcttgcatgctggtgagtcctgcgacttgcgatcctgtccgtccatctttcccgatcctccagctgtggactcaactgagacggtcttagcctgacgaaacgctggaaaggccgcgctcgatcggacaaagggctctgtgcgatgagctatggtcttgtgcattgcgcattttgaccgcaaggtgtgactcttcctctcagctgaaggtgatatcacctgcttcaccgggctccatgtccctcaacgtgagtccctatcagaagtcctcacagcgtagcccatgctctgacggtccttggcttgagagagtcttggccacaatgctgcgaaaagtttctagccgacgcactccttgtccctatccactgcatctcgactgcatatggggctcccataggctgttggcctggaccatcatgaagggttaggagtgtgtacggctagtggaaggcccccctgatggagctacgtgcggcccacagtaccgaaggcatgcaacctttgcgcgcagtcggtcgagatctcatcagccccaggctgcaggtgaggcttcaggggactcgcaggggtccactcactgccacctccgtctgccttgccctccatccttcgctctgttaccttctgaccgggcaccacagcactggggctcacttacgctggagcctcttgtaagt

SEQ ID NO: 496077 - DNA, 126 bp, Homo sapiens
ttctcttacttcagctaatgtaattcattaactgtgtataactgaatctatattttcatttatatcacaaattcagaaaagattattttccactcacatctggaaaatataataaagcttcattct

SEQ ID NO: 496078 - DNA, 332 bp, Homo sapiens
  misc_feature (238)..(238): n is a, c, g, or t
  misc_feature (240)..(240): n is a, c, g, or t
  misc_feature (279)..(279): n is a, c, g, or t
  misc_feature (298)..(298): n is a, c, g, or t
  misc_feature (318)..(318): n is a, c, g, or t
acagtgagagtgcacacgtttgctatatggctctgagctgctgagtcagggccaaccctctgatcaccctcctgtagctccaagaaggagggcagttattcaccctccacgccgttccttcctggggttcgggggcagctccccggaggcttcaggtacccacctttcctgcaggtgtccagggctcctctgccttaccagtggggtgggcgaccattcaccaaggtgtgagggggcngnggggacttgctggggggttgatcaggcaggtcccaaagncttcttttaaattaatttnaaccaattaaaatttcttanttttccttgtttcc

SEQ ID NO: 496079 - DNA, 1022 bp, Homo sapiens
  misc_feature (521)..(521): n is a, c, g, or t
atggcacatgcagcgcaagtagggtctacaagacggctacttcccctatcatagaagagcttatcacctttcatgatcacgccctcataatcattttccttatcgtgcttccatagttcctgtattgcccattttcctaacagttcacaagaaaaaataactaatagtagcatctcagaccgctcaggaactagaaaccgtctgaactatcctgcccgccatcatcctagtcctcatcgccctcccaatccctaagcattcctttaccattaacagacgaggtcaacgatttccctccctttaccatcaaatcaatgtggccaccaatgggtaactgaacctaggagtacacggactacgggcgggacttactcttcaacttcctaccattacttcccccaattaatcctagaacccagtgcgacctggcgactcctttgacgttgccaatcgagtaagtatcccggatggaagccccacaattcgtaataatactttacatcacagaggacgtctggcanttcatgaagctggttccccaacaattacgtggccttaacacacatgattgcacttcccgggacggttataaacccaaaacacatatcagcggctaacacggcaccggggggtattactacggggtcaaatggctcttgacaactctggtgggagccaaacaccaggttttaattggccattgtcctagccattaagttccgctaaaacttttggacataggggccggtaattacacttattgacacgctttaacgccctttagagtcacaaacagcaacacacacaccgatcaaaatttggggcgcccacggccctgaagcgaggtgataaaaacatggatgagggacggcgaccacaagaacgaacaacagcaccacgtgacctaaagaaccggcacggacgatgatgtctcccaaaaacacgcgcgaacgacacggtataaacacagagaaggacagcgtcacaagaaccggcaaaaagccagccactggagcagcgac

SEQ ID NO: 496080 - DNA, 166 bp, Homo sapiens
gtaaaggcagatgggccagaaggagatggggagccaggacacccaaagccacagactacaaatgccccaggagagggagagggaggtactcctgccccctaccagtgacatcatctggagaaggtgtccctcctgtaccactccatgtgcccctcctagcaacagc

SEQ ID NO: 496081 - DNA, 163 bp, Homo sapiens
cacagggtactcagctgccctgcatagaattagaacatactcctttagctcggagaagttagatcgtctgaagccttctcctctcaactcatcaaagtcatcctccgtccagctttgttctattgctggcgaggagctgcgttcccgaggaggagaagcagca

SEQ ID NO: 496082 - DNA, 180 bp, Homo sapiens
tttactggtttctatgagtttggcttttaaaatttcacaagtaagtgagattatgcagtatttgtctttctatgccctgcccagccactccagctccagctgtgacaaaaaggggccaatggacagctaaggctgttgcttcagaagatgcaggtcccaagccttggcagcttccacatg

SEQ ID NO: 496083 - DNA, 139 bp, Homo sapiens
taacacagcatccggatattaagtagagagcatgcctgtcgcaaacatcatactgatctgatgttgatacttttatgccatacttggaaaactcccataataaattcttcctccggagagaacacaaaggcaactttcc

SEQ ID NO: 496084 - DNA, 206 bp, Homo sapiens
tgctgcgggcctgtacgagggagcagagactgctcctgtgcagaatgaaggcctggggtggagatgctgctgtcctcagatgatggtgatgcccatgtccttctccagcttcggcagaggttatcgggactggcccgctgcctagggctcatgctcagctctgagtttgcagctcccgtgtccgtccctgtgcaggaaatcctgga

SEQ ID NO: 496085 - DNA, 926 bp, Homo sapiens
  misc_feature (11)..(11): n is a, c, g, or t
  misc_feature (163)..(163): n is a, c, g, or t
  misc_feature (210)..(210): n is a, c, g, or t
  misc_feature (378)..(378): n is a, c, g, or t
  misc_feature (410)..(410): n is a, c, g, or t
  misc_feature (701)..(701): n is a, c, g, or t
  misc_feature (711)..(712): n is a, c, g, or t
  misc_feature (729)..(729): n is a, c, g, or t
  misc_feature (757)..(757): n is a, c, g, or t
  misc_feature (762)..(762): n is a, c, g, or t
  misc_feature (771)..(771): n is a, c, g, or t
  misc_feature (778)..(779): n is a, c, g, or t
  misc_feature (789)..(789): n is a, c, g, or t
  misc_feature (791)..(792): n is a, c, g, or t
  misc_feature (797)..(797): n is a, c, g, or t
  misc_feature (813)..(813): n is a, c, g, or t
  misc_feature (819)..(819): n is a, c, g, or t
ggtgagctgcncgcaagaggacggcagaggcccggcagctcggagctccgggaccttgtggcgcatcaggacgctggctgtccctctgcctgggacccatgagcctgccgcctgcctgctctgcctcctgcgtgttagcctcctctgctgcgctcctgggcanggcggcctgtgggatgcctgctggggcgatggactggcgctgaggcntgctgctgcttgccccctggccctgcgcggctgtgaaactggaggaggcctgagccaagcggctgtgcccctcttatgctgggaggatgctggagagtagcggctgcaaagcgctgaaggagggcgtgctggagaagcgcagaggacgggtatgttgcagctctgganagaaaaacgtgttgcatcctcacctgaggaangggctgctggttatccctgcccaatgcaagctgcaacaccagcaggcagcagcaagcagcagcagcagcatgcacggaacaacacgcccggggcatgggtgccggacgaatgccgtgcaacaccatgtggaccccgtgtgtcgccagacctccgagccgccggtcaagctcaaggaactgcagttctccaacatgaaggagcgtggactgttgtggagcgcaagggcaatgtacaatgtacttcactagtggtgatggcagagggtaaggagatcgactttcggtgcccgnaagaccaggnntggaacgccgagatcangctgcagatggtgcagtacaagaatcgncaggncatcctggnggtcaannccacgcggananngcagnagcacctggtcagagnagcccncatcgcagacgaagcggaaccgagagctccggcacgaaaccgaggtaagacttaggcggaaaccaagccaagaacaacccaagctcaagccacaaccaggataaccg

SEQ ID NO: 496086 - DNA, 1925 bp, Homo sapiens
tggctatgtagaggcctggtgttaattcggccgaggcactgctggcgggcccgggagatccagcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 496087 - DNA, 542 bp, Homo sapiens
  misc_feature (313)..(313): n is a, c, g, or t
  misc_feature (323)..(323): n is a, c, g, or t
  misc_feature (340)..(340): n is a, c, g, or t
  misc_feature (390)..(390): n is a, c, g, or t
  misc_feature (454)..(454): n is a, c, g, or t
  misc_feature (478)..(478): n is a, c, g, or t
  misc_feature (504)..(504): n is a, c, g, or t
  misc_feature (523)..(523): n is a, c, g, or t
cagggcagccttcagtctgattcaggagaacgaggtcctcttcaccatgtgcttcatccccctggtctgctggatcgtgtgcactggactgaaacagcagatggagagtggcaagagccttgcccagacatccaagacctccaccgcggtgtacgtcttcttcctttccagtttgctgcagccccggggagggagccaggagcacggcctctgcgcccacctctgggggctctgctctttggctgcagatggaatctggaaccagaaaatccgtttgaggagtccgacctcaggaatcaggactgcagaaggnggatgtgtcngcttcctgaggatgaanctgttccaaaaagaagtggatgcgagagttctacagcttcatccacaganttccaggagttcttgcgccagtataactgctggaagagggaaggaagagacgttccagggatcnttgagcttccagccgagagtgacntcctctggaaactatgcaatcggggnattgatttgtgtagtttcnctttgctgtccagagagct

SEQ ID NO: 496088 - DNA, 2076 bp, Homo sapiens
tctctgaagttccagaatcgatggaagtggacggcacgccgcggcggggtgggtgcaagatgccgctgccggttcaggtgtttaacttgcacagcagccagccagctctgtgtcagggtcggggggtgcagaaagtcaggacagaatgagggatagctcggcccccagctcggcctcctcgtcagtgacagatctgtactgcacccctcacaggcagtaggtcagacctcgtcctgcccggcacggccggggacttcagcctgagcgccagcctgtcggcctgtacgctgctctacgagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 496089 - DNA, 536 bp, Homo sapiens
acattttttcaattacattacatcataaatgtcccagagtagttaccaacattacattatgtacaccatttataggagggtaacacaaaccttgtcaggtggaaacttttcaccccacataactgaacgctaaacactcctggctgttacatgtcacaggataccactggggtcagccactcgaagcacaataaatataaaatgtggcccttccatgaaatttttgataaccttctccaaaaacccaacaaaggcgaggtttaaaagaagtttttgaagaaatacaaggatctttctcgtcccctacaaaaagttcacaaaagcatcaaaatgagggctgatcctaccacaataagacgttttgggccaggcagtgtgcagggtggatataagcacacccctttaacatttttcttttttctttttttaagaaaaaaaaactttttttttgtacaaatatacaaggccatgttttttcagcccctttgcgctaaaaacggcatgacgctgccctccaaaaacacagtattataggg

SEQ ID NO: 496090 - DNA, 1740 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaatgtacgccatcatgtctcaatgatgctggactgagatgacaggacaacctgctcctggacatgtatctggccccccatgtcaggaccctgtacacccagattcgcaaccgtgccctcatccagtaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 496091 - DNA, 1948 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaaggtgggctggcttgagggggggcaggcgcacggcgtgtggggcctggtggctgtgagctgctccttgtctcccctgcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 496092 - DNA, 1927 bp, Homo sapiens
  misc_feature (1602)..(1602): n is a, c, g, or t
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctcccctccaggacatcgggggcccaaaagcccacccccccgccctccttgtgaccccccntcgccaaaaccctaccaacgaccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 496093 - DNA, 2027 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 496094 - DNA, 404 bp, Homo sapiens
aataaatgggaagtagttggtaacatggctgtgtcacgctactactttgggtgctgtgaaatgcaaggtttaatttatgtaattgggggcatcagcaatgaaggaatagaacttcgttcttttgaagtctatgatccactttctaagcgttggtctccacttcctccaatgtggaaccaggagagcatatcttggtgtggctgcactcaatgactgcatctattctgttggaggatggaatgagacccaagatgctcttcatactgtagaaaaatattcctttgaagagacgtcgtcttgctcagtcaccaggctgctcggctcactgcaaacttggcctcccaggagaatcgcttgaacctgggagacagaggttgcagtgagccaagatcacaccattgcac

SEQ ID NO: 496095 - DNA, 1849 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 496096 - DNA, 1734 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 496097 - DNA, 2118 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggccaaaaacccccgagggaggggcgcgcaagaaggcagcagcccacccgactcgcatgtattggaagaaaaggcgcggcgccaacaaggagggcgcccctctaatgaacaagcgagcgaccggggcggggggcgctacaaacaacctgcggcggaggagagacagaatgtgggcgcagcggcgacatatggggagaaggacaccccacctagctggcgaggggagagaaacgcgggggacgaaacgtgacgag

SEQ ID NO: 496098 - DNA, 149 bp, Homo sapiens
ttactaaatatgaggcactacaaagtggtaagagatcccatacatagtgaagcatacaactgtaagaagtagtaggaaagaccactagattcttcagtagatggagctacgagtggtccgggggagtcctctgagcagtcgaccgtgca

SEQ ID NO: 496099 - DNA, 2260 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgccgcaggcttggcagagctggccgccaggaagtacaagcaggctgccaagtgcctcctgctggcttcctttgatcactgtgacttccctgagctgctgtcccccagcaacgtggccatctacggtggcctgtgcgccttggctacctttgaccggcaggagctgcagcgcaatgtcatctccagcagctccttcaagttgttcttggagctggagccacaggtccgagacatcatcttcaaattctacgagtccaagtacgcctcatgtctcaagatgctggacgagatgaaggtgggccccgcctggggtaggggtgaggtggggccctgcctggcctcctgtcctggtcctgaccagccccttccccaggacaacctgctcctggacatgtatctggccccccatgtcaggaccctgtacacccagattcgcaaccgtgccctcatccagtatttcagcccctacgtgtcagccgacatgcataggatggcggcagccttcaataccacggtggccgccctggaggacgagctgacgcagctaatcctggaggggctgatcagtgcccgtgtggactcacacagcaaggtggctgtgggctgcgtgggcggtgggggcagctgggggtgagcctgggccccgctgagcttgtgcctgcacaaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaaggtgggctggcttgagggggggcaggcgcacggcgtgtggggcctggtggctgtgagctgctccttgtctcccctgcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 496100 - DNA, 147 bp, Homo sapiens
  misc_feature (86)..(86): n is a, c, g, or t
gtgccctaaagcacaggttttacaggcatgggcaccacgccatgcagcagctggactgtatatattctctgggctaggttctaatngccatcgtgacattatgagcctcacatacccttgcccccgtacgcggggtgttgccgtggt

SEQ ID NO: 496101 - DNA, 131 bp, Homo sapiens
tggggactacgcgactgacttactggtacgcggacggtgaaactatgctcgtgtgtctacgtctattcctactgtaaatatatggtgtgctcacacgatacacccctaggacagcaattgatatcatacag

SEQ ID NO: 496102 - DNA, 124 bp, Homo sapiens
agctaccagaaaatacaataattgtgtatgtggtttggcttgcattcttattatttagttggacagctttgggctagaaaattaaaatttatttgagctcgttatcagtattttgaaaactgaa

SEQ ID NO: 496103 - DNA, 625 bp, Homo sapiens
  misc_feature (112)..(112): n is a, c, g, or t
  misc_feature (134)..(134): n is a, c, g, or t
  misc_feature (235)..(235): n is a, c, g, or t
aaaaacagaaagaaaaaaaaaccatttggaagcaagaaagcagagagacaacccacagaatggcagaaaatatttgtaaatcatgtatccgataagggacttgtatcccaanacataaatgaactctatacaanctacagcaataaaacagacacaataatccacattcaacaacatgggcaacaggatgttacatcgacatttctccaacaggaaatatacaacatgatcaacntggcacattgaaatggatgctcactaaccatatgttcatataggcgaaatggtagatacaaaaccacaaatgcaataacttcttcacataccactaggatgggctaaaatcacaaaaaaacgaaaataagtttgcggatcgtagacacgacacatgaaaccctcatacattcgcagcgtaagacatatataaatgcgcgcagctcactgtggacaaacagttttggaagttgctcaaaaccttaaacaaggagtcaccacatgaccaagcgattccactcctaggtatatgcccaagaacaaaatgcaaacatgatcacacagaaatttgtacacacatgttcaagaccatattattcataatcggcgataagtagaaaccatgcccacc

SEQ ID NO: 496104 - DNA, 749 bp, Homo sapiens
gtaaccggctatcgtcgacccacgcgctccggcaaagcaaatcacagcgttcacagctctgcttcataacaagagtacataaaccaaatgccataaaatttcttcaactctagttggaaaccgtttggaatttttgttagttgtccagcaggtaagctggatgacctgtggtgctgacctttttacatagtgtagtgttatattagccaaccccaaaggagcagtggttttcaaggtttttactggcctacaaatctaccttcattccgtactgtagaaacatacataccaggtaactaaatcgaatcactctctatcatgagttagtactcactcgcacttaaggaacagggatttgtagttctgtctacaaaattctccaagcagtgttgtggttattttatagttttcgtatttttttctttctcttttcaaacagccagttcaggtgcacagcaacctttttctacatgcagttcccagggaaactgcagaacttagaatttgtactttttgtaaagctatactctatgggaattgcaagcaatatatctatcttagtattgtgtgtgctaatgagagcctcagtggctcccccaagtctctcaggtgtttcctgcttaaagaagcaacagtttaaaagccctctaagatactctgtgtgtcaccaaatctgtgtgtccaccatattttggtcatgtggtgctattttgttaagtgtcttttaggtcagtatagttgtagaacag

SEQ ID NO: 496105 - DNA, 428 bp, Homo sapiens
agcggctgcacggacaaaagcggaggcctgtaaggggaaactgaaccataaagaggttacttaatggcctcaaggtcacctacctgacctaccaccagctcaatggccttcccaaagaaaaaacttcagggtcttgtggctgcaaccatcacgccaatgactgacaatggagaaatcaacttttcagtaattggtcagtatgtggattattttgtgaaagaacagggagtgaagaacatttttgtgaatggcacaacaggagaaggcctgtccctgagcgtttcaaaccgtcgccaggttgcaaaggagtgggtgacgggaaggacaagctggatcaggtgataattcacgtaggaccactgaccttgaaggagccacaggaactggcccaacatgcaccagaccaaagatatcctgtttttcctggg

SEQ ID NO: 496106 - DNA, 1155 bp, Homo sapiens
gtatgaccatagtgaggggcgcagcgagccctgcgtatctagctaagtatggcctcaaccgtgttaagcgtcggaagatcacgtgggttcactgcagctaggtgccatggtactacgtcagacacatcatcgatggccgcggcgtagcactgtgcgcagacgtttcgaagagacaatctcaccagaattgaatatctcgcaggtctgtgtatcgcagtctatcgatgcagtgagtccctgagcgatacgtcgcagtattgccatggttattgaccatggtaagagctgggttggtcggaggggcgagtcggtcgtactggctcagcgaaagtctggggactggcgtctcgaccaccgaagggaatcctatgcatttaagataacttggcttggttgcacttaaaaccaatttaccggatgataggttttaaggcagactaggacaaattactttaaaatcgataggattccctcggtgggcctggactgcttaagttcccacagcgaaatcgctaggacccagcaaagggcgcactccctgccctatccgattcaaaacgaatgggtcgacatgggtagaggccaaggagcgctacggggctgggtttccagttgccggagccgactcaacgagggaggagagggcttggggagttcataggccaaatcccatggcggagacattcgtttaaccttccaactgccgagttgcgatcaatacgccatggtcgacaccggacagtttccgggggccattggcaaacaggggaaggccgcccgacacgggacggtctagagcaccctggggatcttcacccaacgttggggaaacctactgaaccggcgttctgctccctgcccttccattctcggcctgcagcgcctggaagaggctacgtgaagggcaactgaggaagcaggggattgtggcaggcgctgttgatgtgctgccgccggagcttgatggtcacgcggggcgcgcagattccattgggacctgtgggcaactggtgggggccaaatacttgttcacgcgaatggaacggttctgattcctgacagtcccccttccggtaaataaccctgtgggggttaatatggagatgggttaccatgcaagagagcccgttaatacaccttagctaccaactgaac

SEQ ID NO: 496107 - DNA, 355 bp, Homo sapiens
taatatcccaaagaaagtgcatccaagcgggaattggagatgcacgctcgcatctcatggagattaggccacctgcaaacacacacctgacctgtcctacatgctgagtaccactgtaggacccatcacctgtcccaatcagccatccccagctggggtgcagagaaatacttaaactgtgccccagtctacggtgactgtcttttctactgcgctgcagtcaagtggttggtcagactggcgagtctcatagacctgggtccatattctgactgtgtcctttatgtgctaactcacaccttggcctcttggcttctcttatctctcatgtgccctcacgtgtgccatgggtcca

SEQ ID NO: 496108 - DNA, 389 bp, Homo sapiens
agcgggggcgggcgccacggttgcccggtgaaggaaagcgaacaccgagtccggtgcccgtccctccgcggccccatccgcccggtgcacccggggtcgcgctcgacaggccgcgataggccatagctgggcgcaagaagcgtgcgccgggtacgggccggtgggcagtggcgccgatagggtccccggggtacttcagacggcgcgtctgtcggcagggtccgtacctctcgcgttgcaagtatggatcccgtggtgggtagcggccctggctccggggccagctcagcaggcagcaacgagacatgggctcgcatgcttggctttcatactacggccggggatcgttagtgccctgttccttgttcggtgactcagcgatctacgcc

SEQ ID NO: 496109 - DNA, 595 bp, Homo sapiens
aatatgaggactccaagacagaagtcagataaggctatagctgtaagagaatgatctttccatgtgaagaacaagactaaagagtcgtctagaacgtcgacgatcgctgacctacttgtgaaacaacacggaagtagacatactttagcaaaatgagattagaagagaaagaatggcgtcttgtaaagcatgaaaagatcactgaagagaatcaaagacacaaagaaagacatcagacaggtctcttccgtagaagagaaagaccgttcggaataaagcgagaaaaggagagatcgcatgaaggatagaagtctccgataagaagaaaattactgagactgtagcaaagaggagagaaagaagaaatctaaaagaccgggcctgcaaaattagagaagagagaatgatttaagaagagtgagcaaagaatttcaagaagagaaggacgaagatgtcttaagagaagataaagataaagaactcaaagaaagaagaggtttactaggggaagatgctggttgtgacgaactatcgtaatcggaatagatcagtgttctggagaatgagagacggcaaattttatggcctttctgag

SEQ ID NO: 496110 - DNA, 143 bp, Homo sapiens
caaacagtgtatagttagtgaatgtgtctgagaggaggagcttgataaatgtgtctgtagaggaggaggtgattgaatgtgtctgtagaggaggagctgaagaaatgtccgttagaggaggagcgtgggtggaatgtgtctgt

SEQ ID NO: 496111 - DNA, 671 bp, Homo sapiens
gcgtcgaatagttattgtgtcatatagcaagagattgtacttccattcagctggttaaagtacaaaatctattgatatggttggctgtgtccccaccgcaaatctcaacttgaattgtaccttccagaattcccacaggacccagggggaggtaattgaatcaagggggcggtgggtctattccgcactgctgattcttgtgataggtgaagtaaggtctcacagagatctgatggttttatcaggggggtttctgcttttgctgcttcttcatttgttctcttgctgctgccatgtacgaaatgccttgtcacctcctgtccagtgattctgaggcctccccgagccaggtggaagctataagtcgcaattgaaagctctgtttgggttcccagtctcaggtatgtctattgagtcagcgagcgatgaaagatggagtaatagtaccagtagagtggggcattgctgaaaagatagccgaaaatgtggaagagcaattgggaactgggtgttgacataatctggagggctcagaagaagataggaaagtgtaggaaagtttggaactcctagagactgtgaatgggattgacatgggatactgactagtgatatgagcactaaggtacaggctgaggtggtctcagatggaagctgaagaccttgtggga

SEQ ID NO: 496112 - DNA, 108 bp, Homo sapiens
tcgtgggtcctaccgtttttcctgttgtagatgcaaatggccgggtgggggggttggatgtggctggcagagtttggctttgtcgttggcttgtggacctgggcgtga

SEQ ID NO: 496113 - DNA, 135 bp, Homo sapiens
ccaagagtcaggtgatagtgcattcgggtatttaagaagggtttcagctatgaactgcgtatgtgctataagtgtgacggtaccataagttacttgaactttttaaaacgacggaacacctccgtgagatgacgc

SEQ ID NO: 496114 - DNA, 673 bp, Homo sapiens
tgctctgagcattgccacactgctgtagagcactccactgtcctgaccagagtcatcagtggtcctgacccccaatgtgggcatggggctgggcaggagggtggtggctctgcctgtgcggttcatgaggattcgcacactcctggactggtcttacctgactgtctgtcccatttttctcatgggatatctgcttggaccacgtaggacttttacgccttacctcctgaagacgcctgtccactgtcattttccctactgccatagataccctaagcccagggccaccttgaggcccagactcagcctgcccactggtgccggagacggatgtggagtgggcctggatccgagggatgctaccctctccctttcccacttgaggatccctggggagagatgggggcggggatacaactggaggtatgaattttggggtaacgaggaaagtgacgatctcctgcttgcagcgtcagcccctgccttgcagggcgggctggcttgactcaggccctgtgagatagagggcccagcccagccccacccacagatccctgctcctgttgtgttctgattgtaaatcatttggcgagactgtatttaagtcactgctgcctaattccttggtgtttctaataaacgcccaggcgcctgtctggataacgttcatatt

SEQ ID NO: 496115 - DNA, 634 bp, Homo sapiens
  misc_feature (41)..(41): n is a, c, g, or t
  misc_feature (45)..(45): n is a, c, g, or t
aattcgcggccgcgtcgactacgctgcgagaagagacagangggnctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaacatgtcggccgtttggggccgcctgagtctagactaatctagactatgcatgctgatgcatgcgggcgtaattggagcttacttgctatattgagcctatttacagtcgacttacacgtcactgacagcggtttgacatggctgttgccaga

SEQ ID NO: 496116 - DNA, 460 bp, Homo sapiens
  misc_feature (30)..(30): n is a, c, g, or t
  misc_feature (437)..(437): n is a, c, g, or t
gcagtggtatcaacgcagagggcccattanggccggggtctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaaacagggaanaggcggccggtcgcgcggccgcg

SEQ ID NO: 496117 - DNA, 429 bp, Homo sapiens
  misc_feature (264)..(264): n is a, c, g, or t
aaagaagtccatctcctctcgcacttcttatgtgagtcgcacaggtagggatgctcataggctttcacttcgtcgagatccttgctgtctcctgcgttaggactatgtatcctatacaggttatactaatttcgtgggttacaagataagttgtttgtatagcttgctaaagtggaggtcgcctcgtccaagtcgtcgagcagctttaggtttatctgatttcgcaagatggaccatacgtagtctcacacatagtcgtgtccnatagtctttgagctgatctgcgtcatcagtgagtatgtctctccatcgatcctaggggctctgtgtaggttcatcttgatttcataaagccgtagattgactttcagttagcaacagcaggttcaaggtcagctttacatctttcatcgtgaaagccaggtatgg

SEQ ID NO: 496118 - DNA, 718 bp, Homo sapiens
  misc_feature (13)..(13): n is a, c, g, or t
  misc_feature (495)..(495): n is a, c, g, or t
cctgcgttgggangccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaanctatagtgaggccgatacaattactggcccggcggttaaaacgcgggactgggaaaccctgggggtaccaacttaatgccttggagaattccccttttgcgctggggtaatagcgaaaaggccgaccgaaacgcttcccaaaaatgggcaacctgatggcaatggaaatgtaacgtaatttttgtttccgggaaattttgttaactcattttaacaatggccg

SEQ ID NO: 496119 - DNA, 465 bp, Homo sapiens
  misc_feature (447)..(449): n is a, c, g, or t
  misc_feature (451)..(451): n is a, c, g, or t
  misc_feature (454)..(454): n is a, c, g, or t
  misc_feature (457)..(458): n is a, c, g, or t
  misc_feature (460)..(460): n is a, c, g, or t
gcggccgcctactactactaaattcgcggccgcgtcgactggctctcatggcgcagaggtttccaaaaaaatggcgctaaggccgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctannncngcnganncncattt

SEQ ID NO: 496120 - DNA, 492 bp, Homo sapiens
tgccctggctgtatcttgagtgctctagaggacaaggtcctcatgatctcatgctggaaagatgttcaccacgcatacttagcttgtccaggcttgttatgattccccctttcaattcctaaatttgtgatttgcctggctttctaaaaaatggatcttggagagcctgtgttgcctttgggcaaggcctctttaacagaggaaacgtgctagattgcctgctattatggcccatgctaaagcacttacctttaaaaaaaaatggttctagttaacttccgaacttaaaatccccttactaattaagtaacattttaataggaaacactataggtgccttagaagaacgtagaaaccaaatggccatcttttttgctgatgggaaaatattgagactaacatttgactacagaagatatcttactcccaactgctgaaggcagaactttcctcatcacagaagtagcagtagaaaaacttaaaaaggaaaag

SEQ ID NO: 496121 - DNA, 473 bp, Homo sapiens
  misc_feature (13)..(13): n is a, c, g, or t
  misc_feature (472)..(472): n is a, c, g, or t
cctgcgttgggangccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtcatctcagcggggatcctaatagagtcgng

SEQ ID NO: 496122 - DNA, 439 bp, Homo sapiens
  misc_feature (71)..(71): n is a, c, g, or t
agaaggctcacgaagggcatccgcagcctgcctgctgacaacacctaggctgattttagataaagccgttntccggtgctcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496123 - DNA, 769 bp, Homo sapiens
  misc_feature (27)..(27): n is a, c, g, or t
tcgccatctcctgcctcccccaccccntgctccctcctcctctccccccctgacccctccaggccccacagacaccgagatttcagcccctacgtgtcagccgacatgcataggatggcggcagccttcaataccacggtggccgccctggaggacgagctgacgcagctaatcctggaggggctgatcagtgcccgtgtggactcacacagcaagatcctatacgcccgggacgtggatcagcgcagcaccacctttgagaagtctctgttgatgggcaaggagttccagcgccgcgccaaggccatgatgctgcgggcagctgtgctccgcaaccagatccatgtcaagtccccgcccagagaagggagccagggggagctgactccagccaacagccagtcccggatgagcaccaacatgtgaggggtgaaccttggcctccaggacatctgcaccccctccccacctccacggacctcggacctccaggcggctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 496124 - DNA, 304 bp, Homo sapiens
  misc_feature (116)..(116): n is a, c, g, or t
  misc_feature (125)..(125): n is a, c, g, or t
  misc_feature (276)..(276): n is a, c, g, or t
tatgggtgatgatgtgggagtgatggatcagcatcgtgggttagttatcagagacacatttagaaagtggtctgatgatggtcaaatgcagagaaagcgtaagctagaaagtaagngccagatanacttaaaaacagattaccaagggattcacagcaaccattctattggcgcatccacacacagactgggaatgagaaccaagactccagaactggctagaactgggttcagagtctgacagtgctcttcgtagcccacatgcttctttcctgnacttgtaaatttctgggtacacagtgag

SEQ ID NO: 496125 - DNA, 974 bp, Homo sapiens
  misc_feature (5)..(5): n is a, c, g, or t
  misc_feature (7)..(8): n is a, c, g, or t
  misc_feature (10)..(11): n is a, c, g, or t
  misc_feature (30)..(30): n is a, c, g, or t
gcctncnncnnctactactactactaaatncgcggccgctcgacaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaagaagggggggggcgtagtatataaatattactccggagaggagaccaaaatgatgagtacaccagtagattttgttcaaaaagaggggaccatcaaacaagggagttattaaacagaggaagacgagggcggctgtaaaaacaagacgtgagtagtagaaacaatgtcatgggtgattcttattgagaggagacagcaatctattgggtggggtgaaagaatatttagtgggaggacgacacaacactacagaaagtatttaactcactggccggggaggaataaaaaactaaagaaggtttagttacggtggaaacaccacagcagattaatggcggcggagataaaaaagtcatcgaccaaagagattgttacttaaacaaaattttaggcgggctatcttaagatgaagaaagaacgatagaagcagaaagaagaagagagagagagtagagagagagaaataagagaaagaacgaaaagaagataagac

SEQ ID NO: 496126 - DNA, 1067 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcagtgctgcctgcggcccagctaaggggcctggccactgggtgccacccagcctgtgtgccctccctggggctgaggaggcaggcggctgctagttgtggcccttcctggaaggagaggcctgcagggctcgaccctgtgggtttctgtccccagggagcagactgtgcggcacccaggcccagtggcaccatttcccagacccctcctgttcccgcctcagtcaggtgcagacaagtgggcggtgtccattaaagagcagactcagcgtt

SEQ ID NO: 496127 - DNA, 852 bp, Homo sapiens
gctgtgtgcatcgcacattcggcttggtgaaatccttctctaaagcctgcttttcgtatttttataactaaacagaggaagtcttcagaagacctcgctttagaaacaaattggtgcaaggcactgcatagagtcatttgaagctcagagcagttttcacttggtttcgttacatgtgtactttttagtttacttgtgaaaatggccatctttaagcatatttattttctgccactttatttaaaggcaagcaatattttgttgatcatagaatagtttgtaatgaaggtacttcctcttttccagggcgttgtatgcactggtataattacatgagtggcaatgtagagtgtgaatctcaggtctgtaaatactttttggaaaatagaaattttcatgctttaaagtttggatatgggtggttttcttttccgggttgggtggaagagtaatttgacgaactttaatggttgtcttgtttagctgtggcaacaagtgtgatttgttaatattagataacacgagtaacgaaattctcccagacattagtagtaagtggggtctttgtgggtcgggacgtagtttgactgtagcaagacttactatcagtctgttattgcaagggttgtgacgaatgcctggcgcacaagatcagactggtatctggacttactctttcataaggtcccaacagaaaaaaaaaaaaaagttggggccggccaaaccaaacatcgggccggccaggaagcaggcacgccaaaacggggcggggggcccaaaaccggaccgcgaacaggggggcggtcagacaaaacgcccgcagaaaaaaaagacaacgacacagcaaataag

SEQ ID NO: 496128 - DNA, 440 bp, Homo sapiens
  misc_feature (13)..(13): n is a, c, g, or t
cctgcgttgggangccgtgtacaatccatagacatctgacctcggcacttagcatcatcacagcaaactaactgtagcctttctctctttccctgtagaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacgtgtttatttgtggccgagtgtaacaaccatataataaatcacctcttccgctgttttagctgaagaattaaa

SEQ ID NO: 496129 - DNA, 986 bp, Homo sapiens
tctctgaagttccagaatcgatggaagtggacggcacgccgcggcggggtgggtgcaagatgccgctgccggttcaggtgtttaacttgcagggggccgtggagcccatgcagatcgacgtggacccccaggaagacccgcagaatgcacctgacgtcaactacgtggtggagaaccccagcctggatctggaacagtacgcggccagctacagcggcctgatgcgcatcgaacggctgcagttcattgctgatcactgccccacgctgcgggtggaggccctgaagatggccctctccttcgtgcagagaacctttaacgtggacatgtacgaggagatccaccgcaagctctcagaggccaccaccagggagctgcagaacgcacccgacgccatccctgagagcggcgtggagcccccagccctggacacggcctgggtggaggccacgcggaagaaggcgctgctgaagctggagaagctggacacagacctgaagaactacaagggcaactccatcaaagagagcatccggcgcggccacgacgacctgggcgaccactacctggactgtggggacctcagcaacgccctcaagtgctattcccgggcccgggactactgcaccagcgccaaacacgtcatcaacatgtgcctcaatgtcatcaaggtcagcgtctacttgcagaattggtctcatgtgctcagctacgtcagcaaggctgagtccaccccagagattgccgagcagcgaggagagcgtgacagccagacccaggccatcctcaccaagctcaagtgtgcgaggttggaaaactggcgcaggagtaaagcgggggcagtgctctgggggtccttgtcactggattcctgagtgtgtaccaaacgggcctaagggcgtgcctgaacttgacgggaaggggagttccccgcctcatgttggggggcggggaattattaaaaacccttaaggaaaaaccgtttc

SEQ ID NO: 496130 - DNA, 337 bp, Homo sapiens
  misc_feature (5)..(5): n is a, c, g, or t
  misc_feature (7)..(8): n is a, c, g, or t
  misc_feature (10)..(11): n is a, c, g, or t
  misc_feature (30)..(30): n is a, c, g, or t
gcctncnncnnctactactactactaaatncgcggccgctcgacaaaagaagaaagatgagcaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496131 - DNA, 332 bp, Homo sapiens
gagagagagagagagagagagagagagagagagagagagaggcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496132 - DNA, 544 bp, Homo sapiens
tggcgagcggactcgactcggcacgttgtgcaccatggccccgggccctgtgccgtctcccgcggcgcggctctggtgtcctggccatcacctcttcgtgagcactgcctgcaggaggtgaaactacggtgccctccttccgggagctccgtgccgttcacccaggttccatggtagtacatggttggcggtctggggagaggctcgtggtgtgactggggcagggcgcgggtcgaggagagctacaggtagcggtggcgatgtgcaccctgtgcaactattggctggactaagctggggctggttcttggcccactgcgaggtggccgggttcttccttggcatgtgctggccgatctttctagtgagctgaccctatctcatggcgagggccgtgtgggctccggccgtgtggcgttactcgtaccctctttcatcgtggtccctctgtgcacgggtgacgcctgctggttgaccggcagtggtggcactggcggtaggcaatgcggcgctgtgggcatggggtgggcgggggccctatgtt

SEQ ID NO: 496133 - DNA, 263 bp, Homo sapiens
  misc_feature (179)..(179): n is a, c, g, or t
  misc_feature (197)..(197): n is a, c, g, or t
  misc_feature (209)..(209): n is a, c, g, or t
  misc_feature (233)..(233): n is a, c, g, or t
taccacacgaggctaatttttgtatttttagtggtagagacggggtttcaccatgttggacaggctggtctcgaactcctgactcaggtgatccgctcgccctggcctcccaaagtgctggggttacaggcgtgaaccaccacgcccagcctctgttgaatctttatacccctcatggnaccaagcacactgtcatnatgcaattaatnaaactggacatcttgagagaagtncctagactgcctgcagagggcatctaaaga

SEQ ID NO: 496134 - DNA, 127 bp, Homo sapiens
ctcaacgctttatacttcagttcacaatattcagatgtcattttttctttccccatttcctttgggggaggtttctcttaaaaggtcttcagaaatggcctcattaacgggtccattctctatggcg

SEQ ID NO: 496135 - DNA, 124 bp, Homo sapiens
aaggcacgatggcgcgtcctacggaaggctcagcgcgtgttttccaccaccgcgactcgtgaaggggccctgactgcccccgcctggggcatacaggcgcacactgcggaggaggtggatctgc

SEQ ID NO: 496136 - DNA, 541 bp, Homo sapiens
gaaaataaaggtataacctgggggtgaatctgggtaatggaatttcataagggtttagattttctgggaaaaaaaatggaagctttaatataatgaatccccagctttggggttaacccccccccgcccccaaccacccttttgttttttttttttttttggaaatggcaaaaccttgtaaaaaaaaccaaagcctcctttgaaaataacttttagcctttttccccaataacccataaacaaaattttccccttccccccatatgcgggaactgccggtaaaagccttgtgaaaacccaatggggggatccccgcttaaatctaagtttaaaacccccccgttaggagcctgaaaaaggcccgggggggaatttttccccccccaaaatcccccaatcctcccaatttgggctcctccttgggcagttaaccgttcaacatttaccggcccccccctggtacaaaatgttaaacaggtcttgttaacaaaaaagtccccccttggaaaaaaggttcccccaaaatctctttttttaaatt

SEQ ID NO: 496137 - DNA, 166 bp, Homo sapiens
attgggtcagtggcacaaaattatgggagcttagggagctacaattcaagatatgatttgggtggggaggagagcaaaccatatcacaagcaccattgttttgctaaatagtaggttgttatactaaagaaaaagggcattagaactatagatgatgatatctaat

SEQ ID NO: 496138 - DNA, 268 bp, Homo sapiens
tcagcagtcctcctgcccggcctcccagagtggtgggattatagacaccatgatcaattacgagccaccatgcctggcattagctagatcttctggatgactgctgcagcttctccactagtactggctgcttcacttagcacttttatgttacagagacagcttatttccttaaacctcatgaaccaacttttcttccgcagcttcctcacctctctgtcttcacagaaatgaggcgagttagggcctcactctggattaggctttg

SEQ ID NO: 496139 - DNA, 968 bp, Homo sapiens
gcgtccatttgtgagaatgccaggcgctactgcgaagctctattgctgatgccgtacaagagtctgctgtctcagtacaaggagagggaagtggtaccataaagatgtcctggtacgtttacattgagcatcggctaatgatggagcagcggattcgggaccctgggatggtccgaagcccccagaagcagtaccctgctgaactcatgcgcagatttgagctgtattttcaaggccctagcagcagcaagcctcgtgtgatccgggaatgtgctgggctgactctgtgggcgaccgttcggtaactgtgcgctggaatcgtcactcgatgtctctgaagatcagatcccaagatggtggtggccacttacacttgatgactcagtagtggcggcaagagacataccagactgatccagtcatacctcaacgttatcactgcctctgaatcatgtagcccaaagcccaggagtgccaaagtcgaacgctcagtgagggcggctgtatctgcatgacacggaggcttccagcacttccatccaaatttccacggagcactgacacgcatcgcaagcacccactaaggtgactcgaaggtgccctgttggggaacatactccactcgataagtaactcaccggctggctaggttacaacggagaagaaccaaccacagcgaatatagcccccagtaccttctcacaactcaaaccacaacaccctcacactcgcctccttcccccattcggaccaatatccccttatcctcactgccacatcccctacccacgacaacaccaagcgactactaacctcactccaataaaaaccactccacctaataaaacccccacaacttcacaataagctataaccccactcacaacccaccccaccctcacagacatcacatccacccccatccaacacacctaaccacaacccaaccacaaaacacaaacaacaaa

SEQ ID NO: 496140 - DNA, 279 bp, Homo sapiens
  misc_feature (29)..(30): n is a, c, g, or t
ttgtgggggggggggggggttttttgtgnnacacccctttcccccccccttaggggggggcgggggttttttttgcctttcccccatttttgggttttcccctggcggggggccccctggaaaaattgggggggggccaaattcttgggggggcgcccccctccggggtgtttgttgggttttcccccccccccccttttcccccccccctgggtgggggggggctttttgggggccggggttccccccggggggtttaagcccgggtttttttcccca

SEQ ID NO: 496141 - DNA, 145 bp, Homo sapiens
  misc_feature (58)..(58): n is a, c, g, or t
tggatccccggacttatcgcccaacactttggaggcaaagataggtggtcacttgtgntcaggagttgagacaggcctggcaacatggtgaaaactctgtctctactaaaaatacaaaattagctgtgtgtggtgttggggataa

SEQ ID NO: 496142 - DNA, 254 bp, Homo sapiens
cggggatggcaaagaagcccccttcccccccccccctttttgtaatgtttgtaataaatttcaggggggcaggatggatgaaccccagatcccgtgaatgattcagctgttcccagccctaccttttccctcattcatcaccccttttccttcaggggaacctcttgccctattgtggtttattttttgtaaaacccggttatgtttttttttttttaaaatgggcctatgtaataaagtttcccccctggcca

SEQ ID NO: 496143 - DNA, 767 bp, Homo sapiens
gttctcttttctcccttctcactttttcggctatcgggtctttctcttagcgcgctcttccttttctgtgtttcagctgggcttcgtcgaacgtattccagccctccgattgtgattgtcccatgtttcggatccatgatctaggacatttgcattactattcgccttgttcatggaagcgcacactcttgtaaacgagtaaggatccccgctggttaatgcctttacccaattgttcttgtaccctctggcaccttctcttcgcctctttacctctgtcccgctccccccttcggtctgtatcgacttctgtcttctgtctcctggtaagcatcccctcggaactcagcgcctcttttcacggtgttgtgctgggagctcgggcctcatcccacctctctgggttacctgcctctctctctcctgtggtgtccgttccctctcccatgtgctcggtgttcagtgtgtgtatatttcttctcccagacatggggcacacgccctcaggggacacgatcctctccttagtcttagctcatggggctctttataaggagttggggggtagaagcaggaaatgggaaccacgagacgtgaagtcagaggtctgagttagggcgttaagaggacagatgctcctggctcacccagcttctgctgagaaccattcactgggattagagctgccctccccagggaaaaagtgtcgtctccgccgaccctcccgatggggaccatgtggtgtgatgcctgtgtctgataatccc

SEQ ID NO: 496144 - DNA, 332 bp, Homo sapiens
ggagacttgttttactcaaaggggaaaattttgcccggggcaaagtcaccccaaagaaacaaacaccaaaaaattgcccgaaagagaacagttaagtgcagctcggggagtcccggcagttccttcccggcactggctcgtccctgggttttaaagggtccatgcgggcacagggtccgtccacctgtccacgcgagccacatgctgaaatggggggggataaaattcatcaggcagctgctgtaacacggaaatgtgcaaatgccaaagtagcttcttctgaacttgaacaagacagacaaaagggaatctttccataggctgaaaaaaaa

SEQ ID NO: 496145 - DNA, 127 bp, Homo sapiens
aagctcgaagagggggtctgagtttcttcctctctctccctcaacacaagcctgttcccaggttctagctttgtctccctgtaagctactgccaggactctggtctggccaccatcatcttctccct

SEQ ID NO: 496146 - DNA, 1615 bp, Homo sapiens
gtgtctgcttcgctgttggtaacgctcgctgcgttatctggtcgtgtggtctgtctcgctctacctagctgctgtggggtctcccacacgcgggggtccactcatgggtcgatcctttgtgtgcgcactctctgttgttgttgtgggcggccagctgcgtgtgtagtaaggggtgttgtgacctccctcgaacacaggggttgtgtccccccgctatgttggtgatttggggggccaccaccgggtgcgccccccccggcgccgggcacggtttttccgccgcaccgatgttttggcccccgtgtgagtttttcctacatcctcccgctgttgagtccccctcgttcttgtcttcgcgaggcccttctccacggaggacatctctgttggggaggtggcctcgtttttccttccccagtgtgcccggtgctcccctcaaaatggttgccgccgcgttctattttgggcgccgccttggtcacacgagtcgttgggactgacgccacagtctgttcggtagccccactcggtggggccagacagagtgttttgcaagaggcgaccccagggtgtggtcaaacacatacacgggggggagctgtgtcgccctgtcgtgacaggttgtcgttttatcacggggtgcttttcgctgtgcgcgctgtgggctctcgattgtgtggggtgttcccgtctttggttccggcggaaagttgtgtggggggaatgccgcagcacaccggtgtggaggggccccctgtctggtggtgcgtgccttgtcccctctgctgggacgcgctctgggctccacacacgggttctacgcggggagtggtcctcccttgtgttttggggcgcgtttctttgtggtgtgtcgtgttggtccgtctgtgaccttttttgggagggggccccccctcgggggagcccactcatcttgttggacggcgcgcgcggagagtgtggggtggggagaacccctccccctcggtcactatgtatacacccgcttttttctcggtggggccactgccgcgctgtgtgctgcgccccgcgccccgcgcccactctgtggccacagctttgttgagactctctctacccgcgccgggtgtgtccacgcagatatgccctcctctcgcggagagggcacattgttggcaccacagagccgcgcggctttcccacagagaagttggcccacacacacacacactcgcgtggtgttcactaagacgtctcacagggacgccacagggtgttgtggcgccaccgcgctcacaagcgcacacgtgtctcacaccccgtcactacctcacacagagagatctctctgcacacacaggcgccccacacaggcgctatagaggttctccctgtgtgagaggcgctcttgcgcacaagatctcctcaattcctcgtgtgtcccacgagggtgtccctctctgggcgcaccacaacccgcaaccctctttcacacttcttcctccacgtgggtaagcacctgttgtgattttttgagaaacttttaaaacttgtgtttctggttttgctggttcttgatcccaccctttggttctggcaaccctcattccattaagacccctggagaacccca

SEQ ID NO: 496147 - DNA, 154 bp, Homo sapiens
aatggaacatacgatgatggagcaaccaaactcaatgatgaggcacggcggctcattgctgatttggggagcacatctattactaatcttggttttagaagcacaactgggctcttactgtggtcgggacagggcattacagacacaaaagccc

SEQ ID NO: 496148 - DNA, 150 bp, Homo sapiens
actatcagctgatggaagactagtcatcagtcaactgaagggttgtacaattattgctggattgagttactctgtgattcatcaatacagtcagttttcattgtctagtaatagtcattgtaagggatcactagcgcgtcgtacattaca

SEQ ID NO: 496149 - DNA, 974 bp, Homo sapiens
cagcggaggccttcgaccgatccctcgccgtccttcaccatcgcacgccaccgacaccccatctctcgaaatctgcagacatcttgatttattcccactgctgtctgtcaggtctccgccgaccacatacgacgccagtggcgccgaggatgagtccacagcactggctgcattgtcggctccactctcacccatacgggggaaactgagagccccggggaaacgcgtgccagacgagtgtcaggcacctgtcacttggttgcagttgtcatcggtcctctttatagcacggcagtgtagccccgccaaggaatatcgcagttgatccgctccggcgaaacggacacctagggacaaaggcctttgctgaggcctggtgcctcgcaacccatcgggaacggatatcgaaaccaaacacaatacgacccattctctcatccctgacaaggcacctcatgcattcttgacacacgccacatgcaagggggctttccagagttgatacctgcacaggggatgcgaagagcattggccccccatggggacgttgatccaccaatgtagatggccggacccacccacatgtcgctcttgcaagagtgctcttcgccttcatggggacaacagctactggaatacccagtcgaaacggataccacaagtgagccacaaaccaaagacagtgatagcaaccatgcataccatgcatcaactgtacccccaagcaggggccccacaagggtctacagctaggtcacacttccaaagaccggaagcgacatgaagcgaatgctcgagatggccacgactacaaaaggcgacgaaggcccacgacgctatagccacacgctgacacacaccaccccacacgacgcgacagtaagatccacagactggacgctcaacaaggagcgacggagacagacacagagaaagcaggccacgcgccgcacaagcccacgaaacaccgacgc

SEQ ID NO: 496150 - DNA, 709 bp, Homo sapiens
atgacaatggcggtttgtggaatagaaggggggaaaggtggggaaacagattgagaaatcggatggttgccgtgtctgtgtagaaagaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgctcgttaagaatcatcaccactccctaatctcaagtacccagggacacaaacactgcggaaggccgcagggtcctctgcctaggaaaaccagagacctttgttcacttgtttatctgccaaccttccctccactattgtcctatgaccctgccaaatccccctctgcgagaaacacccaagaatgatcaataacaaaaactacaacaattaaacaacacaacaagttacacacaatatatatatataaactaattaattttaaccagacaaatgataattggtgcatattcatggggtacatagtgatgtttcagtacatacaatgtttagcgatcagatcagtgtaattagcatggccatcttctcaaacatttataattcttggtgttaggaacttttaccatcctccttctagctatttgaaactctgta

SEQ ID NO: 496151 - DNA, 258 bp, Homo sapiens
aaaactcaccttaaattttaaccaccaccagagggaggggattttatttttggttattgtggggggtttaaaaaattccccccatgaaattattgggacccccttgttttggggtccctgtaacatttggggggggggacaggggggaaaagaaacaaagtccccatgccccgggcatttgttcaaaccggggggcaaaatgtaaggtttttttgtaaaaaacgttttatgatttttaaaaaaaatttggggccccca

SEQ ID NO: 496152 - DNA, 385 bp, Homo sapiens
  misc_feature (10)..(10): n is a, c, g, or t
taggccgtanttatatcacagctcatctgattttctttctttttctttctttctatcttctctctctcgcgctctctctctctctctctctcccccttcctccctccctccctctctctctctctgagagatggggtctcactatcttgcccaagctggtcttgcactcctgggctcaaatgatccacctgccgttggtctcccaaattgctgggatctcaggcatgagccactgtacccggtctcaaaatattttttaacagaaatagcagggtgtggtgatgcctgtagttacagctactcaggaggctgaggtgggaggatcacttgagactgagaggtagaggctacagtgagctgtgatcgcgctactgcactccagcct

SEQ ID NO: 496153 - DNA, 146 bp, Homo sapiens
ctgctaaaattttccagttgataagcagcaggtgctgagagtctggatcagaacaaaaggcaggcagccgggatcccactcgccttccatgagctctccgcagctcaccgtgccatcacttgaagcacacactcctgagggagctg

SEQ ID NO: 496154 - DNA, 315 bp, Homo sapiens
gcggccgcctactactactaaattcgcggccgcgtcgaccaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496155 - DNA, 414 bp, Homo sapiens
gagagagagagagagagagagattgagcgtgcccttctcccccctcgtccctccttggtcgttcgttccttgagttgtctcctcttctcccgcccgctgttgctctctttccggcccctgtcttgtcctctccgtgtccctcgctcttctcttccgtcttcctcctccttctctcccgttcccccccgctgtcctttctcttccctcccgccttctcgtccccttgctgtctctctcgcagtcctcacttttttccagtcctagatattcttaccacttcacctcacccgccttgacttaccatgctccctgatcccctccctcctctccttcaccaccacattctctgccggtattactatacactacactcttacccctgtccatctcagatcttcacatccttttccctcg

SEQ ID NO: 496156 - DNA, 299 bp, Homo sapiens
  misc_feature (16)..(17): n is a, c, g, or t
  misc_feature (272)..(278): n is a, c, g, or t
aattcttcagctaaannagcggaagaggtgatttattatatggttgttacactcggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttattnnnnnnngtcgacgcggccgcgaattta

SEQ ID NO: 496157 - DNA, 318 bp, Homo sapiens
tttttttttcaacaggtcaaaaagaacctttattactttttatgattgccacttatgctttctcaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacacggggatccttagagtgaccagacgt

SEQ ID NO: 496158 - DNA, 174 bp, Homo sapiens
gcggccgcctactactactactgctcgaattcaagcttctaacgatgtacggggacatgttggtcctctgccctggacctgtgacattctggactatttctgtgtttatttgtggccgagtgtaacaaccatataataaatcacctcttccgctgttttagctgaagaattaaa

SEQ ID NO: 496159 - DNA, 233 bp, Homo sapiens
cgccacttctcaggacgacgattcttctcaatgggggggcgggtgatctccagccacccctcagtcactacctttgtaacaacttcagttgttgccatcgtaaactgacacagtgttcctaacgtgtccatacataaactaatcacctcaatttgttatttttcgaaacaaagccctgtggaagaaaatggaaaacttgaagaagcattaaagtcattctgttaagctgcgta

SEQ ID NO: 496160 - DNA, 208 bp, Homo sapiens
gacgccgatgatgatgtacatcgggatcagcgtggcttcgaagaacacgtagaacagcatgcgtccagcgcgcagaacacgccgaccatcagacccgacaggatcaggaaggcggccatgtactgggacacgcggctggtgatgacttcccagccggccagcaccacgatgatggtgatgaacgcggtcaggagcacgaaccacagcg

SEQ ID NO: 496161 - DNA, 177 bp, Homo sapiens
  misc_feature (35)..(35): n is a, c, g, or t
ttcactttatttttcttgtataaaaccctatgttntagccacagctggaacaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496162 - DNA, 505 bp, Homo sapiens
caatatcttaaaaatgtcctccataattggtaaaaaatatttttgctctcacattggtcaggtagcaacttgttccattcaccaaaaacacaatttggataaaaaaattaaagtgcagtaaagacgagagccaaccatttcatataaaccagagttctgtattactgtgtttacctgactcatggctacaattttaaaatggaagctataaggtctccatttgcatctatctgtatgtttatgtatgtacatatgtatgttatgtatatgtgatactttcctatcttctgatggtattacccaattaatttataaaaccctataaagaagctctattctgacaggcttagggacaaattgcttatatcaattaaatatttataaagctctcagaaatataggaattaaccccaattttttttaagttcatgtgactttgggaaatatttgttagataaaaccagtttaaaattgttgattgaataaaacagctgtcttctgagtt

SEQ ID NO: 496163 - DNA, 462 bp, Homo sapiens
  misc_feature (30)..(30): n is a, c, g, or t
gcagtggtatcaacgcagagggcccattanggccggggtctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496164 - DNA, 440 bp, Homo sapiens
tctagcctcgccagtggctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496165 - DNA, 432 bp, Homo sapiens
actagttctagatcgcgagcggcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496166 - DNA, 421 bp, Homo sapiens
aggtgttgctgggtcgatctagaggtccccattggatagcgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496167 - DNA, 196 bp, Homo sapiens
acgttgtcagtgttctggcctgtagttagctatgccgatcggtatacgcactaatgtacggcatcaatatatgtgacctcccgggtagcgggggaccaccaggttgcctaaggaggggtgaaccgtgcccaggtcggaaacggagcaggtcaaaactcccgtgctgatcagtagtgggatcgcgcctgtgaatagc

SEQ ID NO: 496168 - DNA, 1145 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaagagggggggcgcgcgggaaaaaaaacccaccacgggggcgcacaacaaagacacacacgcattatagaagaaagaaggggaccacagaagagggagaatataatacacaaaaacagcaggcgcaaacaacaaaacagaagagagaggaaaacaaaaacaacgagcatatcggagagagaaacaaaaaagaggggagagaaaaacaaggggaaacaacacaccaaaaacaaaaaacgccacagcggagaaaccaagacaagagagagaaaagagaaaaacaaagaaacataaacagagaagagaaaagataagcacaagaagaacaaacaaacacataccagggcaggaacgaacaaagggagaagaacaagagagggagaaacacccggcgacaaggaggaaacaagaaagagaggaagaccacaacaggagaaacagcgggagggagaaaaggtaggagagcaaacggaggagaaacagaaaaaaacggaagaaaacaaaacgaaggaaagaaagaaacagaagccggcagacaggaggagaacaggcacgaggacaacaacagaaaaaaaagcaaaagagaccaaccaagaagacggcgcaagaca

SEQ ID NO: 496169 - DNA, 1364 bp, Homo sapiens
agcggactgatgacgccattttcggcggctggaacggcgcatgcggccgagcgtggactggctgggtcgtgctgggccttgcctgggtgccgaggagcccgcggggcttgtgcatctggctggccaatggggacagctgcgtggttcgggcgacgattcttgcggaggcgggtacgctccgggtgccccttcgctggttgacttgcttggtgccgttgcgctcacactagtctgacgcgtcgggcatcggttgcaccattctgcctgcttccggcagcatccgctgccccgtgtagagccgctccacgtggttgcttgaacaatgctagccgaagacgatggcagctgaggactcttcagtgatgcaatcgagctgaaatttgttgttgaacaactagttgtcccatcgaagttggttgtaacactagaaggggaaggacccagcgtgtgtgaggacattgcgttgactaccagtgcactgggatcatgtaattttttcgtctcagcacgagacgaggcggacagctcaaatgtcccacggggacgtgcgacagtccgttctcgcagaggcaaattgggaggctcacaacagatatcgctaatcttgttacaaaaatgggttttgtgcctgggagggaactgccttggcacacgattgcgtgttcgccaacgggcccccgcactcttcgacgttggcagaagaatcgggtcacaatttctgtgcgcggactacgcgcacacggcgcaaacggcacactagtttcccaagaacacccactttttgatttccacctggtcgcagaagtgcgtgcacaaccgcttgtggtgacgcacactgggttttctggagcaacggaccttacgtaggtgcgacccatctgttaaagattttgtgacatcccggctgcgaccccacttgcggtgtccttcagatttctgcacacttagtcggccgctgctcattcagcgtgaccgcgcaggacgagttaatcagagcgccggttggccataactttggacccttaggttgggacacgctccccggtaagcggaaacgcaccacgaagaggaaacctttgtcagccttgggcacgccccacggcgctttctaccagggtccgctgtctcccttggttggttcccgcagttggtgaaggcacatcttccagggttgctggcatacccaggggtggacttgaacgaccttgtgtctgcctcgcaccaccgtcggcatcggcgcacgttagtgaacccttgggctagggaacagagcgaagatttggtcaggcgcccatgcgtccattggttgggggccctcccaacccttgtctatggtgcagcgggggagtcacaacggacatagc

SEQ ID NO: 496170 - DNA, 368 bp, Homo sapiens
ggatctggaactgcgctatctcactgtgtgttgtgctctcccacacggattctaccttttaacctctgtatctttgttagtttgaaagtcaacagaagttgtcattttggttgcctttttagttaaaattctagctatgaaatgtcctggtgaggaccagcgggtctggggtccggagggccccctaggggaccccgaattgagtcttctttccccagggaaggaagaaagggggcgaaacttacagagacttggaagagggcatatagtgaatttacacatattacaaatatttggtaagaaccctctctaatactgagataacatgaattacttgaaataaatgcaaaagcaaaagtactctctct

SEQ ID NO: 496171 - DNA, 431 bp, Homo sapiens
  misc_feature (6)..(6): n is a, c, g, or t
gagtanatagctacaaataaattaatacctaggaataccaaagaagtacaggatctctacagcgaaaactataaaacgatgatgtaagaaattgaagaggacaccaaaaaaaatgaagatattccatatttgtggactggaagaatcaatattgttaaaatgtccatgctacccagaacgatttacagattcaatgcaatctctatcaaaataccaatgcttttcttcacagaaatagaaaaaataaccctaagatttatatagaaccacaaaagacccagaatagccaaagctattctaagcaaaaagaacaaaactggaggaaccacattaccttacttaaattatactatagagctatagtagccaaaacagtatggtactggcataaaaacagacacatagactaatggaatagagattgcggtgtt

SEQ ID NO: 496172 - DNA, 316 bp, Homo sapiens
gtggccagcctgcaggttgcgggagcgaggagtgggcgtctgcaccaggcatccaggcgtgctcttccccaagaacagggcaggcagccttacgtggtggagtctgttgagcccctccgccagcctggcccccgacagcgaggaacactcgcttggagggacaaatggaggacatcaagctggaggactcctcgccccggggaacaaagggggccctgctccttccatgcttgatcaactgacaaggggcctcacttgacaaggggggggttaccggagctcgaaattcggtaaatcaatggtcataagcttgttt

SEQ ID NO: 496173 - DNA, 1386 bp, Homo sapiens
gggaacgcggacgtttgcagcctcggaaatgggctacgagcgccagatgccgagtcagccactaaacgctacgacgctaggctctgtggccctgaccgtgagggcgcgcagagactggcgtaaccgggacattagttttcaagcgtactatttaaagttccctggcttcagacggaccctctttacatcttggactttgggtcccgtgtattctaagaaaacgcaacctggacacacacgggtcggtaattacccggaaccccttgagacacaacacacgggacgcacgcgtctaccactacactcgacgacaacatggccctcctctttggaaaggggactactaggacgactggaaaacacacgaatactacgcgaaccgggatttggaagaaactcaataattaatattacaagggacggctttaaaaagaaacactaatgggctgcgacttggattaaaatgattgggggtaacttaatataaggacgggcggctttggggactagtgttacccaggaggaacactgtttggcaagacgacagggtttcaccaccacggaatcacggggccgcccaccccgcctgggacaattggggccccaaaaacaaattcctgcaaattttacctgggcacaggttacaatgttgccaacacacgggcaccaaaacattgggtttccacacaggactcataaccaaggataagaacacacggggggtacactacggacaccgagtcaacaggaaggggacgaccacaccatcgacaggacagaacttccttaaggaaagggggccccggggaccccacaggtggcaggcaatgtaccaaacactactaaactggagcatttacaacgtacggagaccagcaaccacagtgtaacaaccacgcggacgatggcacaccagataggcacacaaagctgtgggatagcggctgtgggaacgaagacgcacagagctacacgaagggggcaaactacatacaccgtgtgagcacacccgacaccatgtgtcgcaccacggaacacactttgggaagcggcaacacagacagaactgtatacgtacattttgtaatcaagacagcattgtggtgtactacaacaagggggtcgttcacacatatataggcgatatctaacaccctttctttgtaaacacaagtgggatttatcaatatgggtatctcatcatggaacacagtcaagtgaaagttttgtaggagcaaattatttttcaacgggagggttgccacatgaatatcaatggtgaaacattttacaaacaagagccacgagacgacacatgttttatataccagacggcaatacaaccagtgatcgatagcagcaaaccgatagcacagggagtatcac

SEQ ID NO: 496174 - DNA, 235 bp, Homo sapiens
actgtactccatcacactactgtgcgtcgcagtgatggagcggatactcaaggaggcactggctcagcctgggcagtagagggacaggagtcagctcatacgctgtctgtgactaaagagggcacagcagggccagcgtgagcttacagggacgtacgcccaggtgcagatggtatgggtgactcacttaccgcctctaggtggtgccaggggctggagggccctagaaaaagat

SEQ ID NO: 496175 - DNA, 187 bp, Homo sapiens
aaagtggcatacaagcttcatctatgtaactttgcttatatctcacagagacagactttccatctgattgtgcttaatggattttctgcttcctcagaaaaacttgaatttttaagaaacgtaattgtctccgtaaaaataagcaaagttacatagataaagcttggtattcctcttacttttgagt

SEQ ID NO: 496176 - DNA, 685 bp, Homo sapiens
  misc_feature (685)..(685): n is a, c, g, or t
cacctttatctttattctcttgagaattctagctatcccattctgtgtccccaagccaaaaaaaaaaaaaaaaatagggatttggtgtaattagtggggaaaggtgttttcctatatttgggttttctaattaattctcaaggtctgggaattttttttttacatttctcttccttttgcccttagtcaataaaggtcaattaagaactggtaatggtataacggtgggggggcgttcaagaaagacgccttccaatcaaactctaacttaaagtccctctaaagaaggtcagcgccactttggccaaggtggatatgcgccttccattatcagcaatggcatcatggaatttgggacattccagtcactaagttcttctcaaagagaacaaagcgccttcatataattttgacggctaccaattatctcagcgtatttttagcgcacaattattcagcgtattttccacaacggtggtgtcccttggcattaaagtagagaatcacctataacatgtggatctcccaaatttccataaatatgggtatctcaactggtgaaactttctcctacccaaattttttacaacgattgcggccacatggcttttaacaaattacctccttttttacacattggaaaacgcccactaatatagcgtggagcaagggggaatcctcaatn

SEQ ID NO: 496177 - DNA, 422 bp, Homo sapiens
tgtagactctagacgatcccattctacgctgcactgtctggatacatggtaaaaccccgttgctacgtaaaaatacaaaaattagccgggtgtgatggcatgcacctgtaattctagctactcaggaggctgaggcaggagaattgcttgaacccaggaggcagatgttgcagtgagctgagatcatgccactgcattccagcttgggcaacaaggaatgaaacttcttattaaaagaaaaaaagttgtcctgagccactgcgcccggtccacagcttggttttatacattagggagacatgatacatcagtcagtatatgcaagaagtacattggttgggtctgaaaaggtgggacaacttgcagcaaaggcaggaagacttgaagcggctcccggatcacagacaggtgcagcgtagaat

SEQ ID NO: 496178 - DNA, 99 bp, Homo sapiens
ggcctgcatatgacctgctgtgtcctttgcaggaaggagctaggcacctttctgagcttattctattccccacccacacatacgcccggcttggaaata

SEQ ID NO: 496179 - DNA, 300 bp, Homo sapiens
actctagaggaccccctgaatcttccatcaggtgggcacatttccgttaccggaatcgcagctggaccgttttctgatgtgtctgtcgctgggctacccggatccggcggcagaacgcgccctgctcgcaggcgacgaccgtcggcaattgctggccagactgcatccggtcatgcaggtaacagaattactggaagcacagcaggaactgaagcagattcatgtctctgcttcactgctggattatgtgcaggcactggcgcaggcgacccgcaaacggcgatgtattcgccgaaggga

SEQ ID NO: 496180 - DNA, 198 bp, Homo sapiens
gcatctattgacttagagagttaatcgtgtacccgcggtggctgacacgaaattgaacaaacctgggagttagtatagcttagttaaactttacgtttatttgctaaagtgctaatcactgactgtttccctgtgagaggtgtggctaggctaagcagtttagaactagcattgctgcagtagcttgatgcttgtccc

SEQ ID NO: 496181 - DNA, 226 bp, Homo sapiens
ggtatttaaaaagggtctatgttggtcttattccccaacttaaacactctcacctctacacctcactttcttacaatcatcttgccccttttggcgcaacacccaattcttttccgcccccaggcccttatgttaacccccgggttgaggttcagttttgttgtcacctctgttttgtcctcattgaccaataatgatctgtggggtccctcgtgtaagttgtttg

SEQ ID NO: 496182 - DNA, 1125 bp, Homo sapiens
  misc_feature (775)..(775): n is a, c, g, or t
aagtcttcttgcagcactcctgcttccaacacgaaagacgccagccagcttggagaagcgcgcttgcgcgtggcaagcaggtgaatccgaggagaggcaaattacgaagcctggaagaccacagaggccgcctttgtgattccagcacggggaagcgtctgcttgattcagaagtgcttgcccaaggtctctgccaggtgcacctgcttctgtcctgaattctgtgacagtctgccagcagttaggagattgccagctgcactattccagcgattaaagacacttgaaaattaaggcagacctttaacaaccatgcatcattttgtattcataataaaattacaattctgaacactagccgtgtgggaaccgggtgtgctggctttccttgaggaaggtgagcatgctgatctagccccaggtaggggagcagtatgtgcagtgatgcctgcgaaactctatgactgctacacggactccaccgagataaggggagaaaggtaatgaaggaacatggttaagtggagacaggaacaggggagcaaagcaaagcaaacacctgaagggagacggtggtggagtgcgtctgcgggcctgtgcgaggagcacaggcaggaagaaccctgtgtaaggcgcgtggatggcacagcggtgtgggcggcaccggctcccctgcctcttctggagcttcctgggtctgacctccaaccttgcatgtctttgttttcctttgagatggtttgataggtgtgatctatttggtctcctcaggganacagagctgaaaggaaatgagagggtgttcccaatctgggcatggtggctcatgcctgtaatcccagcactgtaatcccagttacgatgcctacgactcccagaccaaagtgggaggattgcttggggtcagtagttcaaaaacagcctaggcagtgtagcaagaccctgtctctaggaaagaaaaaagtacattagccagtcatggtggtgcacacctgtagtcccagctacgtgggaggctgaggcaggaggatcacttgagcatgggaatcagaggctgtggtgagctgtgatcgcaccactgcactccagcctgggcgatacagcaagaccccatctcaaaaagga

SEQ ID NO: 496183 - DNA, 690 bp, Homo sapiens
  misc_feature (45)..(45): n is a, c, g, or t
  misc_feature (70)..(71): n is a, c, g, or t
  misc_feature (73)..(73): n is a, c, g, or t
  misc_feature (77)..(77): n is a, c, g, or t
  misc_feature (81)..(81): n is a, c, g, or t
  misc_feature (88)..(88): n is a, c, g, or t
  misc_feature (107)..(107): n is a, c, g, or t
  misc_feature (119)..(120): n is a, c, g, or t
  misc_feature (127)..(127): n is a, c, g, or t
  misc_feature (129)..(129): n is a, c, g, or t
  misc_feature (134)..(134): n is a, c, g, or t
  misc_feature (138)..(139): n is a, c, g, or t
  misc_feature (145)..(145): n is a, c, g, or t
  misc_feature (158)..(158): n is a, c, g, or t
  misc_feature (174)..(174): n is a, c, g, or t
  misc_feature (195)..(195): n is a, c, g, or t
  misc_feature (206)..(206): n is a, c, g, or t
  misc_feature (217)..(217): n is a, c, g, or t
  misc_feature (225)..(225): n is a, c, g, or t
  misc_feature (229)..(229): n is a, c, g, or t
  misc_feature (233)..(233): n is a, c, g, or t
  misc_feature (427)..(427): n is a, c, g, or t
  misc_feature (462)..(462): n is a, c, g, or t
  misc_feature (521)..(521): n is a, c, g, or t
  misc_feature (598)..(598): n is a, c, g, or t
  misc_feature (686)..(686): n is a, c, g, or t
tttatcccctactcctccttttaccctctctttccattactcttntcttcccttaatcctccaccaactnntngganatangaaactngaccttggagaacttcctntttatcaacttnnttctccnanaacangttnngtattntacaccatttatncttccatcaccccctntcccttccatccttcttcatngccccatttanccttccaaatncaacattntcanacanttcccaacactattgtccctcttgcctctcattctcaccgctccagcctctgtaatactgccagccctttaatgccctaatgccaaagtaaccattctcccaggctacagttccttcctttggcagatgtccctggccagggcccccaacctctacgcacccctgacctggagttaggggtagaggtttggggnaggggtagtttatccacccctcactcaaggtgggnaatcagcaccatcatgataactccccccagcagccccagcacctccagaagtgattgcnatggtgatgcctccctcagcagctcgggcaacacagacactgttgctacgtagataaagccacctgcagtaaatggnaggacccagccaggacctgcaccacctgcaatttcactgcccactgctcctccttcagtgagaagggcacaggctgtgcctgccagtncccc

SEQ ID NO: 496184 - DNA, 153 bp, Homo sapiens
actgattgtgcactgcactccagccatgggtgcccagagcgagactccatctcaaaaaaaaaccttgagaatccaaggatggctgtaagctaatcgttaaatacttgaaatatacttcgtaaggatcaacagaataacactctctaaagagag

SEQ ID NO: 496185 - DNA, 1199 bp, Homo sapiens
gatgaaacatgcaaggtaccacacagctgtctgaattttggcacaaaaagtgactgtacgtgatcacgtggtgatagctccagaatgtacagtgtcttggtggaccaagatgccttctaaaggctgatataccttggaccctaatggggcagagagtatagccctagcccacgtggtgacatgaccactccctttgggaggcctgaggtaaggggagtggtatgcgttcactcagtgtgataggcacgcaaatgactgggtgatcacggactgttaccatccatggatctacctcagcggtgtaggtgccagaagagagacgtgaatgcctccataggacttagaagagtagagggtgtatggacccctctgtcagcgatgctctatagactcattcagccggaggactcagagacatgagtaactctccttgatcaacggcgtacccacttgtctagtgtgggaaggtggtcattacgagggatccaaaaaatctctgatagggaaagaaagggacagactcgtaagaacagctctacataggatgccctgtgcatatccttgatttatacctcgaggatatactaaaatatctctacccttgcatgtgccataggtagggggactctcaagtcgtgaactggtaatctcttggtgaatggacagccaatgacagacctatgagataattcaaattgtgaccagttcgtacctgttgacatcatactacactccaatccaggaaaacctcttctgcattgcaaagaagcgaaaaccatgatgttaacagcgtccagggagagcttgccatcagacagatgcctgggatcgtgaacgcaacagccgtcggagatccagtgaagacaggaacaaggccacgcaagaacgctctgaactgcccaagtggaagctaccggaaataggacaaggacaaaaaagggaccggcaactgtacaggggacataaacacggaggcggcacgaaacatccaaacgaacctgctaaacccaggagggaaagaaacagagacggaccaaacgacagcagaagcgaaaacagagaagaaaggaagcgacggaaagcaaaacgacaagagcagagcgaacatcaaagaaagaggcagacaccacagacacacacacaagcgaaccacgcgcgacacaaagaaaggacgagcaaaaccagaaggaacgcccgcg

SEQ ID NO: 496186 - DNA, 106 bp, Homo sapiens
aagatcctccagaagtgccacggtctctccatcgatggttatgtcctccatcctcgacgacccgagagatgaccccgaatgagatcaagtgtgctgtccatgtcgt

SEQ ID NO: 496187 - DNA, 470 bp, Homo sapiens
ggtagagcctctgagcctattttcttaacaaggatttagtggggttgagagacaatcctgggctccaggtctgagtctagtagacgctcttaagttcaacattcattctacagatgtggggccggagaaacagcagctattcagataaactttcattcaatacactgctcctatctgagtatctaacaaacactcttagataacaaaagctcttggcagattcctggaaatgggggtctttaagacagttaagtttcagcacagcaaaccacacaaatgtgagctccacaaatgtatacagctgaggggtgcgctggatctatttttgacacaggcagtgatgtgcacaagggaagaagtcagtccagggcgcacatctccactgttcctttgctacgggctttcttggcctctcttctcctgggcccttccaagcacagctcggtatctgggcggggaactgagcttcc

SEQ ID NO: 496188 - DNA, 134 bp, Homo sapiens
tgcgtcagagtcccgggcggcttgggatcttggcagggtaaatttgaccctccagacctcacgttggttccggagcccatactcgcggaccagcttcagttattggtcgagacgagatttctcgaagggtctcg

SEQ ID NO: 496189 - DNA, 224 bp, Homo sapiens
gttgggctgaatggacctctccagctctgggttccttgcgtgagtccctcacgttattctttcccccaaaccctcaagattgtatattttctatttctactgtgtatttatcttaaaatttattaacctatttaatattccccagggacaggaaaccaagggccccgagctcagggcagctgtgctgggtgagctcttccaggagccaccttggcacccattct

SEQ ID NO: 496190 - DNA, 864 bp, Homo sapiens
  misc_feature (550)..(550): n is a, c, g, or t
  misc_feature (557)..(557): n is a, c, g, or t
  misc_feature (570)..(570): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaagggggggggggcnaaaaaancccccgggggggnccattgggaacccgtttttggaaaagggggccccaaaagggggggacgcaatatgaggccaagagacagggggcagcatgtattcaacaagccttcgctgcaagcgggaaacaacttgtctgcggggaatctctgtggaaaggaaccccaactcgggggggcaaccaatctggggacaaactcccccggaaaattacacctccggggaaatacaaattgcgggtaagtgtgaaccacgcggtatattgccgctaaaattcctcacggatacatgtgaaaaatttacggcggaca

SEQ ID NO: 496191 - DNA, 449 bp, Homo sapiens
ctggtagctggcagcattctcgcgcccgcgctcctcctcgtacccgtgcgcccccgtgagaccgatcccgccccgtggcccaggccggtgtctggtgagagccgctggggggaggtggccgcgtcggctccggaaccgggagaggcgccgaggggtgtggggtgagggccgcccgttgtgggtcccggcgatgtctgcgtagccgcttctctgcccggtggacgcacagtgctcgtagctcctcgttttcatgggaccgtgcccccggtctgggcggtagccgatgacccgtctgtgcgggtgctcgcggtcgtcgggagtctgtgggtccgcgtccgtcgctggggcccaggtcggggtgcctgaggggcggtggccgggcgcgcggacctcgcgcgcgctgtccacggggcctgcgccagcgctacggccgtggactgccctgggct

SEQ ID NO: 496192 - DNA, 158 bp, Homo sapiens
  misc_feature (96)..(96): n is a, c, g, or t
  misc_feature (131)..(132): n is a, c, g, or t
gtgttagaacttgaactggcagaggaaaaatacctatgacgctttctaggcaagaggtcatcagaagattgagagaaagaggagaaccaatcaganctatttggagagactgattatgaatgcttttcaanncgtttaaggaaaattagagattcctc

SEQ ID NO: 496193 - DNA, 811 bp, Homo sapiens
  misc_feature (552)..(552): n is a, c, g, or t
  misc_feature (557)..(559): n is a, c, g, or t
  misc_feature (561)..(561): n is a, c, g, or t
  misc_feature (575)..(575): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaggggggggggcgaaaaaaatattccccggggggggcccaatttnggggnnncnaggttttttgtganaaaggggggccccatatatagagggagtggaaattattaaaaagagagaagggggggcgctggtttaaaacaagcgtgctgtgggggaaaatgtgtcactggggggatcctggggagaggacctcattgtggggcgcgcacaatgggggacattcacaaagaatttaaggccgagaattatattgaggttcaggtgacaggcgatggtgcgcgaaattggctggatgttggaattc

SEQ ID NO: 496194 - DNA, 820 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaggacggaaagagaccatgggggtttgaattgggccaaaggttattttaaggggggcaaatttagggttagggggcaaattgggccttatggggggatttttcccattaggggggcggttttaaaaaaagggggggcggggaaaaaccggggggtcgggaaaaaaatggggtttgccaaaattaaccttttggcagaagggccccttttcaaaagggggggcggacgtgtccggggg

SEQ ID NO: 496195 - DNA, 580 bp, Homo sapiens
  misc_feature (560)..(560): n is a, c, g, or t
  misc_feature (563)..(563): n is a, c, g, or t
  misc_feature (565)..(565): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaagaaaaaaaaaaaagaaaaaaaaaaaaaaaaaaaaaaaaaaaaaaaaaaaaaaacnaananaaaaaaaaaaaaaat

SEQ ID NO: 496196 - DNA, 782 bp, Homo sapiens
  misc_feature (612)..(612): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaatttgtgacccttttgtcccaatnttttttaaacttagaaaaattttaatttggcgcccaattgggctattttggcaaatccccctattgggggggtttaaacaataaggggccctgtttttaaaagtgtggtattgaaaaaaccctgggtgtacccatttaaaacgccttggaaacccctttttgggtggggc

SEQ ID NO: 496197 - DNA, 423 bp, Homo sapiens
  misc_feature (39)..(39): n is a, c, g, or t
  misc_feature (49)..(49): n is a, c, g, or t
ccacttgagctggacccactttcagagtaggagtagtancgaggagacnaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496198 - DNA, 711 bp, Homo sapiens
gtggtggtacccaatacccaaacattgccaatagaaaatgcaatgtgaggtaaaggatgaaacaacgatgacatgaaaatggagactgatattaagagaaacaaaaggactcttctagaccaggcatgggacagtacccaataatggatgaacgcaataggtaaagaaaaaggctgaaggcaaaggcgagagaaagagaaaggggaatatagcataagcaaaagtcagtgaaagtggcaaagggtttggcctgggtatactcttaaataccttggtaaaatgccacgatggagagtagagtgacaggagttgatgaatgtatagcacatgtatactttggatttgcaactgacaccaaaatgagaagaccatttggttgtgcctcattttaacttggcccttttgttcttcaattcaaacccagcataactcctcaagttggttattgggaacttgaataaaatattttctttgatacatcgcaagctctagctgatactttaactggatgctacccaatatccagttataatcaggcctcaacgttctgtcaggtattaagtatggttagaattgttcttacaactggtaattatagtcaaatagagataaaacagatgatgtactgacaaatttttgtgaattagattttaaagaaagttgttgtataatcatatcatttaaaatactagattagggctgggcatggtg

SEQ ID NO: 496199 - DNA, 863 bp, Homo sapiens
  misc_feature (15)..(15): n is a, c, g, or t
  misc_feature (62)..(62): n is a, c, g, or t
  misc_feature (84)..(84): n is a, c, g, or t
  misc_feature (89)..(89): n is a, c, g, or t
  misc_feature (91)..(91): n is a, c, g, or t
  misc_feature (96)..(96): n is a, c, g, or t
  misc_feature (98)..(98): n is a, c, g, or t
  misc_feature (102)..(102): n is a, c, g, or t
  misc_feature (104)..(106): n is a, c, g, or t
  misc_feature (109)..(109): n is a, c, g, or t
  misc_feature (111)..(112): n is a, c, g, or t
  misc_feature (126)..(127): n is a, c, g, or t
  misc_feature (129)..(129): n is a, c, g, or t
  misc_feature (131)..(133): n is a, c, g, or t
  misc_feature (144)..(144): n is a, c, g, or t
  misc_feature (150)..(151): n is a, c, g, or t
  misc_feature (156)..(156): n is a, c, g, or t
  misc_feature (160)..(160): n is a, c, g, or t
  misc_feature (168)..(168): n is a, c, g, or t
  misc_feature (174)..(174): n is a, c, g, or t
  misc_feature (177)..(177): n is a, c, g, or t
  misc_feature (189)..(189): n is a, c, g, or t
  misc_feature (193)..(193): n is a, c, g, or t
  misc_feature (202)..(202): n is a, c, g, or t
  misc_feature (204)..(204): n is a, c, g, or t
  misc_feature (207)..(207): n is a, c, g, or t
  misc_feature (212)..(212): n is a, c, g, or t
  misc_feature (215)..(216): n is a, c, g, or t
  misc_feature (219)..(219): n is a, c, g, or t
  misc_feature (225)..(225): n is a, c, g, or t
  misc_feature (228)..(229): n is a, c, g, or t
  misc_feature (233)..(234): n is a, c, g, or t
  misc_feature (240)..(240): n is a, c, g, or t
  misc_feature (254)..(254): n is a, c, g, or t
  misc_feature (258)..(258): n is a, c, g, or t
  misc_feature (261)..(261): n is a, c, g, or t
  misc_feature (269)..(269): n is a, c, g, or t
  misc_feature (286)..(286): n is a, c, g, or t
  misc_feature (299)..(299): n is a, c, g, or t
  misc_feature (306)..(306): n is a, c, g, or t
  misc_feature (333)..(333): n is a, c, g, or t
  misc_feature (352)..(352): n is a, c, g, or t
  misc_feature (388)..(388): n is a, c, g, or t
  misc_feature (436)..(436): n is a, c, g, or t
  misc_feature (451)..(451): n is a, c, g, or t
  misc_feature (466)..(466): n is a, c, g, or t
  misc_feature (475)..(475): n is a, c, g, or t
  misc_feature (510)..(510): n is a, c, g, or t
  misc_feature (523)..(523): n is a, c, g, or t
  misc_feature (805)..(805): n is a, c, g, or t
taacagaggcaaaantgagcaccatagtttacaagtagaaagaccatgcttgaagaaaaaanaagtacactaaggatgcacgantaaantnaaaanantttnannntgntnntcgccctcttcttnntngnnntccccttgttngttggnngtggngtcntggtattnttggtnttnggtcaccaggtngttnatgttgttntnggntttgntgnnttncatttngtnnatgnnctcgcncgtgtaccagtggngganggncttgggcnggaacatggccgtgaantgctcggagatgngcttgancagctcctggatggccgtgctgttgcngatgaaggtggccgacatnttcaggccgcggggcgggatgtcgcacacggccgtnttcacgttgttggggatccactccacgaagtagctgctgttcttgttntgcacgttgagcatntgctcgtccacctcnttcatgganatgcggccccggaagatggcagccacggtcaggtngggggggtggggngggtcgcaggcggccatcatgttcttggagtcgaacatctgctgggtgagctcgggcaccgtgagcgcccggtactgctggctgccccggctggtcaggggcgcgaagcgggcatgaagaagtgcaggcgagggaagggcaccatgttcaccgccagcttgcgcaggtctgcgttcagctggcccgggaagcgcaggcaggtggtgaccccgctcatggtggccgacaccaggtggttgaggtccccgtaggtggggggtggtcagcttcagggtgcggaanagaatgtcatacagggcctcgttatcaatggagtaggtttcatctgtgttttccacca

SEQ ID NO: 496200 - DNA, 399 bp, Homo sapiens
aggtgttgctgggtcgatctagaggtccccattggatagccgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496201 - DNA, 381 bp, Homo sapiens
  misc_feature (18)..(18): n is a, c, g, or t
  misc_feature (66)..(66): n is a, c, g, or t
  misc_feature (68)..(68): n is a, c, g, or t
  misc_feature (99)..(99): n is a, c, g, or t
  misc_feature (113)..(113): n is a, c, g, or t
  misc_feature (142)..(142): n is a, c, g, or t
  misc_feature (145)..(145): n is a, c, g, or t
  misc_feature (147)..(147): n is a, c, g, or t
  misc_feature (150)..(150): n is a, c, g, or t
  misc_feature (170)..(171): n is a, c, g, or t
  misc_feature (197)..(197): n is a, c, g, or t
  misc_feature (201)..(201): n is a, c, g, or t
  misc_feature (203)..(203): n is a, c, g, or t
  misc_feature (218)..(218): n is a, c, g, or t
  misc_feature (230)..(230): n is a, c, g, or t
  misc_feature (302)..(302): n is a, c, g, or t
  misc_feature (304)..(304): n is a, c, g, or t
  misc_feature (311)..(311): n is a, c, g, or t
  misc_feature (317)..(317): n is a, c, g, or t
  misc_feature (327)..(327): n is a, c, g, or t
  misc_feature (349)..(349): n is a, c, g, or t
gcgtgctggaaaaagcgntaatgcacttagttttccgttaggtttctatgacgcagatgtaaaggncnttctctgtacagtatattatccaatgcatgnttgttctctccccngatatattgaacaccacacagttgtgaanccntncantgggatgccccacaccccgnngaggcatctaccccggtgtataaggnaagncnttttccgttgctgtncttgcttgagcngttttattgtctgtacatgtgagctgtgtgagatagatgtgaaaagttcaaatgaatgcattttcctgcccngngtatacngattgncatctgtacnaggaactgtatgtatgaaagcnaatgtacgtatttataaatggctaacgcgtgg

SEQ ID NO: 496202 - DNA, 1174 bp, Homo sapiens
aaaaaaaaaaaaaaaaaaaaaaaaaaaaaaaaaaaaaaaaaaaaaaaaaaaaaaaaaaaaaagggccccgctcgcgatttagaaccgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaagagggggggcgcgcgggaaaaaaaacccaccacgggggcgcacaacaaagacacacacgcattatagaagaaagaaggggaccacagaagagggagaatataatacacaaaaacagcaggcgcaaacaacaaaacagaagagagaggaaaacaaaaacaacgagcatatcggagagagaaacaaaaaagaggggagagaaaaacaaggggaaacaacacaccaaaaacaaaaaacgccacagcggagaaaccaagacaagagagagaaaagagaaaaacaaagaaacataaacagagaagagaaaagataagcacaagaagaacaaacaaacacataccagggcaggaacgaacaaagggagaagaacaagagagggagaaacacccggcgacaaggaggaaacaagaaagagaggaagaccacaacaggagaaacagcgggagggagaaaaggtaggagagcaaacggaggagaaacagaaaaaaacggaagaaaacaaaacgaaggaaagaaagaaacagaagccggcagacaggaggagaacaggcacgaggacaacaacagaaaaaaaagcaaaagagaccaaccaagaagacggcgcaagaca

SEQ ID NO: 496203 - DNA, 472 bp, Homo sapiens
  misc_feature (13)..(13): n is a, c, g, or t
cctgcgttgggangccgtgtacaatccatagacatctgacctcggcacttagcatcatcacagcaaactaactgtagcctttctctctttccctgtagaaacctctgcgccatcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496204 - DNA, 355 bp, Homo sapiens
gccccaaaattgggcccgggggggggggttttaaaactcctttcccccggccttttcccaaccggggcccccccaaggcttaaggggcgccgggtttccctttgggccggggccccccaaaaaaaaacccatttagaaaaaattttttgaaaccctttttgaaatttttggggggggggggggggaaaaaaaaaattttttttggaagggggggttttccctttttaatttttttaaccccccccccctttgttccccctttaaaagggttttttttgggtttccaaaacccgaagggggggcccgaaaagtttttgccctttgaaaaacctttaaaatgtttttttttggggga

SEQ ID NO: 496205 - DNA, 671 bp, Homo sapiens
tgggcgcattatggcccgggggcctgtacaaattcgcgcggctatttttttttgggcgaagataactggacacgaaagggtagcttggctcgacctatgttaattgcctaccatcacagaccttgaatttttgaatacgtatgtgattaaggagaaatccttcggagacttctgcctgcttagggacagcgcaggcagatgtcctctacaaatctgaaagaaagaataccagcgggaatgcacacagaagcgccgtcagatcactccttttttacatgcaggcagacgcatacttacgatgcatgagctagcattacaccaattatgcctgtaacgtcaggggaattagagacccactcgaccgatttgaacaaactgaggcagttagctagagaagaaagccttgctaatggaggcagtctgtcacattaccatggaatgtgcaagttacggaagcagtggcgcctggagagcacccctggcgaagatttttgcaatgctaaatctgccaaggaattatgtggaccccaataacatctttggaaacagaaaacttctataaattcattagtaccatttcgcccacattaagatttttgacagcttaaacaaggcggcccgcacttctgaataattttgcccacaatcccctatagggagttcttccacac

SEQ ID NO: 496206 - DNA, 1142 bp, Homo sapiens
  misc_feature (2)..(2): n is a, c, g, or t
cngcacgatctctctctctctctctctctctctctctctctctctctctctctcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaagagggggggcgcgcgggaaaaaaaacccaccacgggggcgcacaacaaagacacacacgcattatagaagaaagaaggggaccacagaagagggagaatataatacacaaaaacagcaggcgcaaacaacaaaacagaagagagaggaaaacaaaaacaacgagcatatcggagagagaaacaaaaaagaggggagagaaaaacaaggggaaacaacacaccaaaaacaaaaaacgccacagcggagaaaccaagacaagagagagaaaagagaaaaacaaagaaacataaacagagaagagaaaagataagcacaagaagaacaaacaaacacataccagggcaggaacgaacaaagggagaagaacaagagagggagaaacacccggcgacaaggaggaaacaagaaagagaggaagaccacaacaggagaaacagcgggagggagaaaaggtaggagagcaaacggaggagaaacagaaaaaaacggaagaaaacaaaacgaaggaaagaaagaaacagaagccggcagacaggaggagaacaggcacgaggacaacaacagaaaaaaaagcaaaagagaccaaccaagaagacggcgcaagaca

SEQ ID NO: 496207 - DNA, 443 bp, Homo sapiens
gcgagtgagtgagcgagccagtctttcttctgaaaccatgtgcgagtcgcctccctactagctgcagccggagaccaagacggccaccaccaccagggggaaccaaggcagccgagatgaacacgggtggcctgctggacccttccccggcagccctcggcccgacccctcttcccgcgacgtctccggcgctcgtgttctacgaagacgattaccggtactactacgatgacgacagttgcctccaggaggaccaggagggcgaccacgacgcctatcaactcctagaggacgaggacgaagacgtcgccgccaccgggtcgcttgctgacaggctacgtgatctcgtccgtcagaggctggccgaggttaacgcctccagcgcggtcgtcgcggggctcggcctcgtcgggagcgccgtcggcgcctacttcctctggccc

SEQ ID NO: 496208 - DNA, 203 bp, Homo sapiens
cctagagttcccggtcgctcggacgacagagatggcgagaagttcgccgcctgggtgaccagcatcaactggtcgcagctcatcgctgacgtgaaggagtttttccaggaactcgacaaaggggtgcaggcgctgggtggctggaaggtcgtgctgatggcgctgctcggcttgaagataatctcgatggtggtccgagcgga

SEQ ID NO: 496209 - DNA, 115 bp, Homo sapiens
cattgttcccatcattccagcatgtcattgcctgtgtccatggtgtgtgcacctactcacagtctgcacctgcattgcatgcaatgcttgtgcactttgcctgtctgttttcacc

SEQ ID NO: 496210 - DNA, 478 bp, Homo sapiens
  misc_feature (197)..(197): n is a, c, g, or t
  misc_feature (205)..(205): n is a, c, g, or t
  misc_feature (274)..(274): n is a, c, g, or t
  misc_feature (353)..(353): n is a, c, g, or t
  misc_feature (412)..(412): n is a, c, g, or t
  misc_feature (448)..(448): n is a, c, g, or t
tgtgttagccagggtggtctcaatctcctgacctcctgatccgcctgcctcggcctccgaaagtgctaggattacaggcgtgagccactgcacgtggcctgtctgctcttaaagagattaataaattagagggaaaactcagaatgtctttgtaatttaaatttttgttaagggaaaataataacatttataattgnttctctgngttaataatgggtactgtcaattaatttccttttttaatatattttttgagacggagtttctctcttgntgcgcaaggtggagtgcaagtggcaccatctctgctcactgcaagctctgcctccagggtcatgccattctgctgcctnagccttccgagtagctgggactacaggcatccgcaccacgcccggataatttttttcgnatttttagtagagaccggggttcaccatgttagccngatggctttctcctgacttgtgatcctgct

SEQ ID NO: 496211 - DNA, 415 bp, Homo sapiens
tgctgctagttggtctagagtagtcccctctggatgcaaagtgtcacgggtagaaactctacaaggttaaatttactgtcaaattgcagttagtatgatgaaatgaaaggttggtattatcaggaaaatgttttcttaagcttttcctttctcttacacctgccatgcctacccaaattgggcatttaatttcatctttaaactggtcgtcctgttacacgctaacttagtaagtgcttttcttatagaaccccttctgactgagcaatatgcctccctgtattataaaatctttctgataatgcattagaaggtttttttgtcgattagtaaaagtgctttccatgttactttattcagagctaataagtgctttccttagttttctagtaactaggtgtaaaaatcatgtgtc

SEQ ID NO: 496212 - DNA, 298 bp, Homo sapiens
tgctgcagctgatgcccgcctgacgcatgatcagcaagcagttccaccaggcagctgcgcgtgggcgagcgacagcccctgctgggtccccctgagtccatgcgggaacatgtggtcgctgactccaaggacatgaagacatgatgacatggaagaactgtcaaagatttatcatcaatgagaagatgaatgggaaagtgtgggaccttttccccagaggctgacaaaatcacagcaccatgctggttaggaaagatcaggaagagacactgaaggacctaactcttcaactaccaga

SEQ ID NO: 496213 - DNA, 775 bp, Homo sapiens
gcccggtatctgttctcgcccgaagaagctggtccttagcctgcgctgggagcaacctttcggtggccagctgtagcctggtcaccgttcttcaaataatggtttaattcttcagacgagaacgtttaggattacaaaagaaagggttctcttcacatccttatccgttgtgatgtagcattccgtttgaaatggtagccgttcgaatgtcagagagaagcatatgtatgagaatgaagagaggcttctcagaatgattgaaagcaggcggttcggttactggtatcatcagtggtaatgtgatataagacagttgtcgcagtttcatgatatgcctgggtgaaacaatgtgactttgtcaaaagacccaagatagttaaagtgggatcgagacatgtaagcaagcatcatggaggttgaagatgccgcatttggatggatgaattccaaattctgtttgctttgcttttaaatattgatatgcttatacatttacagtttatgcacaaaatgtagggttaataatatgttaacatggacatgaatcttctgtataaattctacgtttgaagtggctggcctaccatgtatgatgtattctgagcaggttgtccaaggaagctctaggaggggatggggacttagaggtgtgaaccaaggaattcgtatgcaaaataaatagcgcgggggagggtggattacttttgcccaaggtttgtaaaattgtaaggggatagaaccaagaattctcggtaatgggggaataaattatggc

SEQ ID NO: 496214 - DNA, 360 bp, Homo sapiens
tctcatatatgaggtaaagctctcagactcctgcgccaacttttatagtaagctggcttacctaggctgggggcttgcaactcactgtaacgaagccaaggagttcagatctagatagcagagaagtacgtctcatactaaaacatggcaactacggttagagtccaccccatgaagctgttacagatagtgtatctttgcctgaattctataagtatatatggtacagactaaaaaaaatgtggctaagctaggtagggctgtgctgtctcagtaggacattgacagcctccagctttcaccctctggagaccttggacctaagtgccacatgcattatgagacccggcaggggaaccg

SEQ ID NO: 496215 - DNA, 942 bp, Homo sapiens
ctctcgcgctacctcccgcgccgggtcctccgtcggttctctcgtgagtccacggtctggtcttccaggctacccgccttcgtctccgagttgcgactcgcggacggcgtccccgggcgaagaggctggactcggattcgtgcctgagcaatggctgccatccggaagaaacggtgatgtggtgatggagccgtgtggaaagaatgcttgtcatagtcttcaggcaaggaccagttcccagaggtgtatgtgcccacaggttgagaactatgtggcagatatcgaggtggatggcaagcaggtagagttggcttgtgggacacagctgggcaggacagattctgatcgcctgaggccctctcctacccagatacgatgttatactgatgtgttatccatcgacagacctgatagttagaaaacatccccagaaagtggacaccagaagtccacgcattcagtcccaacgtgccccatcatccccggggggcactaaagacggctctcgggaatgctgaagaacacaagcggcagctagccacgcatgaagccacggagcaggcgacaccctgacgaaccggcagacctcccgggacaccacacgagggagcaagggtaccatgcagggcacgccaagacccaacacgcgacgtgcaaccacggcaccggcaacgcaccccaccccgcccgcccgcacagcgggaagaacaccgggcgtccgggcccggccaccctgccgaccccggccgcaagccgcaccacgaggccgccccaccccggccaccaggcacgcacacgcccgaccaccaacccgcaaccacgccccgacaccaccaacaacaccacggcaagcaggaccgaaccaaacggaccacgaccgcgcaacccaccgaacaaccacgagcggcccaccgccaccccagcgagccgagagcccacaca

SEQ ID NO: 496216 - DNA, 264 bp, Homo sapiens
atagagtaaaatcttgggtcttcggtcttatcagagtagtgtgaccctgcaacgtgtcacagacagctctcagtgtcaccatctgtacagcgacgggataacgattgggtccagctcatagaactgtgaggatgaaacgatcgtgcccagtgacgcaggtagtatagtgtcagactgcagacgggttcacgagtggcggtgactaacaagccctgtgatccgagccctcccaagttctctgggactgcctgagaactcaggagc

SEQ ID NO: 496217 - DNA, 340 bp, Homo sapiens
ggacaccccggcgtgcgcagcccaggcgtctgcacctttcaccggagccgactacagcgggcgctatgaatgtaccggtccaggataaacatataggcagctataagggtgttgttgatatggcactcgacgccaagcaaagtactggcaagtacgccgcctacaccttcaccttcaccttgtaccttggaagacaagtcccgttatgacggaatggccaccgggacttcggacgcgctgggcgtttattttgctcacaccgaccctgtcttgaaagacttcggcgtgggggtcgcacaaatgacgtccaccccggagggcaaagtgtctttcgttaagt

SEQ ID NO: 496218 - DNA, 256 bp, Homo sapiens
aaggtaagtgcctttagtacgttctctctgccttaggctgtagtgcatgatagctagatcagcaggacagcattctcagtgaaagtgagccattcgtgggtggcatgtcactccacggaataaacataacttagaaataaatgattacgtaggatagcacagtgacatggtgcactgtgaacctgaggccactgtgtcaaactgtgcactggttgtgaatagggagagccaaaaattatgtcctactggtaatgag

SEQ ID NO: 496219 - DNA, 238 bp, Homo sapiens
aagactactcagtctgccctgaccgcctgtggcctccctctccgagagatgacggtgaacacgctgggtgatgaacgggaatgcttattgtctcggccattcattgttgaaacgcacctggaggacagacagattactttccttataaggctacatctatctgctatgccctgctcagttaactggcttgatctggaagactgctcctgaaatggtcttccccaggaagacttttctg

SEQ ID NO: 496220 - DNA, 198 bp, Homo sapiens
tttcggtgctgggtaggcccggtttcagcatagtagacaagaagcgcaggacagactgaattggggccaaacacagaatcaggaaagaggaggccatgcgctggttccagtagaagtatgatgggatcattcttcctggtaaataaatttccgtttgtatacaaaagagcaataaaaagtttttagtgaaaaaaaaaa

SEQ ID NO: 496221 - DNA, 370 bp, Homo sapiens
tttttttcttttttccacaaatagcacttttaatttggccactatttggaagtctgaacttaaaacagattcttggactgggtgggttcatatcccatcagctcgttcaatctttagccacctgtctcgtccccagtgggtctttcccagaaactactgccttcaccatgaagctccatgagtcttccccaattcaaacttgggcttcttcagcatttttatcttttcctaacgaagactatcatggagaggataaatagattggcaagccttttctatagtcttattcccaatgtctgtctgggaatcaatttattgaccatctttctttacaagtcatttgtctgcacctcctcgggtcatgattccc

SEQ ID NO: 496222 - DNA, 234 bp, Homo sapiens
agagacgagatgtacagagacagagacgagatgctggtggcgggacattgaggacagcaatggtagtctcaactataagagctcgtccgcatggtgctgaatggattaggaacttaccagtctccccagagtccgtgcctttccctgtgtgaatatagtatctatgcctatagtttaccctaaggactattcttgtatacagacaactttcccatctcgtctcttctctatgta

SEQ ID NO: 496223 - DNA, 304 bp, Homo sapiens
  misc_feature (145)..(145): n is a, c, g, or t
ccccccccccccccccccccccgctggtggagggcccaaaaaacctggggggggggaaaccgccgggggtgggcttcctaccaccccccgggggaaaaaggggccccggcccaattggggcccccaatttttggggtttaggacnaaaaggaaggggaagggaattcccctccccctcccccccccgtgggtgggaaccccccctaaggccaagcctgccctggggccccccaaccaggggtggggggacccccccccccccccccccgggccaaaaattttttctttaaagaatgttttggga

SEQ ID NO: 496224 - DNA, 610 bp, Homo sapiens
taaaaaaaagtgggggggccgcggggggggggtgacccccccggggggggggccctccctcttttttgggttaaaatttttagggggtgccgagggggggaggagggggggggcgccccactaattactccccccggggtgaagagaagggggcctctccaatcaactagaggaggagtcttcccgcctcaagaacgagagagaggcgtcttccaacaacggcagcgagccaagcatccatccacaactaatccgcgcgcggcggaggaagagaaaagcaccagtacgaccccacaaaataagaaggaggaggatgtccacgggggagcaatcacagcgggggtagcccccccggagaagaagggcggggggcggatcactcgagcgagagaaggcccgcgaagaacaagcgtgcgtgtgtgtggagacacaacaaccctcaattaaatttctacgcgccgaggagataaacaatatagacagaagcagaaaccagagagtctctgcggcggacgaagcagcgtgcgagcgcaccaggcgacgtgccccgaagaagaaaggtgggcacacacctgagaaagagccccgctagttgacgaggcgaaagact

SEQ ID NO: 496225 - DNA, 105 bp, Homo sapiens
ggatttgctggtgcagtacaactaggcttaatagggacatgaggtcaggagatcgagaccatcctggccagcacggtaaaaccccgtctctactaaaaacaagaa

SEQ ID NO: 496226 - DNA, 150 bp, Homo sapiens
ggaacctcagatcggctaacggacacacacaagtatatgcctacccgcgcagtactgatcattctatttccccctctattgatccccacctccaaatatctcatcaacaaccgcctattttacaccaaccccgccgttaggccgatctga

SEQ ID NO: 496227 - DNA, 324 bp, Homo sapiens
cgatcgagctcggtccccctagttttagaagtttcaatagcatcattaagctgggcacagtggctcattcctgtaatcccagcacttcagaaggccgaggcagggggaccacccgagcccaggcatccgagaccagccagggcaacatggggagacatctccacaaaaaattaaaaaataaaaattagccaggtgtagctggtggtcttagctactcaggaggctaaggtaggagactcactggagtccgggtggtcgagaatgcagtgaaccgcgaccgcgccactgcactccagcctaggcaacagagcaagaccctgtctc

SEQ ID NO: 496228 - DNA, 101 bp, Homo sapiens
gaggatccctaatttcaaaatattacgagtcttatgggtgaaaaatgaatcgagagggcagggtggctcgtatgggactaccggggagggatcagtggagc

SEQ ID NO: 496229 - DNA, 843 bp, Homo sapiens
gccggttcaaagaggttgttaaacggccgttgtgccaattttggggcaagatggcagcctctatgtggggcgagccgcttgttcacacccgtgttggggtgcgaccccgcaaagatacctttgcttgttgccccctggtatgccgccacgggtgtggtgtatccgaggtgctgtctctttcaaagaagggacaaggagtacgccctgctgtctccaaactcccccggcggtatatgctggggtgtggataaacaggacgttgtaccgacccgcgcgggttcattactctttctagaaagcaccaccggtgagaaatggacgagggtttccaccacgccaacatcaacgcgcgctaaggtttccccccacagagaaactccgcgtgtctgtctgggcggaagagagcacaccacagaaccagaacttgaaataatgaccgggcacgccgccggccaccctgcgcgaggtacgagagaccccccaggcagggatcgcacctcgcgccctgtgagtcgagcaaccaacccaagggtagggacggcgacgcttacgtgggatacccccccggccgtttttaaacgaaacacgcctccccggccggcacagcggcgcaacaacacccccgatgttttttcggaacatctccgcacgagacccccgggtatatgctgcagagagcccccgaggagctgaggaggatctcgaagggtaaatggatggtagggataccgctacccccaaggagggagggctgcctagcggaccccatagtcagagcaccagcggcttcaccgctctgggggcgacaaacacaaaggcttttcccccacaaaacaaaaacac

SEQ ID NO: 496230 - DNA, 938 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaatcagaaaaatgagaacacaagaacatagaaaacaaagagaaaaggaacaacagaacaatacataggaaaaacaaaaacacaagacaagaaaacaacaagtaagagaggcggagcgccgcgaacgccaaccaagcccaagatccctaaccagggggcgcgcggcccaaaacgacattagacgggggcgatggacaccaaaccactctggagggccgaaaacaaataggaagagagagacccaccccacggacgagagaagggataggccgaagtccggcaatgtcccaaaccagatcccaacacaccaggaaaacggacatctgcgcgcacccccggggcacccgttgtgttcccaaaccacagccgacgcgcgtgcacgggaggccgccgaacggcgcaacaagaaaaacgcgagcctcgcagacacgagacgacaccacaaaggggattacaccactacccggcgaccgga

SEQ ID NO: 496231 - DNA, 924 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaacaaaaaaaaaaaaaaaaaaaaaaaagggggggcgcggcataaaaagacccaaaagggggcaaagtcagagggagaccaaaggttccggagaaaaggggcgcccaataaggggagccgcatattaaaaccaaaggaccgggggcgcagaatataaacaaaggcgagaaggggacaacaaggcgaacacctgggacacatggggaagggcaccatcaacaaaggagggaggggacaaaaaaatgggagaacacaatcgccccagaggaatctatcaaaggcccccaccggggccacatatatccaacagtttctacgacgccgcgtcaatcggtgtggataaacacacagcgggggaaagaacacgcgagagacgtcacagcactttcggcccaacaggagaaaagacaatctcgcagacatttcttcacccggggaggtatcacagctaa

SEQ ID NO: 496232 - DNA, 620 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaagccccctattccccaattgggcccaaaatgtttcttttccggggcctttaatttggcttgcggctccttttttttttttgggcgggaggtgtgttcaacggcctctcaaaaaaataaggttttcttcccgggccccccccgcgaatgggaaggg

SEQ ID NO: 496233 - DNA, 471 bp, Homo sapiens
gagtcccggtcttcaatcggtaagccaatctgggaagtgggggggattcccttggataggactgggtcatctttggaaccaagaacaacctcggggcctggggaatccttaaatctggcaggcaaatctaagcagcatttccttcaaaaatttctaaaatccggcggaatggtcttagagaaataagggtttaaaatgagggtttttcttcaagaaaacaaggcttccaaaggaaaaggttggggaaaaatctttctttaagaatttcttagtctttttctgcattggagcggggaatggttgggtggaccctgttggaggatttccttgccactagagcccctggagatcatttgcccatagaggacagtcttccaaatgggtctcacaagcatttgccccgttttcttggcatattccttccttggccaggtaacttccctcaatccgggtcctttggagaagtttgct

SEQ ID NO: 496234 - DNA, 540 bp, Homo sapiens
  misc_feature (520)..(520): n is a, c, g, or t
  misc_feature (523)..(523): n is a, c, g, or t
  misc_feature (525)..(525): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaagaaaaaaaaaaaaaaaaaaaaaaaaaaaaaaaaaaaaaaacnaananaaaaaaaaaaaaaat

SEQ ID NO: 496235 - DNA, 181 bp, Homo sapiens
cttcaccgagtctgtgtctgcagccagagcgaggggcgtgtcttctttgcaggaagccagccttggtctccacagtcagaaggtggccaggatcccaagaacttctcagacatccatcctggaatgctgctcattggttattgtgacgagcatccaggcctctggcgtgtacatccagtat

SEQ ID NO: 496236 - DNA, 526 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaattattatatggttgttacactcggacacaaataaacacagaaatagtccagaagtcgacc

SEQ ID NO: 496237 - DNA, 475 bp, Homo sapiens
caaaataatgatttattacgccttcagctatttacaaagatgatctggttggaaatgtcacatggcttgggtaaaatattcttctatgatggaaggtctcttttcatttcacctgctggcgtgagttaatattcaaaacgcatgttggttttctagagtcatggctgccagtatttgctctagccttcttacgatatttcctcctggtgcagtagacactgacgagagtgatgattagcatcacagcaaacacggtgaccgtggaagaaacagcgatgataacagtgtctcgggtggaccctctcttctcacaccttttgcccatgtaccaccagtcttctcctgcaggacacttgcactcagctctgccatcttggacaacacagatgccaccgctctgacatacaacctcagagcaggcattatggacagccaaggtggggactgggtcgggggacagctgatgtagaattga

SEQ ID NO: 496238 - DNA, 1122 bp, Homo sapiens
  misc_feature (659)..(659): n is a, c, g, or t
  misc_feature (671)..(671): n is a, c, g, or t
  misc_feature (682)..(682): n is a, c, g, or t
  misc_feature (692)..(692): n is a, c, g, or t
  misc_feature (697)..(699): n is a, c, g, or t
  misc_feature (701)..(701): n is a, c, g, or t
  misc_feature (710)..(710): n is a, c, g, or t
  misc_feature (715)..(715): n is a, c, g, or t
  misc_feature (729)..(730): n is a, c, g, or t
  misc_feature (736)..(737): n is a, c, g, or t
  misc_feature (748)..(750): n is a, c, g, or t
  misc_feature (771)..(772): n is a, c, g, or t
  misc_feature (774)..(774): n is a, c, g, or t
  misc_feature (778)..(778): n is a, c, g, or t
  misc_feature (789)..(789): n is a, c, g, or t
  misc_feature (796)..(796): n is a, c, g, or t
  misc_feature (800)..(802): n is a, c, g, or t
  misc_feature (804)..(806): n is a, c, g, or t
  misc_feature (811)..(811): n is a, c, g, or t
  misc_feature (822)..(823): n is a, c, g, or t
  misc_feature (828)..(828): n is a, c, g, or t
  misc_feature (832)..(832): n is a, c, g, or t
  misc_feature (836)..(836): n is a, c, g, or t
  misc_feature (840)..(840): n is a, c, g, or t
  misc_feature (859)..(859): n is a, c, g, or t
  misc_feature (867)..(867): n is a, c, g, or t
  misc_feature (875)..(875): n is a, c, g, or t
  misc_feature (877)..(878): n is a, c, g, or t
  misc_feature (880)..(881): n is a, c, g, or t
  misc_feature (890)..(890): n is a, c, g, or t
  misc_feature (892)..(892): n is a, c, g, or t
  misc_feature (897)..(898): n is a, c, g, or t
  misc_feature (900)..(900): n is a, c, g, or t
  misc_feature (902)..(902): n is a, c, g, or t
  misc_feature (904)..(904): n is a, c, g, or t
  misc_feature (912)..(912): n is a, c, g, or t
  misc_feature (914)..(914): n is a, c, g, or t
  misc_feature (917)..(917): n is a, c, g, or t
  misc_feature (929)..(929): n is a, c, g, or t
  misc_feature (934)..(934): n is a, c, g, or t
  misc_feature (953)..(953): n is a, c, g, or t
  misc_feature (955)..(956): n is a, c, g, or t
  misc_feature (960)..(961): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaacttttgggggcggtttgggccaagggatttttaaattggaaaaggtttatcattgcggccgaatttagagttaattgggcnaattcccctaanggggggggttnaaaaataaangggcnnngntttaaaaanggggnaatgggaaaaaccnnggggtnnccaaattaaannncttggaaaaaatccccttttnncnagtngggaaaaaacnaaaaagncccnnncnnntcccntttccaaaaanntgccnaccntaangggnaaaggaaaattgtacggtnaaattttngtaaaaancnngnnaaaattttngnaaaannancntntttttaancnaangggcaaaagggnaaaanccttttaaaaaaaaaaaananncccnnaaagggtagaggttttcccaatgtgaaaaaagaggccccttttaaaaaagggggccccaacctcaagggcgaaaaaaccctttttataggggaggccccctattggaaaccattcccctaaacaaagtttgtggggtccaagggcccacctttggcccccg

SEQ ID NO: 496239 - DNA, 117 bp, Homo sapiens
cctgatcggaacaaaaatgggagaaatgaagttagcagtaacaaacacttactgtatcgacttaccagtgtgccaatgcactgttttaatgcacttgacgacatgttagctacactt

SEQ ID NO: 496240 - DNA, 623 bp, Homo sapiens
  misc_feature (603)..(603): n is a, c, g, or t
  misc_feature (606)..(606): n is a, c, g, or t
  misc_feature (608)..(608): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaacnaananaaaaaaaaaaaaaat

SEQ ID NO: 496241 - DNA, 731 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccaaaaaaaaaaaaaaaaaaaaaaaaaaaaaaaattttggggggccgctcgggcctataaagaggtttttataaacccagctgttgtgggggggcgccgcgccccagtatatgtttagatgacactttgtgcccatagaggtgttcccaagaaaacccggcgtctgtaccatatgttgttgggttctctccaccaaataaaaaagcgcggcggaacccgcgttttgtgaaaaccccagaggggtttggagccaataaggccttcaacgggcccaggagctcataaccccgccgggtgagaatagaaagaaa

SEQ ID NO: 496242 - DNA, 464 bp, Homo sapiens
  misc_feature (441)..(441): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaaacagggaanaggcggccggtcgcgcggccgcg

SEQ ID NO: 496243 - DNA, 466 bp, Homo sapiens
  misc_feature (448)..(450): n is a, c, g, or t
  misc_feature (452)..(452): n is a, c, g, or t
  misc_feature (455)..(455): n is a, c, g, or t
  misc_feature (458)..(459): n is a, c, g, or t
  misc_feature (461)..(461): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctannncngcnganncncattt

SEQ ID NO: 496244 - DNA, 583 bp, Homo sapiens
accctggtcgagtaccaaagctgctgagcaagcaccagaagcaccaggctattgaagcagagcatgatgccagcgctgcacggactccgatgaggttatcgacatggtgtgaatccctcattgaacgtggagcctgtgccggcagtgaggatgctgtcaatgcccgactggctgccttatctgaccagtgtgccgttcttggtgcaaaagtcagcggaaaagagccagaaactgaaaggaagccaacaagcagcagaacttcaacacagggatcaaggactttgacttcgtggctgtctgaggtggaggccctgctggcatccgaagattatggcaaagacctggcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggactcccggtgagacaagctgaatgaacccatcgcctcaccagttcttcg

SEQ ID NO: 496245 - DNA, 92 bp, Homo sapiens
ccccggggggggggggtttgggttttttttttcccctttaggggtcccgggggggttgtgtcccttaaatttttttggggccccccccccca

SEQ ID NO: 496246 - DNA, 271 bp, Homo sapiens
tcagtggttatcaaaaatcagcaagtagcgcaatgtctactgttggtaaggtaatgatgggagctggagctgcaattacagcagttggtgtaacaggtgtaaagagctttggagacttccaagcgtcacttaaccaagccgcagtcatcgctggtggtacatcaaaagacattaacggacttgctgacgtagccacaaaatgggtgctgacctgcctttaagcgctggtgctgctgcgaaagtattggtagccatggctcgtgacggggcg

SEQ ID NO: 496247 - DNA, 114 bp, Homo sapiens
ggaagacaggcgcatgagccagtggatcttgaagacgctgtacgtgtacctgcagaggatggacacccatgaagatgccagcggcacggaagcaggcggacatgaccatgtaga

SEQ ID NO: 496248 - DNA, 221 bp, Homo sapiens
cacgggaggatgtcagccaatgaacgccctggagtcctacgccttcaacatgaagagcgccgtgtaggatgaggggctcaaggtgctagatcatgcgaggccgactagaagaaggtgctggacaagtgtcaagagcgtcatctcgtgtcttgacgccaacacctttgcctataaggacgattttgagcacgagaggaaggagctgtcgccgctgcgcctgt

SEQ ID NO: 496249 - DNA, 466 bp, Homo sapiens
tttccatcacttgtgaaggtcaagagttcatgagctttatgtgcaccattgattcgttaggaaacacgttccaaggagatctcctgtcaggcgatcttacaactgcaatgtcctgtgcatccgacgttagatattctacctcggggcctctctatgtcgcctacttgacctccaccggccggtacgtgcgttgagacccataatgagtcacacttttctcaggatacagcctcccttgacatagtctcatccacagtatgggtgcagaattgtataaggcaactccatggtttcattacccaatgtaaactgtttatagacatatgcccagtctagctcgattcattctctctttattccgggctgtcagctgcccagatctcattttagacatgttctagacatgatatgattctatcgatagacactagatattatcatgatgccacacagggaatcttcattt

SEQ ID NO: 496250 - DNA, 245 bp, Homo sapiens
cataattcccaggtgttgtggtaggtaattgaatcatgggggcagtttccctcatgctattctcatgatagtgagctttcataagatctgatggttttataagtgcctggcatttcccctactggctctcattatcactcgtgccgccctgtgaacaggtgccttccaccgtgattgttaagtttcctgaggccttcccagccatgtggacctgtgagtcgaaaattaaacctcttttataatta

SEQ ID NO: 496251 - DNA, 117 bp, Homo sapiens
agcccaaagtgaaaacagtatctaagtattcaagtttattctagcacatattttttaagagccttaaagaggtttcacggatggtccgagggatcctcgtagagatcgacctcgcag

SEQ ID NO: 496252 - DNA, 101 bp, Homo sapiens
ggtaagaccaacatgtttggtttaagattgagagttcagctcctggaattaggcaaggagggggattcatatatgcttggaaaattgaatatctctggttt

SEQ ID NO: 496253 - DNA, 258 bp, Homo sapiens
ggccaggctggtctcgaactcctgacctcaggtgatctgccttccctggctccggacatgctgggattacaggtgggagccaccacgccaggccacagtttgatgagttttgagaaagtaatatacgcatgtaaccaccatcaccacaatcaagatctagaacatttccatcaccccaaaattccctggtactcgtccctggtcaccagcaagccctgatctgttttctgtcactgtggatcagatttttcttttcta

SEQ ID NO: 496254 - DNA, 497 bp, Homo sapiens
  misc_feature (84)..(84): n is a, c, g, or t
  misc_feature (101)..(101): n is a, c, g, or t
  misc_feature (135)..(135): n is a, c, g, or t
  misc_feature (195)..(195): n is a, c, g, or t
  misc_feature (325)..(325): n is a, c, g, or t
  misc_feature (347)..(347): n is a, c, g, or t
  misc_feature (353)..(353): n is a, c, g, or t
  misc_feature (356)..(356): n is a, c, g, or t
  misc_feature (386)..(386): n is a, c, g, or t
  misc_feature (396)..(396): n is a, c, g, or t
  misc_feature (411)..(411): n is a, c, g, or t
  misc_feature (436)..(436): n is a, c, g, or t
cgttatagaggatcccttcagcacatctagtcaccatgagtgatctgtattgatgtgacatgtgtgtgtcccatgatacctgcngtgtgaatgctgatggnctgtggcacacagatgctcataactgttgtcctntggctgtcccctttattatttaagatgcccttctctgtctcctttcatgttttttgcccntatttcatccctctttgatattataactaccacccctgccttctttttgtttggctggtatacttttgcctatcatttgaatttaaacctttgagaatcacatttttatgtggttctcttggatgaagcnttgagttttgctttctgatccnacttcnaantctttttaattcataagtgagtttaggccntttatatgcnttgctgtggtataantgtttggtcttggttatgtcatacnttctgttggctttttgtgtttgtaatttttcatatatcctaactgtgctgaagggtaccga

SEQ ID NO: 496255 - DNA, 426 bp, Homo sapiens
ttgatctagagatcccctaggtggacagcgacgcgcacagcatgcagcaggcagtacgctctggcgcagtcccatggccccacatccaccagcccaacccagcccatagtgccccaatggtgctctgcctctgtggacatcctctgatggcccctgtggaaaatccaccagacccggggtcacctcttcttcccaggaaggtggctgtccttaccttggccttgaggccagtgagctcacaggccaaacatggaagcaagctgatctggggccctgaaggagtggcctggctctgggcccctgtgctctgaggtgcactcaccctggctgtctgttgagaacctgctggggccccgcaatcttggttgtgagtacctgctaggtgtgaggctctgctttctcaaacttcatggccccaggaggcgt

SEQ ID NO: 496256 - DNA, 526 bp, Homo sapiens
gagtgtgtatgctgaaacctgggcttctgtgaggcgatgcctcaccccacttcggctcttgcttggtgggctgcatccactgtctgacaagccccagtgagatgaacctggtacctcagttggaaatgccgaaatcacccatcttctgcgtcgctcatactgggagctgtagactggagctgttcctattcggccatcttggaacctcctgtatcacaatttctttatccactttttgattggtgggaatttgagctgcttccatgtttttgcaattgccaattgtgctactataaacatgtgtgtggaagtatcttttttgtataatgacttctttcctctgggtagataactcatagtgggactgctggattaaatggttgttctacttttagttctttaagggatatcctcactgttgtccttagtggttgtactagtttacattcctaccagcagtggaaaagtgtttccttttcaccacatctatgccgacatctgtttttttttaatcttttgattatgg

SEQ ID NO: 496257 - DNA, 662 bp, Homo sapiens
tcacaccactgcactccagcctgggcgacaaaacaagactccgtctcaaaaaaaaaaaaaattacagtctgtccatacagttaaagaaattaaaaagcccccgataggaatatctattctgttctctaaaattgagtgtacatttaagaccatttaagacagaaaaggcagaactaacaagtgtactctaggtgataaatctggtaccactactgtaccccaatatgttcagttctatctgagtaaaaatagagatctggaatataactactgggccccctactcagctcttaactggcatgggtacacaggctcttgacaacagcaagcacaactctcacgcttaaaccaatatcaacaacacataggtatgaagaatccccttaagaataaaactatccccccaaaaccagctgtagagcatacgtatatcccgtgacaataacaaaaattcacaagccatcactgggaagcgtggatattgcaccagaagggaaaatagcagtccacactatcactgtttacctaacacgcacacaaaaccctaacctaggcactgacctacgcattgaaccttacccagggcacaataactgcctgtagaacggaaaaacaagccgaggctccccacaagtgtgacctgcattaatcccactcaaatc

SEQ ID NO: 496258 - DNA, 256 bp, Homo sapiens
atgatgtgtgcgaccaagcacacgccctcgccagggcccttgctgccctggctgcacagcagcgcggactgagcgtagccggtctccaccactgacacggcgagctgctgccccagaggtgactccggcagctgtagaagccgaggcaccccgcgaactgcagcagcatgcgtcggaactcacactggtttttcctgagcaaggcggaggtcagcttgaggacaccatccgtggcaagccccaccacagacttgca

SEQ ID NO: 496259 - DNA, 738 bp, Homo sapiens
tctgtgaacaaccagctctcccagaaactaatagagtgagaactcgaccattaaggaagggcactaaactattcatgaggaatctaccttcaagatccaagcacctcccattaggcctacgtctccaacactgggggtcaaatatcaacatgaagtttggagggcacaaacaaaccacatccaaatcatagcaaggtgtttggctgtgaacaaacaaaacaaaacatgattttttattagacaaagtagagattgtgtattgatgaacaatccattgactgatgatattaactgattgatatggattaatatataattaatatcaattgagtgagttgggagtctgtggcaggtggatcacatgaggccaggagtttgagaccagcctgggtgacagggcgagaccccatctcaaaatcaattgatattaattgataatacagaaggagggtacaactgctgctgtaattaccttgaataaatgaaagaagaagagccattggggcacaaatgaaagggttggccttagctaggatcatggacagtctaccaaagaaacatccgggaaggccagtatgtcgaccagctgcgaagtgagtgacggtggtgagggccggaggctaatcaatcctcgggcgcttacgaactgcgcagccgaggggaacctcagggcggcaaaaggaattggtgccccattcccacgggggcgtataagacacacaagggtgctgtgccgcg

SEQ ID NO: 496260 - DNA, 910 bp, Homo sapiens
cgctgcactggccgtgtccacgggtcacgggttgaccaaggtgatcgcgcgttttggcacccaacctgcgttttttaacgggtaccctccccagtgggcttgccccccccccgcggtggtggacaccattgcgccttgggggacttcgttgtgtttttggtttttttagttgttgtgtggttaaaattggttatattctaaagggtaactgccccgtgttaacgaaataatttgggtgacctacaaaaagatggccttttttcccacccgcccctatgagggaaatttgaacaacagctgggaaaaacccatctttgggttgccaattctaaggaaccccctgccgctctatgtagttcaccctgaggtcttcccgttgtttcccggaacccggtccatggtgaaatttttggtgtgttttgggtgtttttttatgcagcaacccacggtgagaacccgggcgagtgttttccaggctgtgtagaagcacacgtttacccgttggcttgctttgtgtgtctggtataaaagggaagtgccactacagtaaaaaatgctgtaaataaaatcgaccacgtgttctccacgaaaactggaataatctcgcccgagagcttcgaatggcttcttgtaaccacctgtacggagatttatagaaaatagattgggttttaaatccccggaaaattgtggaggttggtggagcccctcgaggtggaggggaactttcacggctttcttaaagctgaataaaagggtgtaaccccaagagtaccttttttttggaacccccgttttgatggccaaataaattatggtcgaaacaaccaatctccggtttattattccctaaggaatctgtggtataataccctgggaccccttataaagcccaaagtggttgtttcca

SEQ ID NO: 496261 - DNA, 477 bp, Homo sapiens
tgcatgcaggcagactgtagagggacccccgccccgagcacagtgcttccagaaacactggtgacattctacagcagctttggccaatgataattcctgcatatgtactatatctgcactgaccaatacaacagagccattggccactcacagacactgactactcgaaatatgcctgcactgatgaattttgagcctaatataaatgcaaagagccatattagctagatgctacaggactcaacagagcagcttacatgactatgtaaatatcaggcacatggaagacacatactctgtgatctaaacttatgacactatcaatacgcattcgatgagaaataacatcttccacagaaacaccaatttataagctcttataaataatttgtcactacaaaggaactatcaaagagctaaaagaacagatatttggctgggcgcagtaactcatgcccgtaatcccagcactgtgct

SEQ ID NO: 496262 - DNA, 239 bp, Homo sapiens
  misc_feature (141)..(141): n is a, c, g, or t
  misc_feature (214)..(214): n is a, c, g, or t
cccatgccattatagcttaggtatgtcgtactatctaggttgggtaagtagatccatgatgttgcacagtgacgaaattgcctaatgatgcatttctcagaaggtatccccgtccttaagcaaggtgtgactatgtgtatnaggctgctttctatgttgcttagcacccagaaggcagctcccggaaaatataatttagtctgggtgtcagagnagcatgcagtcaaagttagaggggg

SEQ ID NO: 496263 - DNA, 81 bp, Homo sapiens
gcggccgcctactactactactactgctcgaattcaagcttctaacgatgtacggggacatgttattaaaaaatgtgaact

SEQ ID NO: 496264 - DNA, 444 bp, Homo sapiens
cacccatcccataaaatatgtagtgaagataaaataaagataatagtatgttgatgtccccggagctagctctttagagcaagagtcagtccacagaccgggtcaaggaacggagataataactacttgaggctttgccagtcatgtcacctccatagcagttactcaactgtacatttagaacacagtttccttttactgtgcataaattatttggtgtggttatgctcccatataattttatttctggacatagaaatttaggtctcatataatgctcatgtatcactgagctccttgtgttctcctgcataacatcttatctttgtcttaccctctcagccccggctccagcttccgcagctcctccaccgcctgaaccggctccatcgatgtcatctgttcttgttctccttgtgtaaattcttttgggaggggtgttcc

SEQ ID NO: 496265 - DNA, 117 bp, Homo sapiens
catgacgtgtgggagacggaatggggtagcgtgataagggcgatgagtgtggagaggaatggggtgggttattgtatgttcaaactgtcattttatttttaccccggtacatgcaag

SEQ ID NO: 496266 - DNA, 187 bp, Homo sapiens
gaggactctgaagcactggggaggactctgaagcatggatttgtttctgggagctctattctgtcccttatgctctatatattgtttttatgcaagtaccatactgttttccttactataatgtgtgtgtgtgtgtatgtgtgtgtgtgtgtgtgtgtgtgtatctatgttgcccagtgctacagag

SEQ ID NO: 496267 - DNA, 131 bp, Homo sapiens
gcgaatggctcattaaatcagttatggttcctttggtcgttcgctcctttccaccacgcttctgtttcgtcaggaccgtggccgcgcaacaggtcttgaggcttgccgccgcaattttggccgtatggccc

SEQ ID NO: 496268 - DNA, 1101 bp, Homo sapiens
gtttttcttgtgtttctttctttgtgcctctgtcgttttgttctctcgttttttactgtagtatcttgtccaaattttgtgtttttcttcttttttattatttttgtgatgtgtgtggtcatgtgcttcatctcttttatctctttgtagtacttcgtcaatgcccctagtctgttaaatcgttttggctcttaggccttttttatcgtgggaaatcatctctgtattaatttttgtcttttgggttctgtgtattggatgattttatccttcggtgcttctcgtatcctgctttcttctgtggtggtagctgttcttgttgtatgaggtgatggaattcggatgtgtctcgatccttccacatctgcccgcccagagctgtacgggctgatgcgtgagtgggggcacagcagcgccactcccagaggccgtaccttcaagcagctggtggaggcgctggacaaggtcctgctggccgtctctgaggtagtacctcgatcctcgcgcctgaccgttcggaccctattccccctctggtggggacgcctgcagcacctgctcctccagcgattctgtcttctgctcacgacccctctgccattgggatccagctccttccccttcgggtctggggttctagacatgagcaagggcttaaggctgtgctggctactataggctggtggccttgggccttggggctcagccacagcctgacacagtgctcgaccattgatagcatggggcccctggcccagagttgctgtgcctgtgtccaagggccgtgcgccttgcccttggagctgccgttgcctgtgtcctgatggccacaaatgtcagggttcatgctcaggcttcattggaccattaggcagcattaagtccccatcaccagggtttggcatgaagcacatagagacataggaggagcagtgcatatagcataaagcctccgtgccatcacgcaatagcacaagcaaggaaggtatcatgcggcactcgtgtagcccccatttccccacacctccccctgcatgcagcagccccagcgtcttgacgggagcattggcaccacatgataacctacagaggcatggaagc

SEQ ID NO: 496269 - DNA, 756 bp, Homo sapiens
  misc_feature (338)..(338): n is a, c, g, or t
  misc_feature (341)..(341): n is a, c, g, or t
gtccccaaccaagctgagtgccagcaggggggactccaccatcccacaaggcagccggctcaataacatcgttaacaggtccatgacgggctctccccgcagcagcagctagaccactcaccactctacatgctcccccactgccataaaacattaagaaaatcatattgcttcttctcctatgtgtaaggtgaaccatgtcagcatgcagagatgtgcctccacaccgctggccccacgttccctgaggagatgggagagacccagtctgagtactcagattctagctgtgagaacggggccttcttctgcaatgagtgtgactgccgcttctctgnggnggcctcactcaagaggcacacgctgcagacccacagtgacaaaccctacaagtgtgaccgctgccaggcctccttccgcgtacaagggcaacctcgccagccagcaagaccgtccatacacggtgagaaacccgtatcgattgcaacatctagtggggctccagttacaaccaggccagctcaaccgtgaaaacccaacacctcgaattgcactctggagtagaagccactacaaagtgcgaaacctgtcggagcctagatttgatacaggtggcccacactccgtgcccatgtgctgatccacactggtgagaagccctatccactgtgaaatctgtggcacccgtttccggcaccttcagactctgaagagccacctgcgaatccccacagagagagcgtcggggatcctcaa

SEQ ID NO: 496270 - DNA, 340 bp, Homo sapiens
cgccacagcttctcatgagacaaaggaggaagcaggcaccgtgaagagggtgatgtgccaagcagtgtcagacagcagtagtcgcacattgggagtgccacatgctctccatcccttgagaggacgagaaacctgaaagacttgggtttattcctgatgtgtgtcttcttgatttgtacactagtattgtttctatttggataggactgagcccaagattaatctttcagattcttaagtattttccacccatggcgttagctagcttttgtatcctataacagagttctttataaatcatgtagactaagcttaattcatagctcatagagactttcct

SEQ ID NO: 496271 - DNA, 141 bp, Homo sapiens
tggtcgatgcactatattacccacaaaaaaagacaagcagacgggaacttgttaacgatgtgtgctggtgatctcctttaaaggacgagcgagtgtttctgtccacattttcagaataggctccgtatgacataaccgcgg

SEQ ID NO: 496272 - DNA, 180 bp, Homo sapiens
tttttcagattggaattagttttctgtttaaggatttaatggtactgatttatgaaacgataagtaaaagaaaaaatattttgtggtgggagaagtaagttaaaaaatgatatgcttaaacaagcttttgttacattgaatttgcttttattaaaataaaaaattaaacaaaaaaaaaaa

SEQ ID NO: 496273 - DNA, 106 bp, Homo sapiens
tctctctctgtcactctctcacctgcctgccaccatgtaagacatgcctgcttccccttctgccatgattgtaagtttcctgaggcctctccagccacactggatc

SEQ ID NO: 496274 - DNA, 739 bp, Homo sapiens
  misc_feature (44)..(44): n is a, c, g, or t
  misc_feature (155)..(155): n is a, c, g, or t
  misc_feature (181)..(181): n is a, c, g, or t
  misc_feature (205)..(205): n is a, c, g, or t
  misc_feature (267)..(267): n is a, c, g, or t
  misc_feature (285)..(285): n is a, c, g, or t
  misc_feature (294)..(294): n is a, c, g, or t
  misc_feature (300)..(300): n is a, c, g, or t
  misc_feature (308)..(308): n is a, c, g, or t
  misc_feature (311)..(311): n is a, c, g, or t
  misc_feature (329)..(329): n is a, c, g, or t
  misc_feature (333)..(337): n is a, c, g, or t
  misc_feature (343)..(343): n is a, c, g, or t
  misc_feature (348)..(348): n is a, c, g, or t
  misc_feature (356)..(356): n is a, c, g, or t
  misc_feature (358)..(358): n is a, c, g, or t
  misc_feature (360)..(360): n is a, c, g, or t
  misc_feature (364)..(364): n is a, c, g, or t
  misc_feature (367)..(367): n is a, c, g, or t
  misc_feature (369)..(369): n is a, c, g, or t
  misc_feature (373)..(373): n is a, c, g, or t
  misc_feature (375)..(375): n is a, c, g, or t
  misc_feature (380)..(381): n is a, c, g, or t
  misc_feature (383)..(383): n is a, c, g, or t
  misc_feature (387)..(388): n is a, c, g, or t
  misc_feature (390)..(391): n is a, c, g, or t
  misc_feature (394)..(394): n is a, c, g, or t
  misc_feature (397)..(397): n is a, c, g, or t
  misc_feature (409)..(409): n is a, c, g, or t
  misc_feature (412)..(412): n is a, c, g, or t
  misc_feature (429)..(429): n is a, c, g, or t
  misc_feature (460)..(460): n is a, c, g, or t
  misc_feature (465)..(466): n is a, c, g, or t
  misc_feature (474)..(474): n is a, c, g, or t
  misc_feature (477)..(477): n is a, c, g, or t
  misc_feature (485)..(486): n is a, c, g, or t
  misc_feature (489)..(489): n is a, c, g, or t
  misc_feature (506)..(506): n is a, c, g, or t
  misc_feature (516)..(517): n is a, c, g, or t
  misc_feature (519)..(519): n is a, c, g, or t
  misc_feature (524)..(524): n is a, c, g, or t
  misc_feature (543)..(543): n is a, c, g, or t
  misc_feature (550)..(553): n is a, c, g, or t
  misc_feature (563)..(563): n is a, c, g, or t
  misc_feature (572)..(573): n is a, c, g, or t
  misc_feature (583)..(583): n is a, c, g, or t
  misc_feature (589)..(589): n is a, c, g, or t
  misc_feature (612)..(612): n is a, c, g, or t
  misc_feature (614)..(614): n is a, c, g, or t
  misc_feature (628)..(628): n is a, c, g, or t
  misc_feature (632)..(632): n is a, c, g, or t
  misc_feature (638)..(638): n is a, c, g, or t
  misc_feature (646)..(646): n is a, c, g, or t
  misc_feature (673)..(673): n is a, c, g, or t
  misc_feature (686)..(686): n is a, c, g, or t
ttttacaaaattaaaaacataaaccacgggggtacaagcatctnaaataccagcttataatacttgacattttctaatcatttcaaattgagtctcccataagcattttataaatgcaagaccattcattcacttgagtcagtcaccagtctttnctttccaccaatccaaagtgggtttntggtttttgaaattgtccatactnttgttattcaaaaaaatacaatatgcttttgaaatgactagctttaaagaaaaaagttctgngcttcctaccccagtggngggttattnctcctnaacaactnatntacccaaattatctttcngccnnnnntaaggngaccncgcgaccntntntaanacncnggcngnggacnnanaggnngnntgngcnctcaccgggcangtntgcgggtgggaaaaggngggaaagaagggggtggggaggggggggagnccagnngcccatcngtncttcccanntcngaaaatacttcagacangtcccaaaanncngttcngacgagtggccttctgggnctttttnnnngttttttttnttcaaaaanngaaaatgagntaagangaagaagaggggaaagaaaaaangnagggaaaaaggggnaaangtaggnaagaggangaagggggaaaaagaaggagggggganaaggaggaggggnggaagagaaggaaagggggggagggaagggaagagagggagaaagggagaaag

SEQ ID NO: 496275 - DNA, 154 bp, Homo sapiens
  misc_feature (60)..(60): n is a, c, g, or t
ataattatcaagttaatatggatcatcattggaagcgggtcgacttgccaacgaagccgntgtgcttgttggtggctgaattaaagcaggctccgagcgcagttgcattgcatcgctaagtgacagaatatataaaagccatgaaacttttcag

SEQ ID NO: 496276 - DNA, 442 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttattcatggcactacgtacaacactggcacaacgtacacacggg

SEQ ID NO: 496277 - DNA, 466 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496278 - DNA, 1049 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaaggaagggaggggaacacaaaaaaaaaaacaccggaggggaaaccaaggcccagacggacacacagtaaaatcaacaaacgaggggcacaaaagagaggaaggaaataaatgagcgacgccagggcgacgccgacgcggctctactagacgaagcggccggaggacggaggcagaaaagacgtgaagctggatgggaaatcgagagagcgcagcgccacctatccactgatgagagaggggaggaccaacaaaataggcgcgcggcgaagcgcttcacacactagcagcgagagtgctggaacgccaaaacggtggagggtaaacgggcgagaacagcctctttcttgttgtctgtctcgtgttaagcaaggggaggaacaaacacacagacggacgtgggtgaaagatacgaggagcgagtgcgtgagtcggtatgggataggggacgattaagccgaaagattgaacgagacaaggacatcgcagcgagtgagcgcgagacagacaaacct

SEQ ID NO: 496279 - DNA, 508 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaagtcgagcggccgcgaatttagtagtagtagtcgtcgcggccg

SEQ ID NO: 496280 - DNA, 190 bp, Homo sapiens
tggatccatgaccatccttttccttatccagtccaccactgatgtgtacctaggttgattccatgcacttgtctgctcattgcagcattattcacaaagacatggaatcaacctaggtacacatcagtggtggactggataagaaaatgtggtatatatacacatatggaatactatgctgcataaaaaa

SEQ ID NO: 496281 - DNA, 489 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttccggcgcagggtgccggccccatgataattcccttttcccgctgttttaccttaagcatttaaacttctggtctttataaattaaa

SEQ ID NO: 496282 - DNA, 150 bp, Homo sapiens
gaggtttcaccgcttattcgctaagcacgattcccattgttgctggctttagcatgcatactaagctgcggacagtgggaactctccttcactgccattcatgcgctcaacttacttctatatcacgcactctggctacctttacgagat

SEQ ID NO: 496283 - DNA, 412 bp, Homo sapiens
agccgggatcattcccatgagcgcatgtccttcaaatacctcccagaagtttctttgcatcgtctgtgtcctcaggggtaagtcaagcagctgggttatcacacaatgcaagcgcttggtgcccttaaggttagaggtccagatctcaaaaccagtagattatgcagttcattgatatcgcgatagaacccgatgagtgtggcttggaaagttgtgaatgaatgaacaccattggtatatcggtgctcagttatagcatgtcctggtcctttattcggtaaagcctcaggcggcggcacaggtcgtccatgtccgggaacaagagcgcctgcatgttcgacagatcagagatcaacagagcgcgtgtgtccttcaacaaagaagtcagatgtgcccagagtcacggtgtgct

SEQ ID NO: 496284 - DNA, 1142 bp, Homo sapiens
  misc_feature (679)..(679): n is a, c, g, or t
  misc_feature (691)..(691): n is a, c, g, or t
  misc_feature (702)..(702): n is a, c, g, or t
  misc_feature (712)..(712): n is a, c, g, or t
  misc_feature (717)..(719): n is a, c, g, or t
  misc_feature (721)..(721): n is a, c, g, or t
  misc_feature (730)..(730): n is a, c, g, or t
  misc_feature (735)..(735): n is a, c, g, or t
  misc_feature (749)..(750): n is a, c, g, or t
  misc_feature (756)..(757): n is a, c, g, or t
  misc_feature (768)..(770): n is a, c, g, or t
  misc_feature (791)..(792): n is a, c, g, or t
  misc_feature (794)..(794): n is a, c, g, or t
  misc_feature (798)..(798): n is a, c, g, or t
  misc_feature (809)..(809): n is a, c, g, or t
  misc_feature (816)..(816): n is a, c, g, or t
  misc_feature (820)..(822): n is a, c, g, or t
  misc_feature (824)..(826): n is a, c, g, or t
  misc_feature (831)..(831): n is a, c, g, or t
  misc_feature (842)..(843): n is a, c, g, or t
  misc_feature (848)..(848): n is a, c, g, or t
  misc_feature (852)..(852): n is a, c, g, or t
  misc_feature (856)..(856): n is a, c, g, or t
  misc_feature (860)..(860): n is a, c, g, or t
  misc_feature (879)..(879): n is a, c, g, or t
  misc_feature (887)..(887): n is a, c, g, or t
  misc_feature (895)..(895): n is a, c, g, or t
  misc_feature (897)..(898): n is a, c, g, or t
  misc_feature (900)..(901): n is a, c, g, or t
  misc_feature (910)..(910): n is a, c, g, or t
  misc_feature (912)..(912): n is a, c, g, or t
  misc_feature (917)..(918): n is a, c, g, or t
  misc_feature (920)..(920): n is a, c, g, or t
  misc_feature (922)..(922): n is a, c, g, or t
  misc_feature (924)..(924): n is a, c, g, or t
  misc_feature (932)..(932): n is a, c, g, or t
  misc_feature (934)..(934): n is a, c, g, or t
  misc_feature (937)..(937): n is a, c, g, or t
  misc_feature (949)..(949): n is a, c, g, or t
  misc_feature (954)..(954): n is a, c, g, or t
  misc_feature (973)..(973): n is a, c, g, or t
  misc_feature (975)..(976): n is a, c, g, or t
  misc_feature (980)..(981): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttttggccccccttgccccaacccatttaaaactcaaaaaattttttccaggggccccaaattggggcccattgggcnaattcccctaanggggggggttnaaaaataaangggcnnngntttaaaaanggggnaatgggaaaaaccnnggggtnnccaaattaaannncttggaaaaaatccccttttnncnagtngggaaaaaacnaaaaagncccnnncnnntcccntttccaaaaanntgccnaccntaangggnaaaggaaaattgtacggtnaaattttngtaaaaancnngnnaaaattttngnaaaannancntntttttaancnaangggcaaaagggnaaaanccttttaaaaaaaaaaaananncccnnaaagggtagaggttttcccaatgtgaaaaaagaggccccttttaaaaaagggggccccaacctcaagggcgaaaaaaccctttttataggggaggccccctattggaaaccattcccctaaacaaagtttgtggggtccaagggcccacctttggcccccg

SEQ ID NO: 496285 - DNA, 809 bp, Homo sapiens
  misc_feature (3)..(3): n is a, c, g, or t
  misc_feature (64)..(64): n is a, c, g, or t
  misc_feature (70)..(70): n is a, c, g, or t
  misc_feature (77)..(77): n is a, c, g, or t
  misc_feature (142)..(142): n is a, c, g, or t
  misc_feature (154)..(154): n is a, c, g, or t
aanaatgtgatgttggagggggatggggatgagggtgtgttgatttgtggaggaaaggagaaanctagtntccgaangaacctggtccctggtggaatcagtttatggagagaagagagtctcgatttcggaaggagatganaaaattgagtancggaggcctggaaccccttccgctccaagctagccagcatgcaatcctgggtggtgtggaccagatccacatcaaaaccgggggctaaggttctcttacctcggggctgcctcgggcacccacggtctcccatgtctctgacatcgttggtccggatggtctagtctatgcagtcgagttctcccacccgctctggccgtgacctcattaacttggccaagaagaggaccaacatcattcctgtgatcgaggatgctcgacaccccacacaaattccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggcccccccccaaggtgaagaactgaagttcagcgctgtcaggattgcgagagatgtgtgttgatactgttgcacgtgtgtttttctattaaaagactcatccgtcca

SEQ ID NO: 496286 - DNA, 1108 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaagaaaaaaaaaaaagaaaaaaaaaaaaaaaaaaaaaaaaaaaaaaaaaaaaaaggcccctttttgccccgggggggtgtgcccccctttcggggggcccccccgggggggccccccggggcccccttttcccggcccttccccggggggcgcctttttcgcccccggtttcccgggccccctgaggggccccccctttgccttttttttgggggcccctttttgggggggggttttccccccgggggtgggggggggttcccccttttttttctcttcccgggggggttttggcccccccggggcccctccccccgctggtcccgggccccgtgcaccccaggggccgccccgggcttgccccctcttggggggcccgagctcggccccggccttgggggggcccccttttcgccccggtgggggacttgggcccccgttttccccccttgccccttgacacccccctgggtttttccttggggcccccgctggagggttcccccccccccacccttggggggcctcttggaggggccccccgttttggtgcgccggggctctctgtttttcggcccggggtgaccgcggccgctccgcctgct

SEQ ID NO: 496287 - DNA, 167 bp, Homo sapiens
ttaatgtgctgacagacgatgccactacaggacctgtctggacctggtgtctgagatggagataatagaagatgatcgggaaacaaaaacatcatcaacctgctgtgcgcctgcacgcagggcggccccttatacgtgctggtggagtacgcggccaaggttaacct

SEQ ID NO: 496288 - DNA, 687 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaagaaaaaaaaaaaaaaaaaaaaaaaaaaaaaacatatacaaacaaacataatatcaaacttaatttgccaatcccttcctcccaacctcgggcggtcccaacttaatccgccttaaactcaaccccctttcgattgcagtcctcatgccgttaggccccaatcggtcgtcctcccaactccca

SEQ ID NO: 496289 - DNA, 565 bp, Homo sapiens
gttgtaccgatcacggtatcagccccagcagcagaccggctcgcccgagcggaccgcaggccagcgcgccagcccttggcagccccggagcagtcgggctccgggaggaaactccttgggagcgccctgtaccggggtgccctctgacgctctgcagatgtctttctttctgcctgggaggaggaggaggaggcggaagaggaggaggaggaggaggaggaggaggaggaagaggaggagagagagagagaggacgtctgcaaacaccagatagggaggaacggagccagcggacagcagacagacacgaacgacgacacagacacgaccaggacaaagaatgaccgcagcgaagacggacgagacgacgaggaagacggaagagagagaagaacagaagtagagagggaaaccaccagaaagaagaatcagacaaagcacaagaaaacagacaaagccgacaccacaaaaaagcacaacaaatacgaacaaaaggagatgaaaagccgagaccagcaagataacccagacagatacgccacactaaaataaccccaacagcaac

SEQ ID NO: 496290 - DNA, 832 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattattgcaccctaatacccaaactccttataaaaaatacaaaatttttttaaatcccccatatcaacacaatatttgcccaaattcgcctataaaaggattcataaaaaaaaactgggctcaattaaaaaacgtagggtgaggaaaaaacacggggttccccaaaaagggcctgtaaaaaagacctttttcccagtggaatatgtccccccc

SEQ ID NO: 496291 - DNA, 494 bp, Homo sapiens
  misc_feature (467)..(473): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaannnnnnngtcgacgcggccgcgaattta

SEQ ID NO: 496292 - DNA, 526 bp, Homo sapiens
catttgtttttgctgttctaaaattccttagttgctggctttgaccttttatgttgctgagttttacacatctattttctcaactgccatatcctagggggcttggagtacccataatacagtgagcccaccttccggtccccagacatttcagaaggtcgggaaatttttaaacccaggcagcttcctgcagtgccatttggagcatcaaagtggtaaataaaattgcatttacattcatatatcatttctgtctgatttgttttgccctactggatgttaagaattaaatctttcttttctagattgagcttccaagaaacactttttaaatctaaaaattttaatgtaaagaaataatatgcttgcatttaaaaatcaagtatacatttttaatacctctttttatggttaattccttttgttgtgattactactgtttttatgagggagaagtccttgacatgtagaccaaaaggtaattaaggaccttttcattcatgatatcataaaaccttgttgctta

SEQ ID NO: 496293 - DNA, 882 bp, Homo sapiens
  misc_feature (388)..(388): n is a, c, g, or t
  misc_feature (568)..(568): n is a, c, g, or t
  misc_feature (753)..(753): n is a, c, g, or t
tggaccccaaaattaccctttatgggttttccaaaaaaaatggggtgaaaaaaattgggatttaaataccctttttttccattttgcaacagataaatgttccccaaaaaacccctttcaagattgacactctccaaagccttctgtggggcacgagagtgggcccccaccgagcaaaattacaaaaattccaccgctctatgactctccggggttgcggatggagagaacacgcgttaggccctcccgagcagataataatgagaaggcacgcaagattattgacattaacactccctttggaggggcttaaacatttcttcacaggaggaagattcgccacattctataggggagaacagactctcctcggagaacacactcctcngggagaacccccctccctgtgcggtctccccataggagatggatagagggtgcatctcccgggagacagtttgctgttgagaactatgaccagagctctcccgggggggttcccccaaggcacggaaaagcgcagaaagcacccacaggccatctctctgtgggagatgtgtgcgccgcnagcgagggggccgccacgtgtgttggcgcacgaaagatagcgcggcaagggcgcgcgaggacccaaacgccccgcgtggtgccacacgaagaagcctagttctcccacaaagagcgcgcggagaggtacaccacaggggggtatagccgcctgatagagggaggttccccccggggtccataganagggccccggggtaggggtcccccgctgaggaagcaaggagcctcttattggccccccgcgcaagggtgattgcccctgggggaacacctacacgaaccggggggccctcccaagttattaccccggca

SEQ ID NO: 496294 - DNA, 153 bp, Homo sapiens
tcaggattagctgcagacttcgcgtgagtgtacaggtcttagcggctcgtctggagtcttcgtactctggtgcgttgtgtctcactggttacaggagtgaactgcagaacttcacagtgagtgtacagctcataagctcggtgtggacccgtg

SEQ ID NO: 496295 - DNA, 152 bp, Homo sapiens
  misc_feature (34)..(34): n is a, c, g, or t
  misc_feature (40)..(40): n is a, c, g, or t
  misc_feature (45)..(45): n is a, c, g, or t
  misc_feature (47)..(47): n is a, c, g, or t
  misc_feature (51)..(51): n is a, c, g, or t
  misc_feature (87)..(87): n is a, c, g, or t
  misc_feature (94)..(94): n is a, c, g, or t
  misc_feature (109)..(109): n is a, c, g, or t
gatctcgctctgtacgacaatgaaggtctgtatntttgcncagtnanggtnagctaagctaaattgaatttgatggtcatagccttnacggcantgccatattcagatngtttagaagtgtcgagttcgttaacaaaaatgttccacctaga

SEQ ID NO: 496296 - DNA, 1525 bp, Homo sapiens
gttacaaacactcctgacatagttctgcctttcacactcaaggagaagacgctgggtactatgcgtgataattaggataaggactagaaaagatattacgtgcaagaaatgtgcttagcatagagcgtagtgtaagtggtgacttcaatggggagtatcatatattcttataatacgagcgtgataggaaacactgagtgtgagaactagtggctattgatggtcttggtgatcagaactgttattttactgatgggctattagtgagctcttagaactgttgaacatattaaaggcgttttagtaggaaacctaagtactaggtaagtaatgcaagaatgcagagatgccatattaggaaatactcccaagaatgcatgctcaattggcttctggatattgttgtatcgaaggaatgattaagtctctatgaaacgcgtaattaggacgaaattctgctccagtccctgtaataccggactgatttcaaataacatacgagctagttaatgacgtaggggttaactgtgccattctttagcagtacaacaggacttcaccgaaataagcacttaagggaagtgtgcctatgcatatttccaaataacctttaatttcacttcaccaatagtgaatgatcccgcacagttaatcgcaatgtgcattatgggcacagttaaaaattcgaatgaataggagaaagatcttgggtactatggcacattaatgttagtctaggggaaaacttaaaggaacatagggttcagctaatgtggcgttgtttgaaaaggaagtttcgggtaagagaggaagacggtatatagagagtcccattgcggttggatcagtccataggtatgtcgaagttgagaagcggttaaaagggatggcataactggattaggttgtgtaagatattggtataatacacccagtgtgagagtaggccattgggataaggggtgacggacgttcacacgttccaactactcatattggaccccggtgagtgtaaacaacagagacgtgtctataggccaagtttatgttggaccccggcttggacaaacgtccctacgttcggataatacacacagatgcgggatcacgtccaaaattggtgcaagacaaagacaacagtgagcgcactttaagaacaaagttatatcaggcaaagtttccaaaggtccgagaacgcaaatttacccacagataacaggtgtaacgacagagaggccccccaggtggttgtggacataacagagcctgtttccaaaactttttatcacccggggatggggccacagatttgtcccccctagctgaaggggcgcatatcacgtgtgtaactgttttcgcggaccttccaattctgattcatggcaaaatggctacacacggcatcaggtgcggcatatactacggggccgggaaccaatcgtcgctgtgccgcgttaatgaaaggggtgatggccagaatatgggatgacacattgtgctagtatatgctctccatccaataaaa

SEQ ID NO: 496297 - DNA, 949 bp, Homo sapiens
tttttttgacgaagacgaaaaaacataaataaaggggaagacaaaagaaaaagtagcacttagcattcttctcgctgcctgagtacgccgttcccttctcggtattctctacgcactttctctgaccccccccttttgttattccccgcccaatcaccatggttatcgcctgccgccaatagctcttactaacagcgtggtgcccgtgtaacaaacctgtcttcagtaggacaaatcggttctgtgaagcctcaaatcttccgttctgtcgtcattcatagcgcctcaccattcgtcgtccgtagacttgtgccccacgggcctggccatactgttgaaattccggcccgttttcaaaggtctctcatgcaaccaaagttgtcaccgtgtccacattggggcctcccccaagtgcgggccctaagcgtaatacaaaaatcccgggggcacacaaaacacgtgggcgccacgacacatgttttcaccacccgcgggggtgacacaacgatttcttgcacacacttgggcgagacaacgggattcttcgtccccctgtctgggaacctccctgacccgagggtgagaattttttctaagggagcccctgttctctaacccaccgaggtggcctgctcattgccatgatgtttgtgccacgcaacttgcttgtttgggagactatctcccgtcggcgttaatatattatgaggaaaacaaagcggggcgccatccccaccgttgtacccctagactgggtaccctcccgcgtctttttctggtgggctcccagagtcgtggagacctgcatccacctgtttgtctggcgccgccaatccctcgccggaggtaattttgcgtgtctccccggctgccccgccggtctggggaagactgctatattggccccggacgttcaaaaaatttcccggggggcagccaaaacaaaaca

SEQ ID NO: 496298 - DNA, 99 bp, Homo sapiens
tgcagcgtcttcaaagacccgtgatcaccacgtgtgggcacacgttctgtaggagatgcgccttgaagtcagagaagtgtcccgtggacaacgtcaaac

SEQ ID NO: 496299 - DNA, 492 bp, Homo sapiens
taggaagtgaacactgagatccctgcgaattggacgatgcccggcgatcggatggcactactcgaaactctgcttcgatgggttcgctcttcggaggtgccagcggtggaggaacctctcagtcgagcgtaaagccagttggacgccttggctgatcctcttaagacgccattgcagcgcggaatcgcagcactgcgaaataccctaggtcaggatgcagccgatgcattgcttcagcccgcacccatgcgggctgacgaagcggcgtgctttcacttccccttgcccatcgattacacggggcaggagcggcgactgcgtatgggtttcccctccaagtttccccgtgggctcttgcggctgaacgtcgaaccttctccatggctggttcggccgcatgccactacgtcggggcttagccttcatggctttcagggaacgccccatatatgggctctccggaggccgtggaacaggacagccttgctcggt

SEQ ID NO: 496300 - DNA, 101 bp, Homo sapiens
atgcccaactaatattgggaatatcatataagtggattccagaggggtgacagcaaaacgtggtgaccatccatgttgcaggaaaacaagcttacacacgc

SEQ ID NO: 496301 - DNA, 303 bp, Homo sapiens
atcttagggagctacagatagcgttatacttatctggtagggctgccataatagaatactgggtggattaaacaacagaaattaattttctcccagttctgcagcctggaagcccaagagatcaaggtattaacaggtttagttactcctggtacctctctccttggcttgtagatggccgtcttctcattgtgtcctcacacggcctttcctttgtgttcacgcatctctggtttctctttctctccttcttcttccttcttccttctttctcctttctccctaagaccctactccctaaga

SEQ ID NO: 496302 - DNA, 369 bp, Homo sapiens
  misc_feature (2)..(2): n is a, c, g, or t
  misc_feature (5)..(5): n is a, c, g, or t
gncgnagtgcaatggctggagcaatccttctgctcagcttcctgagtggctgggactacaggcatgaaccactacattcggctagttttaattttttttgtagagacagggtcttgttctattgtccaagctggtcttgaattcctgacctcaagcaatcctcctgcctctgcctcccaaagcactgggattattacaggtatgagccattgcactccggccaatctttgtatttttagtagagatggggtttcgccatgttggccaggctggtctcaaactcctaacttcaagtgatccacccccctcggtcttccaaagtgatgggattacggacgtgagccaccgtgcccagccattgcactccgg

SEQ ID NO: 496303 - DNA, 300 bp, Homo sapiens
tggactgtcccatggcttgtgagcaccggagcgcttggttgcctaccaaggacgtgcaattgcctaaaaacagaaagaacaacgccatggacccaatgattcaagaaaggaatttccaaaggataatatttttttaataaatgcggctgcaacctcctgtgcatttaaataaatcggccaaatttatgctgcttaggtcatcatcaagggtgttacttgagctgtgtgcccagagatcatgcatttagatgtatattcttgccagaaaacacaaggttataataaaactaagatcttcca

SEQ ID NO: 496304 - DNA, 734 bp, Homo sapiens
ccacagcgtcgcccacgcgtcagcagccactatctcaagcgtctctgccggtcccctggcgctgagggctgcaccgcctgcgtcaccaggtagccctggaaatggtcgtcatagaaatacaggtgcacgctggacggcaagcccctggcgctcaaagctaaggtgccagcagggcagaacagggagactgccatacagtcacaacctgtatttggcctggagtcccagggatggtggctctggggagatcccatccaccaggcacttccatttccccagatctcaccacccacagcaccatgcatgcctggcctctagccgtcctttatatcggtattctgcattctatttccctgctattcaagaactgagggccatatgaattagtggagcacggggaccgtacacttctcatgcgcttaggcccttccacaccataggggcgacacaacaagcccacaacggcgcccttgcgtgctaattgctccagcacacggtggagatctcaaccctgccacgaagtgtgcgagttgccccacttgcgcgggcgtgcaagacacgtggcgcatgggccacatcggatggcaaggggccttgcagggccgctggactgaaacgggcctcgctggttcaaggccacgactgcacgcaactgcagaattcaacttggacgcccacacatgcggtcgccctattcaacccaggcgtctgataccgttgtaacatcccaagta

SEQ ID NO: 496305 - DNA, 389 bp, Homo sapiens
cgtgtctatagacgggcgtagctaggactacaatggcgcactttaactctagcctcatggaccaagaagcatgaagactaagatcctaaatgacctataactctagtgtgtgctcattgaaaatagacagaacaaagattactgattgtaagtccactctaaggaaagtcgcctgaaaacaattggccacgaaaagccacaccaaaaccgctcattttaccagtttcatgaaataggctaatatctacaactacaatacccacgctctcatatagattcacagctatcataagtctacccaattgctcacatggaagctcacatatcaacacagttcttaagaacatcgtgctgtcccgacccgaggatcataacgcactctctgtgct

SEQ ID NO: 496306 - DNA, 262 bp, Homo sapiens
  misc_feature (43)..(44): n is a, c, g, or t
  misc_feature (51)..(51): n is a, c, g, or t
  misc_feature (103)..(103): n is a, c, g, or t
taatagttctatgtgaaattcggaaagttttatcagtatattnntcttttngtttgttggtttgttttagacagattctcactctgtcacccagactggagtncggtggcttaatctttgctcgctgcggcctctacctcccggattcaggctgaggcaggagaatcgcttgaaccagggaaatggagtttgcagtgagctgagatcatgccactggactccagcctgggcgacagagcaagactctgtctcaaaaaaaaca

SEQ ID NO: 496307 - DNA, 322 bp, Homo sapiens
tggggagctcgtcatccactgtaaaagtttcatgatggccgagggtcactggaatgctcgagccccagtgcatggcccagcttcgtgcacatgcgagcaggcagatgtcatttccattcagatcctcattcctgacagtccaaggctcgaaagagtcaaagtgggtagtctcctccaatgttggggcctgagaagtaggcatgggccaggaagccgacctcaccatcgaagtggcgtgctgtcgccatggaagccctcggaaaaagaagatcatgatgtcggcctgcttctcatggccctcaggaatttaggcttagggcac

SEQ ID NO: 496308 - DNA, 456 bp, Homo sapiens
  misc_feature (188)..(188): n is a, c, g, or t
acaataataataatttaaacaataatattaataataatttaaataataataataataatgaaaatgaaaataaatttaaagaagatggtgatgatgaaattttacaaaatttaaatagattaaattatatattattaagggattttgaatttggaccaaatgatattacaactaaacttcgataatcncatataaatctatttgatagattattacttatagaggataatttagaggcattggataagatattaaagaatttcactcaaaaaggttgtacattatcaagggatttggttggtgatcgtaatctattggttttagtggcaattctagattcaacttcaaaagagaaactatcattattgaacaagtattggccattacctgaaaaaacgaaaaagtttgctattccattaattttctttgcaatatctgaagaatgtttaaaaatgt

SEQ ID NO: 496309 - DNA, 111 bp, Homo sapiens
gcagacccccagtgaacttctacgcagaaggtctgcagcctcctctgcagatccctgaatactacttgctgtataacagagagagtaggtgtctgtttgagggcggaatag

SEQ ID NO: 496310 - DNA, 238 bp, Homo sapiens
ttaggcacagaaagaatcatttactatgcatgtttgcaacccttttcccctgccgtgacccccctccagcaagctttccaacaaagaaaccccaaccccagccccgggacactccttctagcctgtggtctcaagagggaggcccagcaacagggagttggtttctgtaggccctagactttggacaggacgctgaacggcttgtcccctccttgtatcttccatcctcccacctaaa

SEQ ID NO: 496311 - DNA, 445 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacacggggatccttagagtgaccagacgt

SEQ ID NO: 496312 - DNA, 466 bp, Homo sapiens; identical to SEQ ID NO: 496243
  misc_feature (448)..(450): n is a, c, g, or t
  misc_feature (452)..(452): n is a, c, g, or t
  misc_feature (455)..(455): n is a, c, g, or t
  misc_feature (458)..(459): n is a, c, g, or t
  misc_feature (461)..(461): n is a, c, g, or t

SEQ ID NO: 496313 - DNA, 546 bp, Homo sapiens
  misc_feature (526)..(526): n is a, c, g, or t
  misc_feature (529)..(529): n is a, c, g, or t
  misc_feature (531)..(531): n is a, c, g, or t
actagttctagatcgcgagcggcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaagaaaaaaaaaaaagaaaaaaaaaaaaaaaaaaaaaaaaaaaaaaaaaaaaaaacnaananaaaaaaaaaaaaaat

SEQ ID NO: 496314 - DNA, 378 bp, Homo sapiens
actagtaatattactagtgaattcactagtaatattactagtgaattcactagtaatgcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496315 - DNA, 730 bp, Homo sapiens
ctggcggtaccatcggcgacgcctggccgacgcgttgggctcacggatgcctttgcccaggtctcccgtcggggagaacgcgtgcccacttcccacggagatgatggcgaacctgggggttgcctgatggccagaccccctgggggaacacatgggagaggtttcgtttgtgggagcaatctcgcaagaacgtgtggccgatgagtgggaaccctatgagtcgtgggacttcttgccccggcccagccacacgacaggcacagagggcgaggggagagtattttgacaccccggttccgcacggcacgagggctccgaccatgaggctgggaaccccggccgaggggacactgctgtcctcctgagacccgcccccaccccgccttctctgtcccctccccgcaagctctgcacgcatggttgctgcatctgctgtcaccagcccttcctttttgctcttgaaatgccctcccagcccggctttggctgctccacggccccttggagaccgctcctgtccaggcccccggtgtaaacactgaggctggttcccgaggcccggcctctgtcctgatcctcttgggtcttctcagaggatatcggcactacgggccacggttcctggatcaagccgcgtatcccagcgctttgggaggcccaggtgggcagatcaattgagggcaagagttcaagattacctgggcaacatagcgagacctcgtctctacca

SEQ ID NO: 496316 - DNA, 499 bp, Homo sapiens
  misc_feature (406)..(406): n is a, c, g, or t
  misc_feature (411)..(411): n is a, c, g, or t
  misc_feature (437)..(437): n is a, c, g, or t
  misc_feature (463)..(464): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgccatgttgggtccctctgccccctggggacctggtgaacattcctgggaacctaattttcnggttnttttttattctggttgggcccgaaantggttaatcaacccaattattaaatnnaaaatcaaccttcctttccccggcttggtttttta

SEQ ID NO: 496317 - DNA, 403 bp, Homo sapiens
tactagaggatccgagtagggctaccttttcatacaggtataaatgagttatagaatatacatacttctcccattcagagtgttgtttaggtaagagtacattggtgtttacacggtaccttttgggttcattgcatgtttattccttggctcttctgaactggttggttcctttcggctctttttagaacgtttaacttttggcctcctcttatgtttcctccttctgcttctctcatgttcaagttcactttctgaagatgattctgaagaagaggaggaatcggaagaggaatccgagccttctgaatgagttggtttcttccttttttttctcaaaaacatcttttattgattttgtggcaagtactccacagtcaataactcgcacatctgcatatgg

SEQ ID NO: 496318 - DNA, 308 bp, Homo sapiens
ctagacgatccccggtacgcttgacatagtcccaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496319 - DNA, 814 bp, Homo sapiens
ggaggcggcggggggcgcacagagtggcgagtagtggaaacgtggcttctgaggggagcccaatgatgaccggttctatacgaggttcaagggctgatagccagtccactccgagttgatggcaatctgccttcgcgtgagacgttcagccccaggcatcctcccagttcctggttgtctcctcctgggactgcgtccgtgtgtctctacgatgtgccggtgacttccatgcggctctagtgccagctcaccgggcgccgtcctggagtgcgccttctacgtatccaaggcatgtctggagtggagtgactcgatcatcaattgaaaatgcttgatttgaacactgatcaggaaggatcttgttgtggacccatgatgtcctcctatcagatgtgtcgaatactggtccagaatgtgaatgtgagtggtcactggtaagtgggatcagacagtgtcaagctgtgggatcccaggaactccttgtaactggctgggagcttctctcagcgctgagaacggtatataccctctcagtgtctgcagaccggctgctgtgtggggaacagcggtccgccgagtgtttggtggtgggacttgcgggcaacatggttcccgtgcgggttccgctggtcgttccagctgatatagctggatcggtgattgcgagcgttgccaaagaagcgggttaatgtttaagctctattgaagggcgagtgggagtgagtctttgggccccgcctgagtgtatgacgagggaggttgcttccatgtcccgccagacacagatttttggcgtttcccgcagcgttcttta

SEQ ID NO: 496320 - DNA, 335 bp, Homo sapiens
  misc_feature (16)..(17): n is a, c, g, or t
aattcttcagctaaannagcggaagaggtgatttattatatggttgttacactcggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496321 - DNA, 293 bp, Homo sapiens
atggggtagaatgctgatgttttaatacatgtactcaatgtgtaatgatcaaatcagggtaatttgcataatgatttttctgtagggagagaattcaaaatctactcttctggctattttcaaatatataatatgttattgttaactatactcatcctactatgcaataggacaccagaacttattctgggttctacatccgttaaggcaaccaaggattggatatattggaaacaaatttgcgtctgtacctgaacatgtccagctttttcttgtcctattcctacacattt

SEQ ID NO: 496322 - DNA, 671 bp, Homo sapiens
  misc_feature (1)..(1): n is a, c, g, or t
  misc_feature (121)..(122): n is a, c, g, or t
  misc_feature (127)..(127): n is a, c, g, or t
  misc_feature (136)..(137): n is a, c, g, or t
  misc_feature (160)..(160): n is a, c, g, or t
  misc_feature (169)..(170): n is a, c, g, or t
  misc_feature (187)..(187): n is a, c, g, or t
  misc_feature (215)..(215): n is a, c, g, or t
  misc_feature (225)..(225): n is a, c, g, or t
  misc_feature (230)..(230): n is a, c, g, or t
  misc_feature (235)..(235): n is a, c, g, or t
  misc_feature (246)..(246): n is a, c, g, or t
  misc_feature (259)..(259): n is a, c, g, or t
  misc_feature (319)..(319): n is a, c, g, or t
  misc_feature (335)..(336): n is a, c, g, or t
  misc_feature (340)..(340): n is a, c, g, or t
  misc_feature (369)..(369): n is a, c, g, or t
  misc_feature (396)..(397): n is a, c, g, or t
  misc_feature (446)..(446): n is a, c, g, or t
  misc_feature (451)..(451): n is a, c, g, or t
  misc_feature (471)..(471): n is a, c, g, or t
  misc_feature (490)..(490): n is a, c, g, or t
  misc_feature (511)..(511): n is a, c, g, or t
  misc_feature (518)..(518): n is a, c, g, or t
  misc_feature (531)..(531): n is a, c, g, or t
  misc_feature (536)..(536): n is a, c, g, or t
  misc_feature (595)..(595): n is a, c, g, or t
  misc_feature (610)..(610): n is a, c, g, or t
  misc_feature (668)..(668): n is a, c, g, or t
ntgaagacgccacccctggcatggggtccgtggcccttgctgtcacatctcgccttggttgatctcgatgggaggttgatctctctcagggagaactgtggcggtggggatttagcctttnnagggnccttcaggnngtaggggtggggggttggggagngtggtaganncagaaagttctgggggngtgagggataggtgtactaatatttggnggcagtgggngatgntggcnccaaggttgangtatcgagttagngcagaagcgatagtgtgcgacctagtatgctggtttttcctttgggtttaggtgtaagtnaactattattattggnntggngaactggagagaaagggttgtcactgtgnagcagcgtacacagcgtgcaggcagcnnagatggtacacattcccagaaagactacaatagcgtagacactgtggcntgtanaccccatgcacacacacacnaatcacagcatacctgtanggcatgtgtgtaaacacccanatgcacncacacccacatgnctggnagtacacagaactgtatgcatccatttgtgccaggctggggccttgagtgataggaaangggtctgtgatgggnagatagtgtggttggagacacggatttcttcctgaacaaagtccctcccctacatggngga

SEQ ID NO: 496323 - DNA, 856 bp, Homo sapiens
gcggccgcctactactactaaattcgcggccgcgtcgaccgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaacaaaaaaaaaaaaaaaaaaaaaaaagggggggcgcggcataaaaagacccaaaagggggcaaagtcagagggagaccaaaggttccggagaaaaggggcgcccaataaggggagccgcatattaaaaccaaaggaccgggggcgcagaatataaacaaaggcgagaaggggacaacaaggcgaacacctgggacacatggggaagggcaccatcaacaaaggagggaggggacaaaaaaatgggagaacacaatcgccccagaggaatctatcaaaggcccccaccggggccacatatatccaacagtttctacgacgccgcgtcaatcggtgtggataaacacacagcgggggaaagaacacgcgagagacgtcacagcactttcggcccaacaggagaaaagacaatctcgcagacatttcttcacccggggaggtatcacagctaa

SEQ ID NO: 496324 - DNA, 606 bp, Homo sapiens
ggaagcggccgcgactgtccttttgtgtgcgtacaagcagccggcgtggtgccgccgagtgaggggacgcggcgcggtggggcggcgcggcccgaggaggcggcggaggaggggccgcccgcgtgcccccgtgctcactcctggcactccgtggcctgctcggtgcccccatgcctgccctgacgcgcgctgcctggagccccagtgtgaccatgctgccatgtccagccaggtggtgggcattgagcctctctacatcaaggcatgatgcctggccagccctgacagtccaaatgggttcctcggagacagagaccgagacctcctgtggccctggcccctggtccagctcccactcgctgcctcccaggccacaaggaagaggaggatgggcgagggggctgggcctggtgagcaggggcgtgtggaaaagcatggatgcaattaggcataagttgcacgcaataattctcctctgaccatggctcatagctcggtgacgattggcttccagcgttaaccacatacatactcgatgagcactaccacagctgacggccatgtccacgccattcttcaagaggcccatccatgcagacaagagac

SEQ ID NO: 496325 - DNA, 1071 bp, Homo sapiens
  misc_feature (34)..(34): n is a, c, g, or t
  misc_feature (49)..(49): n is a, c, g, or t
  misc_feature (608)..(608): n is a, c, g, or t
  misc_feature (620)..(620): n is a, c, g, or t
  misc_feature (631)..(631): n is a, c, g, or t
  misc_feature (641)..(641): n is a, c, g, or t
  misc_feature (646)..(648): n is a, c, g, or t
  misc_feature (650)..(650): n is a, c, g, or t
  misc_feature (659)..(659): n is a, c, g, or t
  misc_feature (664)..(664): n is a, c, g, or t
  misc_feature (678)..(679): n is a, c, g, or t
  misc_feature (685)..(686): n is a, c, g, or t
  misc_feature (697)..(699): n is a, c, g, or t
  misc_feature (720)..(721): n is a, c, g, or t
  misc_feature (723)..(723): n is a, c, g, or t
  misc_feature (727)..(727): n is a, c, g, or t
  misc_feature (738)..(738): n is a, c, g, or t
  misc_feature (745)..(745): n is a, c, g, or t
  misc_feature (749)..(751): n is a, c, g, or t
  misc_feature (753)..(755): n is a, c, g, or t
  misc_feature (760)..(760): n is a, c, g, or t
  misc_feature (771)..(772): n is a, c, g, or t
  misc_feature (777)..(777): n is a, c, g, or t
  misc_feature (781)..(781): n is a, c, g, or t
  misc_feature (785)..(785): n is a, c, g, or t
  misc_feature (789)..(789): n is a, c, g, or t
  misc_feature (808)..(808): n is a, c, g, or t
  misc_feature (816)..(816): n is a, c, g, or t
  misc_feature (824)..(824): n is a, c, g, or t
  misc_feature (826)..(827): n is a, c, g, or t
  misc_feature (829)..(830): n is a, c, g, or t
  misc_feature (839)..(839): n is a, c, g, or t
  misc_feature (841)..(841): n is a, c, g, or t
  misc_feature (846)..(847): n is a, c, g, or t
  misc_feature (849)..(849): n is a, c, g, or t
  misc_feature (851)..(851): n is a, c, g, or t
  misc_feature (853)..(853): n is a, c, g, or t
  misc_feature (861)..(861): n is a, c, g, or t
  misc_feature (863)..(863): n is a, c, g, or t
  misc_feature (866)..(866): n is a, c, g, or t
  misc_feature (878)..(878): n is a, c, g, or t
  misc_feature (883)..(883): n is a, c, g, or t
  misc_feature (902)..(902): n is a, c, g, or t
  misc_feature (904)..(905): n is a, c, g, or t
  misc_feature (909)..(910): n is a, c, g, or t
tttataataagtacgaggtaaaaatcatcccccntttcctcctcatggnagcagagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaacttttgggggcggtttgggccaagggatttttaaattggaaaaggtttatcattgcggccgaatttagagttaattgggcnaattcccctaanggggggggttnaaaaataaangggcnnngntttaaaaanggggnaatgggaaaaaccnnggggtnnccaaattaaannncttggaaaaaatccccttttnncnagtngggaaaaaacnaaaaagncccnnncnnntcccntttccaaaaanntgccnaccntaangggnaaaggaaaattgtacggtnaaattttngtaaaaancnngnnaaaattttngnaaaannancntntttttaancnaangggcaaaagggnaaaanccttttaaaaaaaaaaaananncccnnaaagggtagaggttttcccaatgtgaaaaaagaggccccttttaaaaaagggggccccaacctcaagggcgaaaaaaccctttttataggggaggccccctattggaaaccattcccctaaacaaagtttgtggggtccaagggcccacctttggcccccg

SEQ ID NO: 496326 - DNA, 412 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacgtgtttatttgtggccgagtgtaacaaccatataataaatcacctcttccgctgttttagctgaagaattaaa

SEQ ID NO: 496327 - DNA, 407 bp, Homo sapiens
  misc_feature (303)..(303): n is a, c, g, or t
tgatccaattaagtttcgatttggcttatatgatctcaaatcttcagtgtttacaaaacatatcttgagccaccacccagctctgtcacccaggcgggagtgcagtggcaccatctcagctcactgcagcctccgcctccgaggtttaagcgattctcatgcctcagcctcctgagtaacttggactacaggtgctcaccaccacgcagggattctttttctatttttttgtagagacatggtttcaccatgttggccaggctgctctcgaactcctgacctcatgatcctgcccacctcggnctcccaaagtgctgggattacaggcgtgagccactgcactgagcctacagctcatttcttaccacataaagcttttgagctcttcacaaaactggcatgtggag

SEQ ID NO: 496328 - DNA, 150 bp, Homo sapiens
  misc_feature (150)..(150): n is a, c, g, or t
tcgtacgcgtacagttgcggtagagctctgttgcagggtcagactgcagggcggcatgccctctcggataccgagctgcagcctcgatacaccaggtgtcacagagcattttccgcaactggtacgtcgggcgcaactggtacggcgggn

SEQ ID NO: 496329 - DNA, 161 bp, Homo sapiens
acccacttccacctttacttaccagacaacctttagccaaaccattttacccaaattaaagttattaggcgattagaaatttgaaaccttggcgcaattagatattaggttaccgcaagggaaagattgaaaaatttattaaccaagcattaattattagc

SEQ ID NO: 496330 - DNA, 306 bp, Homo sapiens
ccgagatcgcgccactgcactccagcctgggtgacagagcgatacttggtctcaaaaaaaaaaaatgaaaaaaaaaaacttggaaataattggggggagtttaaagggggtttaagaaaaattttggggcaatttttatccgagatttttgcccttcatatcagtggagcggggaaaataaggctttgcgcgtaaaagtaggtagttttttttttcctaaacaatctctaggagtgtaaaataattttcgctggacaaaggttgtcgggaaaccaagtggtctttctaaagtggaaaatcctttcc

SEQ ID NO: 496331 - DNA, 911 bp, Homo sapiens
  misc_feature (1)..(1): n is a, c, g, or t
ntaacagggggaccacagctatgtgggcccccttttgggccctaatttttagaggggcaccaccttattgtgggacccaaaggtgtttgggtacaccaaaaaaaaccccacgacatctggggtaacacacgggttccccgcgaaattttcctccccgcggggataaaaaatgattgtttataggtgaacactttgttatagggttttagatttgtggatagttgtttttaaaacacgccgggggtgaacagagacgctgttacacatatatattaaggaaacaaaaaatagcgttctcagcgatccacagatggggtgaccacatatcccccacagattctcacatcgccagtttgagcgtttattgtgagaaacaaatggtgtttgtgcgttttatagaggagaatctccaacagcgttctcgttaagcacacatttcaaagaacattggcttgatagtgtcaccaacatttgggcgccacgccagagacgcccatcgtgagacgcccacccgaggcgcaggggcctgcgtgtgtagattatcccgcgcgcatatatcgctgtgtacacaccagggaagcgttctcgcccagcgtttgtctcgccaatggcgcgcccatttccttaagtgagacgttatctcttaagaaagtattttaattttgagccccacctttttcaagaagggaattgtggtgggtgtggtcgtaagagacacctagtaaataggggtgaaacctttatggggcccggggaaccctggcagagggtggagatgggggatagaagccttcagactcctccgccccagcccctttgcacctggggcctttcagactgtttaaatgaaaaacccattattttttgtaaatgaggggaaaaaagaaggaataaaagtgtttattatgtta

SEQ ID NO: 496332 - DNA, 110 bp, Homo sapiens
gcggcgcgtggtctacgccgagtgcaagagacgtttcaggctgtgttctaaggatgaccgagtggagacagacaagaaccaaccggtgcaaaggacccccacgcacataa

SEQ ID NO: 496333 - DNA, 914 bp, Homo sapiens
  misc_feature (261)..(261): n is a, c, g, or t
  misc_feature (771)..(771): n is a, c, g, or t
agcggagtgcacaaaagggcgccctacaggctactggtgactcgtgctgcagaaagctcatgggtgtgcggcagtaccgagtgatggcgcgtcagatcctgtgcgcaatcgggccagagggtggcgatgaggtccactattgagcccaactgagatacattccgatgatgacctgctagagaagaacattaacattgttcggaaaggactgaaccggacggtgaccctctcggagaagactggtggtatggagcacctggnagtgagccccgagcgcaggcgcaggaaaagtcgaggcgagtgcaagctcagttcctggcggattgcgagcgcggaacgcgctggtgggccaaatggcaggaatggcgagcgggcccagtacgtgggcaagtcatccaggtatgcatcaggcagacggcgctggtccatagaggtggcttgtgccattccagccaatccagctggtgatctcactcgtgaatggaacgcaccaggggttggcgggcgatgaaaaggaaccgtgcgtaccagggccagagaggaacatgtcaaaccaggggaacgtgtagtgaagtgtatgcgctgggcgagacgtggcgagggtggcgcgaagagtagtgggcgtttgaggcgtctctggagagccgtggggatcgtgggagatcaatgtacgaggcgacgattgattactgggcaagaactcatggcggtaccactgaggggttcttcctgatttggccacatgaactctacatactcaccctaaatggntggacggacattgcggggcaatactgcgattggagttggggggttgccagaatggctgtggactgtctatgggattggggataccgctgggggagctgaacgtggcacccaaggattgattggaggtgaaagacttgaagggg

SEQ ID NO: 496334 - DNA, 773 bp, Homo sapiens
caaccctaacataaccattcttaatttgaacatatttagtattatcctaagctacgtaccgcattcctacatactcaacttaaactccagcaccacagaccctactactatctcgcacctgaaacaagctaacatgactaacacccttaattccatcgcaaccgtcctctccctaggaggcctgcccccgcctaaccggcttttagctccaaatgggccatttatcgtacctaattcacaaatacacacaagtagcctcagtcagtccccaccatcatagcgcaccagtcaccctcctataacctctacttctagcctacgcctaatctactccacctcaatcacacttaatccccatatcttaacaacgtaacaatataaacatgacacgtgttgaacagtacgaaaacccaccccatatacctcccgcacacatcatcgcccttgaccacgctagctcctacctatgtccacctgttaatacgtaagtaatcctatactcagacagcaagaatcttccaccgaaggcagaaagactattcgtctcgccagcccgggaccccggctaccaatcttagcagactcagggaagacacagagaagaggcatccgggctggcctacggcgacagcacaaacagtcgacagggccggaacccgacgccctccctactaaggatacacggggccacgaacctaaggggtccaagatgaaccgggcccataggaacacacacgctcggcaggacaagccaggcgtccccggaacaatac

SEQ ID NO: 496335 - DNA, 186 bp, Homo sapiens
  misc_feature (84)..(84): n is a, c, g, or t
  misc_feature (135)..(135): n is a, c, g, or t
gaggacgtaggctcagtgatctcaaaagatcaatgtactaggcatgaacaggctttaggaatcactagacgagaacactcccanggaccctaagatggtaggatttgacctccttgtgcccagggctcctccctnaccagatgtgtcacttacagcttactttgaagtcaccagacccgaagagag

SEQ ID NO: 496336 - DNA, 420 bp, Homo sapiens
gtgctcgggaactataccatccatcatccaaggaccgttgtgtactccgtatccatatagtgagggttccactagaggtgtggaatcatgcaagtgaggaatcgaatcattttaagcagacaatctacagagagaatcagatttcaccactcagtaacaaagcatggatctatctgagggagaaagacaagtgtcctcttggcagggctatcatcccatttctcccctgaccttggattaatggaaggcagcaccgcaagggcacaagatacttttcactgttgagtgaagtgtacttttggtcttaataatagactgtctgtagtactttcgaaaactgtgtctctaccagaagattagtatcctaggatgcttgtcatgaggaaagggcgttcctctcaggtggccccgggggcgatg

SEQ ID NO: 496337 - DNA, 640 bp, Homo sapiens
aggtctatacccgcccgtgaaaacgccctctcggtgcaggagagacacactggcatcctccctctggtgcccctgaggaaccctccttctgtatgccgctgctgctgctgctacctgcttacgcgccgtgctaggctagtaccccctggcagcgaggtggctgcccaacaagggaggagacccctgcgactgagtagtcccgactacaggcctgtactaccaccggtacctaccagtgaggtcatcgcatgtcctggcagcacgtgatgggccataatcccgccaccaccaagcctagcccggctgcccacatgccggcaggcaccatcctcatccagacgggcacctgcctgcagcccgcagcaggctgcgcactctctggtccaggccccgtccccctacttcttcgcgtgccctacccccacacgccgttcgggcatcgcacccttcccccggccgcccccagtgcccggggctggtccccccgcgccctcgccccgccatcgccctcggcgtccgcccgggcctcccgcagtcattgctgccgtgcccggctgccccggcatccctctagttgctcccgcgcgctcggcatcccaccctgcccgtcgcccccttggccctcaccaggccaccgcca

SEQ ID NO: 496338 - DNA, 157 bp, Homo sapiens
ggatataacccttatcaaagttccctggccccttccccccttttttcttttcttccaatccactgctttttattttccctttaaccaattttttttaatttttacttcttccctttttaatttttttccttttgaattaaaatttcattttccttta

SEQ ID NO: 496339 - DNA, 156 bp, Homo sapiens
cttatggtccttcactgtatcgtgtcggtccttctcgactgcctcttgtatcactcttcgcgtttcttgttgtctgcttccgttcaacatcacctcttctcctgcgtctctcttctctcctcgttcttcatttcttataatgttcccgttacttct

SEQ ID NO: 496340 - DNA, 364 bp, Homo sapiens
  misc_feature (155)..(155): n is a, c, g, or t
  misc_feature (234)..(234): n is a, c, g, or t
  misc_feature (304)..(304): n is a, c, g, or t
agctgcggcgggagccgccgggatcctcctgtggttcctgcaggagcagaaccgggcctacagctcccaggatgtgttcggttttttacagcgggaacacggactgggcttggcggtggtggcgaagacgctggagcagttggcgcaacaaggcntgatcaaagagaagatgttcggcacgcagaagatctattttgcggatcaggaccagtttgacatggtgagtgatgctgncctttaagtcctagatggcaatatcgcggcccttactgctcaggtgcagagcttgcagcaaagctgccgntccatggaggctgagctcaaggaattatcttgtgccctgtccacaccagcgatgcagaag

SEQ ID NO: 496341 - DNA, 1669 bp, Homo sapiens
attgtgagcacgcacaaaatagtttttgcatatccctgaatgtgttgtagaacaggaatattctctaaaaatctcagcaggactttgattggatgcacacatgcattgtccagctctaacattggaatgttctgttatttttttatggttctaatatgtcctcgtccatttgtaatgcagtgtgttgtacttttggatgataaaatgagaattaatatttttaaacactattttaccaggaatgaatgactaaacatttacatgaaggcataaacattttagtgaaaccaaacaaaatctatgaggttattccatggcaaacaaaaatcaattatacaatatatattctaatcagagcctttaaaatatttaatttttgttttatgtttacctttcagataacataggtttgagaagtgaactatgtgttcactactcatttctggactttttattataacttaatcttaacaggtggttgtcttcatctttttatgccttcattcatttatttctgatattgatgtaaaatgataactaatttgttctcttattttagggctaccagagaccaagtcattacattgcaacccaaggtaaaactttgccttgttaaatgttatagaaaaaacaaacttgcttattcatctatgtggtggtttttattattttttaaattttatcttagtaacaaaaaaatcagcccttctgattaacactgctccttactcatttgtatagtacaaatttattgtgtgtgtaaagcttatataaatttaagcttgatttacttttaattaaaagtgaaagaaaagctggtagtggttattatgatttgatccttgttacacagataggtcagagcactagtcaatagtgccagtcagaggaattactcatttttgaggaaaggaaaaagaagtctcatataagaggcctgtcttcttgcagcaagtttgttagtagtacccaagaccaatattgttataatgagctgttatactgagcaattttttgacgagtcaagactgagacaaaacaaagagatggaatttagtcaagttaattcttcatggaatataataagacagtagagagatcttgttatagtggtacactggggagtaaaagtatccaaataccaccaccaaaaaaagcatctgtagtatctctctaaattgactactggccctcagaagagaaacctgtacatctttttttatataaaaggaaagtaaaacaaaagctaggtttactcttttaacaggggtcatttttctgtgttttcacatatctttggagtaattgagttcagttgtgtactctttaaagttagaaagatcgaccatagtggtgaacaatattcagttttatggtattcggtagagaacagcccagcacatgcttttgcagtttggagatattatgataagattaggatatgtccttacgtgtaaggatatgtttttattgatccctaaacatgcactatttataaatagtgggcacttatttaattggtaatatatgctgtctggttgatggtggtataagagttctattttttacacatatttgaagatgcattaaagtgacttagtgacaaatataaatacccaagaaactagtgatagtttcttctaaattgggaagtgtagagggcaaattg

SEQ ID NO: 496342 - DNA, 159 bp, Homo sapiens
catgtcgacttctagaggattccccaccagatttgtgtaatgccattaaatgcagtgccatgggggaaatttgtagcactaaattgtctattgcagttggaatcctacaatcttactagtgcagttacactcccaatgaaacccgatcataatggttga

SEQ ID NO: 496343 - DNA, 119 bp, Homo sapiens
atacaatcgagctcgcaccccctaggatatgtcgtgctatgcatctccagacaaaatatttagaaaataaaatcatcatggagggccgggcgcggtggctcacacctataatcccagca

SEQ ID NO: 496344 - DNA, 137 bp, Homo sapiens
atgatataggtgaagctggtgctgagggggcccactcactcgaaatgacacctggaggcctgtgcctcccttaccactccctatccccagaccgaataattggcctactgcacaaccagacacctcaaactctgtca

SEQ ID NO: 496345 - DNA, 1032 bp, Homo sapiens
agcgggagtgatccgtgggagccatggacaatgtgtttggcggccgcagcgctgaatggggtggaaccgacgttccctgcagcgtacagtcaagggtggttctagaaatgctggagagggccaagatggagggcggtggactggcatagccctgtagctgcaccaaatggcttgcatgggaggtccttgccctgggatggacgtccccagactaatacgaacagcacgccgtgtatttcgcggtcctgcgattcagcgtttctcaccgtgtgagacgaggagaacgagatgaccgcccattccgtatagtgcttccttctaggaacagatggcatgaatgcgagtggtactatactttgcaacgtgcagctgtgggcaacatatcgattcatctggtgccagaggcaacggtagtgggcacatccatgtcgtattcgttcatcacagacggcgagtcgaatctgcccatgtgcttggcacgtagggcaatgcgtcggagaataacgacagaggaaacgacatcgccgttgggtcccttggaggcagcatagtcataagtatcagagcatgcttccagaggcatcccatgtcctgctgagaagcatctctaaggacctcgtacagtagaagtatatccgaggggacctattcgtgtcaccttgtagggctcccgttgatttatgccgactaaagactccatgtggtcacgcaggttgagtctggacaaacgcgtagaacctggtctttcccctgttgtgattgttgaccatcagtgccaatcacccattccccttattttacggtacgcagaattgaagcccactggtattgatgtctcttaaagtaggccaaatccctttaaattccctggttttaagtgcttgactgtgttcaccgcttccgggaaactggagctttgtcccctttcactgcataattgtaagggtggtagggttctatttgaaaacagtctaactctgtaaccaggcttgaaatgcagggcttacacgcggtcattgcaagtggcccccg

SEQ ID NO: 496346 - DNA, 178 bp, Homo sapiens
atcagaggatcccgacgcctctctggcggggtgcaattgagtctctgtggtgggaatgggatctgtcagtctggcctttggctgggtctttttggcagctgccttgcagcaaaagcccactatggcagcaggacagcagccccagccacagccagctgcagccccacagagagagcgt

SEQ ID NO: 496347 - DNA, 144 bp, Homo sapiens
cggatgcttattactgcttcggatggacacaccagatgttacaagatttacctgcctagccagaggacatagcccaaggaaaaacgcactccagcacctagagcctgagccttgtagaggcgtccgagctgccagcaaagagat

SEQ ID NO: 496348 - DNA, 241 bp, Homo sapiens
  misc_feature (131)..(132): n is a, c, g, or t
  misc_feature (236)..(236): n is a, c, g, or t
ttaagttgaatgtccgggcggagtaggtatcgatgggcagatgaggggcgcatatgatctaggctataatatccggataacgtagccggtatgtaacaccggtactctagaatatagtagcatgcgaaatnnaaagcgtgataatcgatcgcgcgcagatctgtcatgatgatcattgcaattggatccatatatagggccggggtaataaattaacctcaggtcgacgtcccatngccat

SEQ ID NO: 496349 - DNA, 100 bp, Homo sapiens
taccacttcgagctcggcacccttgaacatcaggtcttatttcctctaagtgtatgtttgtatcaattagtactctcttcaccaccatcccccaacctat

SEQ ID NO: 496350 - DNA, 462 bp, Homo sapiens
tggtaccgtacttttcacagggcgggggaaggagcagttttcgggtttaagtaccccttttgaggctcctataagttacctcttgtctggatgaaggatttggttcctggctaattaaaggctgaggtgaattggtgccctatgcagaggaaggggtggcccatgcttggccaatcaggacactctctctttccatctgagatgtgctggaagcgggagggctgtagggagatttgatcctttgctgctcggcgtggggagatgggatttccccttctggtttagttttaggaagttcgtgttaattggccttaggttccctacccccagacccaggtgtcctccttttgatccagctttgagaagtcagcaccaattggcccccagaccctggtgtttttcctcgattcagcacaaattggccttaagttccagaccctgtaaagtaccctgtgaaaagta

SEQ ID NO: 496351 - DNA, 547 bp, Homo sapiens
cacgagggggaaagtcccctggacactggctctctttttaccttctctattccatatattggttggttgaagtttgttcaaagtattttgctacaaggatccctaaaacttatagtctctaagttcttgtatgtttcaatatgtccgtgagtgactttatatgtaaacagttgtttggctgggaataaaaatctctggatcttactttctttcccccaggactttgaaaatgttgatctctctgtcttacagcattaaatctgctttggaaagaatgagggcacagatgagccttaattttttcataataagctcttaatactcttttcttatgtgcccgtaagtatttatatgtaaatccaggtaaatatcctagatattatctcagtattgattattctttattgagaatgcatatcctttctaaacaaaagtttagcaagaaagaagatggagctccaataaattatttgagagatgttctcaccggaacttttcatttcttacccaaggtttagttcaagggagctgcattaaggaaagtggg

SEQ ID NO: 496352 - DNA, 308 bp, Homo sapiens
ccttttaatttcccatagtccgtgaaagttggggctgaagtccctaagtgtgaatgtctctcctgttaaactgagggtagaaatctgaatttttaaaagagctgtacctagttgtaagtgcttaggaagaacctttgccaccctttaatgaggatcccctgttcctttttaaaattccttccccctgtaatttaatgtgttttatattcttttgtagtaaacccccctaactccgatttttcccggggcccgtggttttttttggattgttttctgtaataggtttccataaagctggatggccttta

SEQ ID NO: 496353 - DNA, 383 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccacacacaaagagccacgcgaagggccacactaagggccacacaatgcgccacacaagag

SEQ ID NO: 496354 - DNA, 380 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccacgtgcacacgatgagccacccaaagagccacccaaagagccacccgatgagt

SEQ ID NO: 496355 - DNA, 546 bp, Homo sapiens
  misc_feature (13)..(13): n is a, c, g, or t
  misc_feature (16)..(16): n is a, c, g, or t
  misc_feature (24)..(24): n is a, c, g, or t
tacagctggtcgnccncggagtangatatcgtcgatccacgcgctccgctgggattacaggcatgagccaccgtgcctggccaattgctgtagctttttagtgagttttgaaatcaggaagtgtgagaccttcagtctttcaagactgtttaagctatgtggtgtcccttgatatggatttttctatttctttagaaaatgtcattgggattttgttaggcattgcattgaatctgtagatcactttgggtagtactgacaccttatcaatattaaatcttctaatccatgaacatggaatgtctttccatttattggtgtcatctttaatttcaccaatatcttgtagtttttagcatacaatatttaacctttgttaagtttattcctcggtactttattctttttgatgctattgtacaatggaattattttcttaatttcctttttggattgtttattgttagttgtagaaatgtaaccgatttttgtgtgttcattttgtatccttcaactttgctgaatttattagttctaattgccctg

SEQ ID NO: 496356 - DNA, 849 bp, Homo sapiens
atggagaggagacgcatcacctccgctgatcgccgctcctacgtctcctcagagagagatgatggtggggggcctggctcctggaccggcgtctggagtcctggcacccgctctccctggctcgaatgccccctcacactcccgatccgggtggatttctccctggactggggacactcaatgctggcttcaaggcagacccggttgccagtgacgcggtcagacgtctgctggagctcactgaccgcttatgccagctacatcgagaagaggttcgctgtcctggatacagctagaacaaggcgctggctgctgagctgatagcagtctgcgggccatggagcccaccaagctggcagacgtctaccaggctgagctggcgagagctgcgggtgcggctcgatcaagtcaccgcacacagcgcccggctggaggtcgagagggacaatctggcacaggagctggacactgtgaggcagaagctccaggatgaaaccaaatctgaggcctggcagccgagaacaactggtgcctatagacacggaagcagatgaagccaccctggcccgtctggatctggcgacggaagacttgagatcgcgtggacggacggacgatcccggttcctttgaaggaacgatccacgaaggagagtccgggaaactccaaggaggcaagtgggaccgacaagacggtacatggtggagcattgaacggagcgcaaggccagaactcaccggagccctggaaggacgatcagcaacgccaggatgcaagaatggcggtccgaacatgactggagcgaaaatagagaccgacccagtgtgaagcctaacgagcgctgccgca

SEQ ID NO: 496357 - DNA, 277 bp, Homo sapiens
ctgaaactccagtttttatatgtgctactgcgggggtgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496358 - DNA, 305 bp, Homo sapiens
tgaccccccacttaatgcgttggatatgatttttcaaagaatgcttcatgcccaaaataccagatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaa

SEQ ID NO: 496359 - DNA, 498 bp, Homo sapiens
  misc_feature (370)..(370): n is a, c, g, or t
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagtacgtactgccatgaggcattttatttgtcaatatatgtattacatccctagaacaagaatcccagggatttccctcctgtgtgtnttcgtctggcttcttcatgatccatgatgccagctgaggttgtcagtacaatgaaagcaaactggcgggatggacgcagattattctgccatttctccaggtctttgagttgcacgttccatctgggg

SEQ ID NO: 496360 - DNA, 371 bp, Homo sapiens
acccggcgctccattaaatagccgtagacggaacttcgcctttctctcggccttagcgccatttttttggaaacctctgcgccatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagtaccccatgcgcccaaggagccatcccaatgcgccacacaagcgccccaccatgagccacacgaagagccaccaagcggggatcctc

SEQ ID NO: 496361 - DNA, 137 bp, Homo sapiens
gcggccgcctactactactactactgctcgaattcaagcttctaacgatgtacggggacatggtgcccgtgcctctgtgctgtgtatgtgaaccacccacgtgagggaataaacctggcactaggtaaaaaaaaaaa

SEQ ID NO: 496362 - DNA, 952 bp, Homo sapiens
accaccgccaatgaatccctaatcctgcgccatgggttttttctggcggaaaaccaaccgccccgctagcttgatgcaccgcctaggccatttcaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaaggaagggaggggaacacaaaaaaaaaaacaccggaggggaaaccaaggcccagacggacacacagtaaaatcaacaaacgaggggcacaaaagagaggaaggaaataaatgagcgacgccagggcgacgccgacgcggctctactagacgaagcggccggaggacggaggcagaaaagacgtgaagctggatgggaaatcgagagagcgcagcgccacctatccactgatgagagaggggaggaccaacaaaataggcgcgcggcgaagcgcttcacacactagcagcgagagtgctggaacgccaaaacggtggagggtaaacgggcgagaacagcctctttcttgttgtctgtctcgtgttaagcaaggggaggaacaaacacacagacggacgtgggtgaaagatacgaggagcgagtgcgtgagtcggtatgggataggggacgattaagccgaaagattgaacgagacaaggacatcgcagcgagtgagcgcgagacagacaaacct

SEQ ID NO: 496363 - DNA, 408 bp, Homo sapiens
  misc_feature (8)..(8): n is a, c, g, or t
  misc_feature (43)..(43): n is a, c, g, or t
  misc_feature (79)..(79): n is a, c, g, or t
  misc_feature (176)..(176): n is a, c, g, or t
  misc_feature (248)..(248): n is a, c, g, or t
  misc_feature (317)..(317): n is a, c, g, or t
  misc_feature (354)..(354): n is a, c, g, or t
gattcggnacgagaggcgcccaccaccacgcccggctaatttnttatatttttagtagagacagggtttcaccatgtangccacaagggtctcgatctcctgaccttgtgatctgcccacctcggcctcccaaagtgctgggattacaggcgtgaaccaccacgcctagccaaatnttagtttcttacacagactttcaattcattcccacatttttaaccttaaggggtcataaatgtatgtttttntctttctggcaaaatgggtgataatgagacaggcaaattcagagggttggacatcagtagaaagtgagnctctttggcttctagtgtctaaagatgtggggaggtntgtgtacattaaaaatgtaaggcagtagttccgtgtgaatttgattgatatgtt

SEQ ID NO: 496364 - DNA, 528 bp, Homo sapiens
gcggccgcctactactactactgctcgaattcaagcttctaacgatgtacggggacatgttggtcctctgccctggacctgtgacattctggactatttctgtgtttatttgtggccgagtgtaacaaccatataataaatcacctcttccgctgttttagctgaagaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaggacggaaagagaccatgggggtttgaattgggccaaaggttattttaaggggggcaaatttagggttagggggcaaattgggccttatggggggatttttcccattaggggggcggttttaaaaaaagggggggcggggaaaaaccggggggtcgggaaaaaaatggggtttgccaaaattaaccttttggcagaagggccccttttcaaaagggggggcggacgtgtccggggg

SEQ ID NO: 496365 - DNA, 564 bp, Homo sapiens
gtggggttgaaatgcattttgaggggatgaagcgcgcaatcttaccccactgatggggggtttatgcttcttattctatcatgttggtcctctgccctggacctgtgacattctggactatttctgtgtttatttgtggccgagtgtaacaaccatataataaatcacctcttccgctgttttagctgaagaattaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattattgcaccctaatacccaaactccttataaaaaatacaaaatttttttaaatcccccatatcaacacaatatttgcccaaattcgcctataaaaggattcataaaaaaaaactgggctcaattaaaaaacgtagggtgaggaaaaaacacggggttccccaaaaagggcctgtaaaaaagacctttttcccagtggaatatgtccccccc

SEQ ID NO: 496366 - DNA, 398 bp, Homo sapiens
  misc_feature (192)..(192): n is a, c, g, or t
  misc_feature (200)..(201): n is a, c, g, or t
  misc_feature (235)..(235): n is a, c, g, or t
aaaaaaaaaaaaaaaaaaaaaaaaaaaaaaaaaaaaaaaaaaaaaaaaaaaaaaaaaaaaaagggccccgctcgcgatttagaaccgccatttttttggaaacctctgcgccatgagagccaagtggaggaagaagcgaatgcgcaggctgaagcgcaaaagaagaaagatgaggcagaggtcccagaaccngctagctnngtgcacggggaggcccacaggacagaaacatggnatgccaaaccttggggatgtgggacaagttgggggatggatggttactggtaaaggttggtcaaaggggtttaaaatttttcggcctctggggcgggcacctttggaaccacctgtgtaaaaaaaaaaccaccagggggccccccccggcccggaaaaaagga

SEQ ID NO: 496367 - DNA, 904 bp, Homo sapiens
gttcgaaggcctcgagagcgggagggagtctggcggccgataggactagttgttcccagcgtgcctgcgccttagcccggcgctcgcagcttctcgctctcgcctgctgcccgtcccttgcttgtcgcgctttcgctcgcctctcctcgaggatcgaggggaagtctgaccaaaggtctgtggctcgggaaggggagaacagaagggcggcgtgggatcaggtgaaacgaggctgcagtggtggtagtaggaagatgtcggcgaggacgagcaacaggagcaaagtatcgctgaggacctggtcgtgaccaaagtataagatggggggcgacatcgccaacaggggtacttcggtccttggtggaagcaatctagctcaggtgtgtcgggtactgcggcctgtgtgagaaaaggtgatgccatgattatggaagaaaccagggaacaatctcccagaaagaacaacggacacatgacgcaaggtattgctttccccacccagcatttcggtacataaactgtgtatgtcacttctccccttggaagagggaccgaggataatatctcaaggaaggtgaccttggtaaaacattgaccttgggggtcccatggtgggagtagcttcatcgcataagtgtagctcacacctctttgtggttgatggtcgctcaggggaccccaagtacacagggaggacaagcacgaactgttcttcacgggcggttcaccctttgtgctgaaagcttggccctacggctggtcaaacctggcaatgagaaccaacccggggacggaggcctgaacacgttgccactctttaaatgcaagccatagaggtatgtgtacacacattggcgcgcctgttcgaggagaagacctttcagatccacagacaggagagggc

SEQ ID NO: 496368 - DNA, 534 bp, Homo sapiens
ctgtaatcccagctctcagggaggctaagaggcgggaggatagcttgagcccaggagttcgagacctgcctgggcaatatagcgagaccccgttctccataaacaaaacaaaaaacaaaaaaaaaaaacaacaaacacatgtgtgtgggcgcgcgcgcctcgggccctccggaagaacacgttttttaagaacacaatccggttggcggcgcgcgcggggcgccacaaggtggggtcagtgcggacactggggccaaaaacgcgggggcccataaaggagaagacctccgggggcacagagagaacaagaggagcggggaggtttctacacccaaatataaaaaaagcgcgccgggggggggaaaacaccaggggggcggttttgtggaaaaaaatatttcaaagagaggggggattcactagggaggaggaaactaacaggggggagctcatatatccacagaggggaggttacaaaacgagagaagcgtggagaaatattacaaatttatagcgccccggcatggggggtga

SEQ ID NO: 496369 - DNA, 432 bp, Homo sapiens
tatattctggaaagcaaaattatgtccaccagtatgaacattaagataccgttaccagtcatattattattgaatgtccagtcatcctggctggttatttgcagcaccccattattaacaattactgacttgccgatatttttttgtactactgatatcaatacttgccgtgggtaaaatattcaacaaaccactataatcggtattatctcccgtgagatgcgtctcgccactctctgcattaattataccattacctgtgtttttagaaattaaagctgatgaaaaagataattgtcagagttatgtttaaaaatcaactctgccttcccaactccaaaaagaatccctttagattcaatagttccaggcatgtcgctattgatgaataatttcccttttgtgtcatttgccgtagttatattgatgtag

SEQ ID NO: 496370 - DNA, 1202 bp, Homo sapiens
  misc_feature (838)..(838): n is a, c, g, or t
  misc_feature (1059)..(1059): n is a, c, g, or t
  misc_feature (1152)..(1152): n is a, c, g, or t
atgaccccactgacgcaaaatttatcccctaatcacattcagttacgccgctcattgagtcgatctgtgcgctacgcccgatcacaacatgctccgtcatgatgataacttcggctcactccttgggtggcctggcctgatcctccaaaatcaccacaggaactattccctagtccactgccacgtactcaccagcacgccgtcaatccgtgctgtttcattctacagtcgtgcctactattcacttctgagaatggtaacattgatgggcttgaatcatcacgcgtaccttgcactccctagatggcgggcctcagagtatgtcctcttatcgtgcactctttcgctacacatcggggcgagggcctcatagttaccggagtcagtttcatcatagcatgcgagaaaactcgtgatgatcagtgcgtgccaatttagtcgcatccatgctttgcagacctaatagtcgagactatgtccgtctcatcacgcgcgtcatgttgcactccactcggtggagggggctagaaatacttcatctcattgaaggtgagtccgaccgagctcaattctaaccaaaaagcattaccttgaatgcgcggctctatcactcagtaaccaatctgggggggcatggacccatacgttgcagaatcgaaagtcctgacgtgatgggtctaaaattccaaggtcagagcaaggtactccgaagcgcgcttccatcaagcgatataacttctatcgcgtgtctcctaccatttcatgtgcctgtggtctcccggtgttcatctacattagctaggcgctcttcagccgagggaacttccaaacctccgcnttgatctcctgtgactaccaggttatatacgggcaatcaaatacaaaatgctcctctcagagggctactacctttcccctattctccccagtactttaaagagtcataggtcttctcctgagcgccatttagcgtacgaggcaaatcgcgagaaagggaccgcccgccctccgggattataagtcttcatcaatctgctttcattccttcgccgtttaatntggaccagctttatccacctatgttcctccaacccaggagcggtcctttaaggccgaaccctccagacagaattttatactcacgttaaatcnacaaaccccactatttaaaaagagcgcgcccattcccccccaccatcttg

SEQ ID NO: 496371 - DNA, 262 bp, Homo sapiens
gcacacaactgggatagaaatcctgcaactaccatcctcaaatgcaaagttcctttggtacgtatcttctcaaaattctcattcctcaaagctgtctttcctaacggaaactaacatttttcactaagccttctggaattttacccaattgtcaaccaagtctccaatatccttactgatataccataatttgtgattctaatgtctcaaaatgaagtcacttatgtcagtagcgtgagcccacagtaaagctgttcacccc

SEQ ID NO: 496372 - DNA, 267 bp, Homo sapiens
ggggggggggggggttttaaaaaaaaggaatgtttttttctgaggggttcccttggccctggggggccccaactgggccggagggaacccctgtttttaagggcccgccccatttttttgggttgggttgggggttgttttctccccaaccgggggggccctttgggttggaaaggtgggttgttttttaaaaccccccggtggggccttttttttgggattttgaattggccctttttttcctttaaaaagaaggtttttggtcca

SEQ ID NO: 496373 - DNA, 372 bp, Homo sapiens
ttgcggaccaggatggtcgtctcccgctcgttgatgtgttcgtgacgtcttcactagccttcactctgggaggcccgtggcgctggctgttggccgtgcctcttgtctcgtggaggtagacgcatgagtactctccccactgggcgtcggactacaccttgaactccgttatctggactgaggcagttgcgtcctccttcagcaacaagccccccttcagccagcggtgtcctgtgacctctgtggcgctgtcattcaaggagcaggtgaggagtatcttggagccaaggtcttctacggtagtgaagactgtgccggcagccccggaggctccgtgggtgcccagcagcgcgaatcccagcacaagaacca

SEQ ID NO: 496374 - DNA, 278 bp, Homo sapiens
atatccactttaccagagttaagagcagccctggtgaccagggccatggagtaaatggcatgccatttactccatggcggtgaagatgccagtggactccacgaggtactcaagcgccagaatcgccccaagttgattaaggagggatctcgctccctggaagatggtgatgggatttccattgatgacaagcttcccgtcctcagccttgccggtgccctggaatttgccatgaatggaatcatatgggaccatgtaacccatgtagtagaggtcat

SEQ ID NO: 496375 - DNA, 192 bp, Homo sapiens
ggcccttcccccccccttggggtttccccccgggcccgccccccttggaaaatttggcccggggtggatttgtattttggctggggtggtttcccctccctttttaaaaattcttttttttttgcccaataaaggggtttttttttttcccttaggttgggaattaaaattggggaaaaaatttcccttgga

SEQ ID NO: 496376 - DNA, 158 bp, Homo sapiens
  misc_feature (62)..(62): n is a, c, g, or t
catgacaaccgacgttggagtttggaggtgcttgccttagagcaggaacagctctcatcaanggacctaggaggcctctccctcagtggtagggaagacagccaggagcggtttttctgggaacctttgggattgtccccttgggggccccaagaaaa

SEQ ID NO: 496377 - DNA, 424 bp, Homo sapiens
gactgagcccagtggaggaggcacggggcagtgaccagccactgttgctggcacactggtgacgcagcacgtggcagatggacctgagagaaagcaggagggacagcacagtggagccaagaaagggcttagcatggccgggcacggtgactcacacctgtaatcccagcactttgggaggctgaggcgggcggatcacgaggtcaggaattcgagaccagcctggccaagatggtgaaaccccatctctactaaagatacaaaaaaaaattgccgagcatggtggcgtgtgcctgtaatcccagctactcaggagactgaggcaggagaatcacttgaacccaggaggcagaggtttcaatgaacagagatcacaccattgtactccaggctgggtgacagggcaagactccgtctcaaaaaa

SEQ ID NO: 496378 - DNA, 539 bp, Homo sapiens
gctctggcacagccgagagtcaaaagactacagcatccctgagagcagggagaggggccttttcctcgttttgcgttttcccctggagccagcaatgtgtcagtaacttgtctatgaaagaacctgaggtgtagccacatgtccagctgccttctgcgcacgcctggcctccctccaggctaccccttctatgggtgcgcatggtgctgctgttggttctgggcggggcctccactctgatggttccaccctgggaaagctggccttccatcctgccaaaccagatgacctcagtcccaccacctccaggaagcctctgtagatcttcattctgggttcttgtccattaaaaatacccaccatggcctgggcacagtggctcatgcctgtaatcacagcactttgggaggctgaggcaggaagatcacttgaggccaggagttcgagaccagcctggacagcatagcaaaaccttgcttctacagaaaataaagcttaataaataaagatacccagcacggctgacagtgaaaaaaaaa

SEQ ID NO: 496379 - DNA, 227 bp, Homo sapiens
ttttagttactgtgtaaaatcattatcaagaacctagggactacagccaggcatggtggctcatgcctgtaatcccagcattttgggaggccaaggcaggcagatgacttgagcccaggagttcgagaccagtctgggcaacatggcaaaaccccatctttataaaaaaatacaaaaattagctgggtgtggtggcatgcacctctagtcccagctactcaaggagg

SEQ ID NO: 496380 - DNA, 123 bp, Homo sapiens
tagcagatccccacattccagactcaaggccttgtctctcaggtggcatccctaaactcccccttggctggggagaagcgggatgttttcaaaggaaggacacattcctggctgcattcacca

SEQ ID NO: 496381 - DNA, 102 bp, Homo sapiens
tcaagcttctaacgatgtacggggacatggacatttttcctctggggaattaacatctaaattctggtaactattaaaagacagatctggttaatttaaaaa

SEQ ID NO: 496382 - DNA, 621 bp, Homo sapiens
cgccgtacaagaccgaaatttccaattagccccaaccaagccctcatagcgagaaaggggctcataagcaggccaggacactagacctccgaggaaatcaagcagggaagaaggaaacgggaaagcatccaccagggtaacaaagccggccatcagagaaacccagcagcgacaagccacgacagagccgaagagaccccgagaacagaaagcgcaccgccaaatatccgcgctcgaaagcaacccactagatacaccaacagaggagagggcacaagatcgagcaacgcctgagaggatccgcaacaccgcaaacctaacaagaacaccggggaagaacgaaacaagaaaagtagcacagacgacgagaaaaaccccaagaacctctgcaccgaagcagagcaaacagccacagcccaataagcggcagaccacaccgaaggcacgacgcaccaaaggaaacagcaaccacgtcacgcacatgaaaacagccgcaaccgcagcgaaagcacaaaagcacgaaagaaaacgcaaacccaaacgcaccgcagaccggaacccgacacacagatcccagtcatccagcacgcaccagcacaccgtcaccgcgctatgcgcccg

SEQ ID NO: 496383 - DNA, 287 bp, Homo sapiens
caaaaaaaaaaaaaaaaaccaaccaacttctcccggaggggggcggggttgttttttttaaggggacggaagcccctttccggtttcaactttaaaggcaaggatttttaaggaacatttgggtggtcctacaaaaatatggaggccggttatttcccatggggttacacttttacaaagaggggaagcagcaaagggctgaggcggaattgacttgggaaaccggcggcaaggtctttgggccccaacggcccccctaaaggccaattttcctaaagaccaaggcc

SEQ ID NO: 496384 - DNA, 141 bp, Homo sapiens
acatccgtgtcccaaatctaaagttatatatttaaccctcacaatcaggtttgatattgtttgatcttaagtatatatatgtagttaagcaagttatttgaggagggtatttccatacagcctttcatcagaaaataaaat

SEQ ID NO: 496385 - DNA, 1134 bp, Homo sapiens
gattcaagagtggggtggaggaagcagaggtcttcagggctcttatattttggagggagggggtgagtcatcttccatgatcatgagcttctagaaactgtgcctagtgggacgggggagagaagttggcatgaagcacattagaatgcatgggaggagagccatccaaagaatggcattgacatcggagctaaaggtcccatggagggtgcagcatggatactagctagaagtcccaggagcattaagtgtgacgcatcattgccagaacatcagagctatgaggagagggctgaggctaagaaaagaccacatggcaagaaacaaggaggctaccgagacacccaaaggtattccccaaggacctactacacacccaaattcaccatactccagggaaagacgatcgaaccaagtggcactgaaagtgtgcacctccctacagacgagaaggggtattggagcagatcagagccatgtgagcagggacccatgacatgacatcgtggagcagggagcctggagagaccaaggaatactcacagagagccttaacatctggacttccattgggctttgccattgagatgaggggacaggggagagcagggggacaacaacaggaccaacaagagaaggagcaataccaacataaagacaaaagagaaagaagaaaaaagcaaaaaaaacacacaccacaaaaaacaagagcaatcacgacacaaaaaacaatgaaaaaaaatacacaagacacagaaaaggagacacaaaagaagcaagagcacagaaaagaaaaacagcaaaaagaaggacagaacaataaaagcaaaagaaaaggaaataacaaagaaaaaacaagaaagaagagaaaaaaacaaaggaaaaaaggaaaaaacgagaaaaggcaacaacagaaaagaatagaataaacaaaaaaaaaaaaaaaaaaaaaaacacaaaataaaaacaaaacataaaataaaaaaaaaaagaaaaaaaaaaaaaagagggtagaggcaccgggagtaaaagagaagaagagaaaaagaaaataggaaaagataaaagaagaagaaaagaagcaaagaaaaatacacgaaagaacaaaagagtagagaaaagacaaaaaaaagg

SEQ ID NO: 496386 - DNA, 80 bp, Homo sapiens
  misc_feature (8)..(8): n is a, c, g, or t
  misc_feature (64)..(64): n is a, c, g, or t
aggaattnggcacgaggccgagggacggtccatgcccctggttaagagttgcaggtagcggtangttgggccactctggt

SEQ ID NO: 496387 - DNA, 173 bp, Homo sapiens
aaatgaatgttgctgatagggataaatttttaggctgagggcgggtgggacaaatgtgtatgggaaacccccacccctatatattgtaaataaatggggtgggctaaacattgttgccgtttcatacttctaccaactcagcttttacccaatcaagctcttctgtttttgga

SEQ ID NO: 496388 - DNA, 379 bp, Homo sapiens
  misc_feature (30)..(30): n is a, c, g, or t
gagagcctacagaataaaaggttaagatancccccacaggtagcctactgtatgttcacccttaccttatgtaaagtgcccagcttactgagcataagccaatgcatacttgactattcccctacctgctcattttgtcttggaacatctgaatgacaagttcctctttcccctccagcccacttttcccctttagatactgaagccctcaaagtcatcttgggagaaaggcacagacaatagactgtttctgtgattctgtgttttttttttttctcccaggcattgtccttagcctggcaaaataaatttctaagttgattaaaacctgtcatagatactttttggtttccaaatattataaatggtggttctattt

SEQ ID NO: 496389 - DNA, 348 bp, Homo sapiens
gttcgggagctcactctctctatactggtaccttctacatctcactacaagtatgtaagagttggtgtcgatctcaagtcttctgaatatcttcccctatccacagaaatctactctgggggccaaaaaatagaacaaattcttgccgtcctgaccattgaacaagagactaattagacaatggggctagaacaacctcaacgtacactggaaggaggcatgcatccccagctgataccttcggttatggctgtagttttcatcttacttctcagtgtctgttttattgcaagttgtttggtgacttatcacaacttttcacgctgtaagagaggcacagattggagt

SEQ ID NO: 496390 - DNA, 110 bp, Homo sapiens
gaattatattacttactagagtggcacaagattacactgtaacatattagctacaaaaaaggcactgctaagacattcaagcaaatagctattacacactactgcagatt

SEQ ID NO: 496391 - DNA, 288 bp, Homo sapiens
  misc_feature (66)..(66): n is a, c, g, or t
  misc_feature (102)..(102): n is a, c, g, or t
atacattctagcatccactatctggtgcccaaggaccacaatccataaacagctgaagcgattttncaaacgctagctcccaggaacagctaacataatgantttagagcccctcacactctgataacaaatctgagctacttacttaacagccaaagcaccagttctctttcatcttagctgagaatctgaaaatattctggctgagactatggtgctctatggagcatttatattctttaattaacatccagataaagactagtaatagatccagccagaaagggg

SEQ ID NO: 496392 - DNA, 1603 bp, Homo sapiens
  misc_feature (14)..(14): n is a, c, g, or t
  misc_feature (60)..(60): n is a, c, g, or t
  misc_feature (500)..(500): n is a, c, g, or t
  misc_feature (525)..(525): n is a, c, g, or t
  misc_feature (550)..(550): n is a, c, g, or t
  misc_feature (557)..(557): n is a, c, g, or t
  misc_feature (570)..(570): n is a, c, g, or t
  misc_feature (584)..(584): n is a, c, g, or t
  misc_feature (587)..(587): n is a, c, g, or t
  misc_feature (1603)..(1603): n is a, c, g, or t
cctcaggccgctgnagtcgcgtcgccggctgctcgggccccagccccggccgctgtggtnactccgccgcgcctcgccgtcgcccccgtcccgcccgccgccccagccgccagggacatgtctaacctcggaggccgtagggacgggcctgtcgaagtgcgcctgacagggacatgccacccccgttttaggaggacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgcaactccgtgagggtggagattataccaacaaggaaataaattagtggcagagtaagggtgacttgagatctcttggaagcgaggatcctttaaaaatcctggnatatacactgcagtaaaagaacaangcatacctcagccttaaacgactgnagaagantgtcaagtggggnagtggctttggttntcngtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctaaaaaaaaaaaaaaaagaaaaaaggaaagaacaattaaaaaaagagtgaaagctaacttttcaaaaccccagtattctaggttgaggtagcttacaggttctttgttttttttttttggagcacagggttctcgcttcttgttcccccaggctgtggagttgcaggggttgtgatcacagtctcacgtgcggactcgaccctcccgggggctcgggttgactcctcccaccttcagcctctagagtagtgtggaatttatgggcacaggttcaccacacccaattaattgttcggtatttttggttgaaaaatagggttccacttattttgggtcaagctgggtctcaaaactcctctggatttcaagtggatctacccacctgggcttccccaaagtggctgggggttacacggcgtgagttaccatgcccagcctcacagttcactcctgtcgcactattcttgtttcactctctatttggaccaagtgggagatccactgtccatgggccaaatgttcttggcaaggacaaaatattggcgtgggaatcccaaggtcccctgggtggaccgtcccggatatcctcaatgatgggaaaccgcggccacagttcatcgggggcccaccacaccaagtctggctttcggacccgggagcttggggcacaaatataacgcttaatccccaggcgtcccagtcgctggagcaatatattagcgtcagagaacccagaagctgccgaaaaatgacagaatgtaagtcgaacgttagaggaaaaaagcaccctgcagacagcgagacaaaccgcacacatctgagcatgccacttaacaagtn

SEQ ID NO: 496393 - DNA, 252 bp, Homo sapiens
  misc_feature (110)..(111): n is a, c, g, or t
  misc_feature (150)..(150): n is a, c, g, or t
gggccaaaaaaacaaaaaaaaaaaacccccggggcttttttggggcccaatttttggcccccagggcccctgggttggggccaagggggcccaagcccccccgggggttnnttttgtggttttgggcccacccccaatttttgggggggncccccccaattcccttttttttggcccccccgggggggggttaaaaaaaagggggccccccccgtgggggccccccaaaaggaaaccttttttcccttttta

SEQ ID NO: 496394 - DNA, 233 bp, Homo sapiens
gatgtaggatgtgaaaagatgaaggtgtttgctttaagatagtcaggtggaaataggttagagaagtgatttgaacccagtggcttttcctctctacaaatgtgtaactaaaatgatttgaccaggtgagagacattctctcgggaatattttccaagaaatatcactgtctatgattaatcactgtctaactcatatgagtggtagcctggcattgttagcagatgcattcg

SEQ ID NO: 496395 - DNA, 1645 bp, Homo sapiens
  misc_feature (14)..(14): n is a, c, g, or t
  misc_feature (60)..(60): n is a, c, g, or t
  misc_feature (429)..(429): n is a, c, g, or t
  misc_feature (439)..(439): n is a, c, g, or t
  misc_feature (448)..(448): n is a, c, g, or t
  misc_feature (451)..(451): n is a, c, g, or t
  misc_feature (456)..(456): n is a, c, g, or t
  misc_feature (542)..(542): n is a, c, g, or t
  misc_feature (567)..(567): n is a, c, g, or t
  misc_feature (592)..(592): n is a, c, g, or t
  misc_feature (599)..(599): n is a, c, g, or t
  misc_feature (612)..(612): n is a, c, g, or t
  misc_feature (626)..(626): n is a, c, g, or t
  misc_feature (629)..(629): n is a, c, g, or t
  misc_feature (1645)..(1645): n is a, c, g, or t
cctcaggccgctgnagtcgcgtcgccggctgctcgggccccagccccggccgctgtggtnactccgccgcgcctcgccgtcgcccccgtcccgcccgccgccccagccgccagggacatgtctaacctcggaggccgtagggacgggcctgtcgaagtgcgcctgacagggacatgccacccccgttttaggaggacttgtatttggtttgagaaggaattggaatcacggcgttatcctaccttcaccatttacccctgataaattgtccacgtttatatttgggaatcatattgacaggtcatgaaaatgagaccaaaagatctctggaagcgattaatgataaaatttcatggagaagaaggccttgactacggaggggttgccagggtgatgcaactccgtgagggtggagattatacattctcncccaaatttnccccacttnttntttcncccaaagccaacaaggaaataaattagtggcagagtaagggtgacttgagatctcttggaagcgaggatcctttaaaaatcctggnatatacactgcagtaaaagaacaangcatacctcagccttaaacgactgnagaagantgtcaagtggggnagtggctttggttntcngtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctaaaaaaaaaaaaaaaagaaaaaaggaaagaacaattaaaaaaagagtgaaagctaacttttcaaaaccccagtattctaggttgaggtagcttacaggttctttgttttttttttttggagcacagggttctcgcttcttgttcccccaggctgtggagttgcaggggttgtgatcacagtctcacgtgcggactcgaccctcccgggggctcgggttgactcctcccaccttcagcctctagagtagtgtggaatttatgggcacaggttcaccacacccaattaattgttcggtatttttggttgaaaaatagggttccacttattttgggtcaagctgggtctcaaaactcctctggatttcaagtggatctacccacctgggcttccccaaagtggctgggggttacacggcgtgagttaccatgcccagcctcacagttcactcctgtcgcactattcttgtttcactctctatttggaccaagtgggagatccactgtccatgggccaaatgttcttggcaaggacaaaatattggcgtgggaatcccaaggtcccctgggtggaccgtcccggatatcctcaatgatgggaaaccgcggccacagttcatcgggggcccaccacaccaagtctggctttcggacccgggagcttggggcacaaatataacgcttaatccccaggcgtcccagtcgctggagcaatatattagcgtcagagaacccagaagctgccgaaaaatgacagaatgtaagtcgaacgttagaggaaaaaagcaccctgcagacagcgagacaaaccgcacacatctgagcatgccacttaacaagtn

SEQ ID NO: 496396 - DNA, 422 bp, Homo sapiens
  misc_feature (167)..(167): n is a, c, g, or t
  misc_feature (204)..(204): n is a, c, g, or t
agcttctttaaaatctcacttactctccttctctacttcatttaccctgagaataaagaagaataaaggggtgggaaaggcctatcctcattcctcttgctctttccacagaggacaatgaggcaggactgagcagtgtcttcatccctcacggaattccaaggtgnacgccatctgtgaagcgacttcgtgttggcctgaacntgctaggagcttttagccactcatttggttgtaatccaacacatgacgtaatagtcggccgtctggattaatcagtcccagctgttggacgctctgctctgtgtgggggttcaagcctctccatctgttcctggggcctctccacttatcccttctctgcttgagcctccagccatgacagatggctctttctcagtattacagataatttttctctg

SEQ ID NO: 496397 - DNA, 635 bp, Homo sapiens
cgcagttccagagggcgcaccggggcccaaacagaggaccacgatgcgtgagagccgcccagaggcccaccactttgggggcaaagacaaggggtgggcacatgcgccagcttcgagcatccgggcccgctggagaaaagtccccgggtggatcgcacgacagcaccagaccctggggaaaccacccacgcgatttgtggctccgttttcacggccccttcaaggagactaagcacagcctggccgaagggggactccaggcatcgggggatatctcgtcccccatttcactattggtatgggacccaccaagtgcgaagccgaaacaggggtttcgaacacaccgtttgtgctggggccaaccaccagtttggttaacgtgtgcggacgacaccgagacacccaatcatcttgtcgtggagagttgtcaccatcaaagatcttctgagaaacctggttcggggtgttctacctaggggcattttctggtgaacaccagggagtctctccccaagaaccactacaactgtccatttttttttttgtggggaggggggtcaccccccccggggaaggggccctttggtcccacatcccccaaataaaacaaaatttttttggaatgcacccaaata

SEQ ID NO: 496398 - DNA, 148 bp, Homo sapiens
ggaattgaatggccgtatacctggtagcgtaaatcaataactaataaccttctataatagaaagcaccaggcttagatgggttcactgatgagtgatcaaacatttaagaaataaatcttggacccagaaatatttcctgtaaaattt

SEQ ID NO: 496399 - DNA, 831 bp, Homo sapiens
cctcatcgttcagccgatgtcaccaccagcccttatgctgacacacagaatagctatgggtgtgctacttctaccccttactccacgtctcggctgatgtgttaaatatgccaggcagctacctcagactctgagttccccatcggaacaacgggtggttactggacccaccaaaagtcatatctcttggggagccccatctatggtgtgtggtatgaccactcctcgcaacttctcctggaaatgtcccaacctggaatcctggtcaccacccttaaaccaggtaaacgcctttgggtaacaacttggcgggtgtgcacaaggggaattccttcggggaaccccaagaaacactctctctcttccagccccactctgctcattcggatgactactgtgcacatttcactcccccaggcacagtcacaccccccaggaaggtgcgatccagctcgtctgctatccctctgcccaggcaaagtgattcacttgtaagcctcacctgcgaagcctaattatgccagatagaattctgacctaacaagtgcacatgggcttcgactccagacctactctgaaaagtggacttacacaagcatgctctcaaaggtgtgaatctgccgaaccctgggctggtcccaaaaccactgcctcggcaggaaactctcgggagggaacccaggacgggtccaacccacgtcccatgaatgcaacagtcgtactctgggaacagagaaccacacaccagcgcccaagggcgcgagacagggacaaacaggaccacacgaacaagaccccagggcgaacaccgccgcacccccccaacaccgg

SEQ ID NO: 496400 - DNA, 515 bp, Homo sapiens
  misc_feature (357)..(357): n is a, c, g, or t
gccacaggcactttacagtgccccctaagtacccgaacactccaaggggggccatccccgcttgtgtatataacgtttccggtattactctgcaacacgacgcctttttacttttggggttttgtttttgttctgaactttcctgtacccttttcagggctgacgtcacatgtaggtggggtgtataagtgaaaacgggcctggtttttggggattgaagggcaggggtccttttcccctggggtcccagggtgttttgcctgttcagccaggcctttcttgggagccactcgcccaaaaattaagtttggccaacttggggggttgtgtccacccagcccgcccgtcctgttgggnggcaaagctccccttgttccctcctgccccggttcaaaagccgagtttgtgggcactttttcccttcaggcccctgtcctttttaacacgtccccttcaactgtaatcccaacatcctgaccccgtcatttaataaaaaaggaacatcaggcatgcta

SEQ ID NO: 496401 - DNA, 949 bp, Homo sapiens
gcacgcctgtaatcccagcactttgagagaccgaggcgggcggatcacgaggtcaggagatcgagaccatcctggctaacacggtgaaaccccatctctactaaaaatacaaaaaattagctgggcgtggtggcaggcgcctgtggtcccagctactcgggaggctgaggcaggagaatagtgtgaacccaggaggcggagcttgcagtgagccaagatagtgccactgcacttcagcctgggtgacagagtgagactctgtctcaaaaaaaaaaaaaaattcctgggaaaagccagaaacaatttacaaacaagtttgtgggagggcagattggttttattccaagaggttggttggagtggtggtgtttggcctaagcctccttataggcctatttttctactggctggagagagtaatattaacgggaacaggtggagggatgtggaaggacgagccttagttagagcgtcccattgcgggccttggggggtttggaactgtgcgggagatgatactctcatcactctgaaggcccatctgtgcaaatgtgggactctgtggttgtccatgagcaccagggagacctgtagctgagcagactgggtatggatgagcatatggggcaaggaacctcaagaacaaaggacaggttcaggtacaattcagtttggcagaatccccattggattggttatggatcctgggagaacaagacgttaaacatgattgagacccaaagtgtgaaggttgggaaacgctcagtgataaaaggactaataggaaataagggtattgaaatcacactgagatctgtggaagcctgaaatggttggaatgaataacgggtgaagtgcgagttaaagtatggctgcgaaatgagacttgttgaaggcaagtaaaatatgggagaaaggtcgtgtaataggagtaatgattataaaaagg

SEQ ID NO: 496402 - DNA, 285 bp, Homo sapiens
aaaagggaaaggggggaggggggccgaagcccccccccccccctttttttttttgggaccccaaagcccccccaaaaaattttgggggggggttcccctttccggtttcccaataaaaaaaaaaatgttggaggccccccgtttttttttttgggggggtcccaaacccccccggggggggggggaaccggccccttttagggggggtggggggggccccctttaattggttttgggggggccaaagcccgggtgggcccaaattaaaattcctttgggggggga

SEQ ID NO: 496403 - DNA, 253 bp, Homo sapiens
atgactcgttggctgttgacttcttccttttcttcttttattccaggtagctaccctagacttcagtgtagactaagttctgttaagcatgtttgcactttttttttctgactttttttttttttcccttaagggggaaaacgggaccttgctatattgcccaactccggggctaaagttatcctcccatttttgcctccttaagagcgggaattacgggggggagccaccatgcctggccataagcttgttt

SEQ ID NO: 496404 - DNA, 1062 bp, Homo sapiens
  misc_feature (805)..(805): n is a, c, g, or t
actcctaggtgaaggacgaactactataattaagttcctgagatgagttagtctgtctaaagctgactcttcaaaagtcagacgcctaagcattgaagggtcccatgccatataatacgcggcagagcaagggtacccttagtccaataaggtactatcttgatgctgggatataggcatgtggtgtattaatccgtgtcatagaaatggggactgccatatatataagacctgaggcaatgaaggaacacgtatgaaaaggatagctagaagagtgcaataatgtaagttgatggtgaattcctcgtattaatatcatgtcgatacatttctgaggtgactagatatcatgtgttcgtaaatgtagctaatttactataatcaaggattttataatctggaaatggcaagaaaatatataggtatataactatatattggtgggtgtcggtaaaaaggatattgttgtctgagggacacaaaaacatttcgcagttgctcgaagtcttgtgggtgggaaagaggagcggtatgtctacttgaatgtagaataagtgtcttcacaaagcttggatttgagtgccggaggaaaaaccacctgttcccgtacctgaggtcaacagaaggacgtactctccgtcgtagggttctcgccagaggaggaagcgtaatcctcctggcagcgttgtgggaccactaacatttggtgcccaccattgtgcctataaagaggcacttgaggggtattcagacaggccaccaaagactttgaggatctacaaagcgcgggctctaacgtgccgtnttaccatactcttgcagctatgacaagtttagctccccatagatgccgcagtacccttgcggttggggaacctttgaaaccccttagttatatcggggtgaccacaggctgtgtattaaggcgccacctggtgacatttcccagggatttgccactgtcagaatgtgccccgttcaaatagagcggtgggtcccattcttagacggggccaccctgcgaaataactctggccatatcacagataacttccggagaga

SEQ ID NO: 496405 - DNA, 515 bp, Homo sapiens
ctacctacctctaatagactacggattctagaaacagaatcattatagattgctatctctcattcgacttccgagtatagcgttaatttcagcagtcttggtcggacttgagccgccgtctccgctctcttggggccagtattgcgtatgatgagatcttcatcttctacatcactgggctcagtctcttgagcaggtggtgttggcttcgggctcggcctttttgggcgcaacctttgacttttacgctggccgtgggtcatcctcctcctcctcgtcaataacgacaggttccattttgacggcagtctaagcagccatctacttgacagctatgccttctactgtttcggctcacatctggtgtgcgcgtcctatttagatgggggttcttcattcatcacttgcccgtggcctcttctgtgtcttcctttccttgtccgcagtcgcttctttgacggacttgcaggctcccactacgtctttatccgatcgaatggagcatgagatgggat

SEQ ID NO: 496406 - DNA, 442 bp, Homo sapiens
gtaggcgggtgaggtggccagggtaatcctcaggggtcaactcccccgggttgttcaccgggttttttggcccccgcatcggggaccggttcaagggccgggtcccccgggccttcccctggggggtggtggggcccgcggggccggtgggggcccccggttccggggggtttgtggggggggccccttaccccctggtcctggtttgggggccttatttttttcgcaaccccttcacggattgttttggggccggggggtggaaggtccttccccctggggcccgggggagtttcgtcccgccccagcccctggtgggtctgggggagcccccccgttcgggttgcgggtttttaccttttgttaagccgctgggtttttttgtttccgggggccgtttgcctcttttaaccccggaagaaaaaaaccccaataaaaccta

SEQ ID NO: 496407 - DNA, 194 bp, Homo sapiens
agctggacggctagcggattagtgaacggatacctctgcatcacaatggaaactccatatgatcccatttctctgaaatgtccagaagaggtaaatccacagggacagaacatagattagtagttgtctctggctgaaggtccaggggaaaggaggagtgacttgctaagagtacaggcgttcacttaatgccg

SEQ ID NO: 496408 - DNA, 120 bp, Homo sapiens
acacacttcaaccttagaacactgtggtgttatttcaaagccccaagtgaaaccgttgtctgtacagacattttcaaagttgccagtgttacttataattggactgctggattcaggcca

SEQ ID NO: 496409 - DNA, 124 bp, Homo sapiens
ccaagcacactccctcctgggctttcccgccccggggggtccactcccaagggctgttatgaggactgggttgggcctacttgatttgaaaacacacccaagcaataaaaagcctcttcctgca

SEQ ID NO: 496410 - DNA, 689 bp, Homo sapiens
tcagggagtctgatggagaagatggctgcctggcagtggcagccagctggccagtgtggtgccctgtctggtgccatgcccacctgtgtgtcctggatgtggatggcatgcacaagacatgtgatggactgagagaagaaggagtgacgaggatggaggaggaatgactgatggatgggcagttggcttgtgcatgccctgtggatggggccacccctctgtcctaccccagccctggccctcagcctccaggccccagctggacagccacctttgacccagtgcctacagatgcccctgacagcccccgatgtctccgtgtggatgtgaagatgcttgcacacttgggcctccagccccacatgggtgcccctcatgtgtgccccagggcctccccactcagagcctggccagccctccatgccctgtgactgccctgcaatgctcagtgtctcatgtgacccctaggaccccccctacatgcacctcatgtgaaatgccacatgaatggcagccaaatgtcactggaggccctcagccccttgccatggccttggtaaagcatcggggaccttcaggccaccttccacgggatccagttctgccccagctcctcggacagtgcaccagagaccctctagctctgtcccagctccggggcccacagacgcacacagaacacagaatgg

SEQ ID NO: 496411 - DNA, 200 bp, Homo sapiens
tgtgagtgatcaccaggatcccgtaagactatccagcagcgcgctgaaaaggtaaaccatgatgagtgacctgcgcgaagtccgggtcactcgagcaggacgctgacgtcgtcatcctgatatgcacctgatgaggacgtttacgacaaagagtccccgcgcgccggcacggccgaatatcatcgtcgccaagcaccgca

SEQ ID NO: 496412 - DNA, 412 bp, Homo sapiens
tttgcacgctagaagtagaggatcgcttaggcctgggaaggcgaggttgcagtgtagccaagatgcactgtactctagcctgggcgacagagccagaccttgtctcaaaacaacaacaaaagccccaagaacccacatgcataaagtccttatatacctagcaccattctcagtgcattacacatattggctcattcaatcctcccaggactctctatcaccaaggttcctttatcagaccacaggttacacatatcggaacctgaggtacaaagaggttaagaaatagtagctaggctgggcataatggctcacacctctaatcccagcactttgggaagcccaagcaggaggaatacatgaggcccggagttcaaaaccagcctgggaaacaggcagaacccatctcagc

SEQ ID NO: 496413 - DNA, 100 bp, Homo sapiens
agggttccctggcccccagtagtcaagaaccccccagatcccctctctcccgactctcctcgcacagtaaaatacggccgtgtcctcagatctcaggctg

SEQ ID NO: 496414 - DNA, 812 bp, Homo sapiens
  misc_feature (4)..(4): n is a, c, g, or t
  misc_feature (15)..(15): n is a, c, g, or t
  misc_feature (20)..(20): n is a, c, g, or t
  misc_feature (36)..(36): n is a, c, g, or t
  misc_feature (39)..(39): n is a, c, g, or t
  misc_feature (76)..(76): n is a, c, g, or t
  misc_feature (107)..(107): n is a, c, g, or t
  misc_feature (116)..(116): n is a, c, g, or t
  misc_feature (120)..(120): n is a, c, g, or t
  misc_feature (149)..(149): n is a, c, g, or t
  misc_feature (167)..(167): n is a, c, g, or t
  misc_feature (171)..(171): n is a, c, g, or t
  misc_feature (185)..(185): n is a, c, g, or t
  misc_feature (200)..(200): n is a, c, g, or t
  misc_feature (228)..(228): n is a, c, g, or t
  misc_feature (243)..(243): n is a, c, g, or t
  misc_feature (255)..(255): n is a, c, g, or t
  misc_feature (263)..(263): n is a, c, g, or t
  misc_feature (278)..(278): n is a, c, g, or t
  misc_feature (284)..(284): n is a, c, g, or t
  misc_feature (305)..(305): n is a, c, g, or t
  misc_feature (308)..(308): n is a, c, g, or t
  misc_feature (311)..(311): n is a, c, g, or t
  misc_feature (314)..(314): n is a, c, g, or t
  misc_feature (338)..(338): n is a, c, g, or t
  misc_feature (345)..(345): n is a, c, g, or t
  misc_feature (367)..(367): n is a, c, g, or t
  misc_feature (369)..(369): n is a, c, g, or t
  misc_feature (374)..(374): n is a, c, g, or t
  misc_feature (407)..(407): n is a, c, g, or t
  misc_feature (411)..(411): n is a, c, g, or t
  misc_feature (447)..(447): n is a, c, g, or t
  misc_feature (458)..(458): n is a, c, g, or t
  misc_feature (501)..(501): n is a, c, g, or t
  misc_feature (503)..(503): n is a, c, g, or t
  misc_feature (512)..(512): n is a, c, g, or t
  misc_feature (515)..(515): n is a, c, g, or t
  misc_feature (595)..(595): n is a, c, g, or t
  misc_feature (635)..(635): n is a, c, g, or t
  misc_feature (660)..(660): n is a, c, g, or t
  misc_feature (665)..(665): n is a, c, g, or t
  misc_feature (673)..(673): n is a, c, g, or t
  misc_feature (710)..(710): n is a, c, g, or t
  misc_feature (747)..(747): n is a, c, g, or t
  misc_feature (807)..(807): n is a, c, g, or t
taangctcccaaaangtaangtttattgcaactgancanaaaaaggctgtgcggaccttcctcaatcccgtccaanccccagcccctccccaagcccccgctgcaantacgccggnaggnccgcagagtgttgcttgaaagcgcgtggnggtgcccggagttttaanaaancgccagtttctggngccttcagtaatggnaggggactccagagggcacgcccgcctnttgaagccctaagtncggcttggaggnagcggaanctccggagaggtcanaggtanagcgaggacactgttggaggnggnggngcnggtctggagggtaccaataggggngggattncagcccctgggccgggcaggtnanccgangggcaccggccctgggggtcggcagggagtggntttnttgggggtggggggttggctggcccctgaaaattantgccttgtgcnaacagggccctctgcggaggtcctggccgttcaaagggaacanantgggctgcnctntaatggcaggtgggttccttgaactggaagaattgctggtgcaggcgggcacggtaccagttgctggcaccaagcatcancaggaccaataagaccaggaggctgaggagcagccctgtngtcagggagctggttgctttgagcngagtngtgcagtnagggggtgcccagccctcctcacagtagcagttcctnttgctgttacagaccccatgtccatggcatttgcttngacatttctgtgcccccaggagatccacacgctggcatcgatggtctatacacaccaggncaggg

SEQ ID NO: 496415 - DNA, 181 bp, Homo sapiens
tttttttttaaggggctgaaaaaaaaagaaggttatggatgtccccagtttttatgaaaccggttttgtaaaaaaaattttggaggttaaggattgtcaaacaggggtccaaacccccgcccaaggccccccggtgggtttaaaaaccctttaccttttgttaaaggcccttttttgggga

SEQ ID NO: 496416 - DNA, 111 bp, Homo sapiens
tcttctccccgtacatctgggaatacaacaaatatgcctacatttaccactgtcatatgccatactattggaacatactagcgagagtcatcagtaagagagaaccgaaat

SEQ ID NO: 496417 - DNA, 237 bp, Homo sapiens
tgcgcaaaactgagccgcgcgcgcattacgcattcggggaaaaagaaaagccgcccgcggggcgcttacctatttgccggtcagggcggcgtgcgtcactcgatcgacgcgtacacagcctcgccgagcgggaacgaatcgctgcgcgcaatcggccaccacttgtcgtacagcgtaaagccgcaggtgtttgccgtcgagcagcgcgccgggcttcaggtacttcagcaactgcga

SEQ ID NO: 496418 - DNA, 1394 bp, Homo sapiens
agcataacccacaaatgatcattggacatcgacatatacctaaattattcagtgcgcatcgagctgtgagttcctagtgactaccatgcgccgtaatgccctctcgttattactgcatgcctcagtacgcctggggctcacgccccagggcagagccgtgtcctggcggtaaacagatcctatgactcgtacaacggtatactcagtgacagtccctagtagcacttgagtcacaatagatgcttgcttccatagtaaagtacccatacagtaatctggagggcttgtaggcaacttgactagttccccttacataagcgcgtgcccgcctgatcatggcgtatccccgattcaatacgatgtaagctgctagattctgatctccgttcctcgtccctaactcccgtgcgtgcggcggtcatgcctagtaaggtggcaggggcccgtgtaggcagagtagacagggtttagaaacagggtacgtagccgcttcaccctttacgcccacggggaagcatagcatccctcgaaccacatggggaagacgcctcgcgtgagaacgcataacgcatcgttgcgtcgctttaccacctcgtacgccacgggtggtcgtcccgtccatactctatgtagggggagccactcaaagtttatctaagttcaacaacactagacgtataactctaaaggtatgttagaaatacacagccgctgtggtcccaattaaacctcatagtataacatatatggccctcacttccttttcggaggtcgatggatttcgcggggtccctaaaatttcacaagaacatattcaccgtaacctttgcactcgcgcgtattcgtcggttcgctcgagtcttccggtaagccttgggcatgggacctatttgaccttaattaacatagcattagatcgaatgaaacccgttggaagcacctccaaatggaacacaacgcgttttgcattttctggaccccccggcgcgggggaggggaaagggaaggagagccccccaaattttccgtgaataaaccggaaaccaacgactgatattgctttggagtggtttcacccggggtccacccccccctgaaaagggtttaataacattccttttattcgctaacccagggggcgtttccgcgaagttactcttcccccaataattggctctaccgttgaagctaacttcgcggggaaagatcactataggaacgcccttgtgtggggcataaccaataacggggaatggcgaccctggagcgccatcactggaataagtcacaattggggagccatcccattaaggggggttaagcacgaccggttggattgaaacgcccacagtggcgttgatataatttctaaccatgtgatgagacacattatg

SEQ ID NO: 496419 - DNA, 431 bp, Homo sapiens
tcccaggccaggatggttggccctgatcccaaacctctgggggcaggtggaaattggctgtggtgagccatttcttcatgtcccttcagctgtgaggccttcctggccctagctcagatcatcatctcctcctttgcttttaccccaggagtgaggctgggttaaaggtggctttttattccgtagcagataaattcccttctccctgtcctgtccatcctgcctttacccatcaagcacccgttccttctgaaccaaatctctttactttgttggggaaaaaaagtattttgttttttaatttatttttttatttcaatgccattttatatgtttatctctgcgcttttgtgtgagccttcaaatgtgcatgtgttgggggtttttccctttctggtatttattaataaaaaaatctttcttttgggggg

SEQ ID NO: 496420 - DNA, 891 bp, Homo sapiens
  misc_feature (1)..(1): n is a, c, g, or t
  misc_feature (12)..(12): n is a, c, g, or t
  misc_feature (16)..(16): n is a, c, g, or t
  misc_feature (28)..(28): n is a, c, g, or t
  misc_feature (30)..(30): n is a, c, g, or t
  misc_feature (59)..(59): n is a, c, g, or t
  misc_feature (75)..(75): n is a, c, g, or t
  misc_feature (682)..(682): n is a, c, g, or t
  misc_feature (772)..(772): n is a, c, g, or t
  misc_feature (775)..(775): n is a, c, g, or t
ntgtcgattttncttncctgtgttaagnanagaagcttgctattacttcaagttttttngaagaaacacctgggnaaattcatcgcaaaaagacatcacctaggcacatcgtcgtcaggttatccaaagttaagatgaaggaaagaatcttaagagctgtgagacagaagcaccacgtaacctataaaggaaaacctatcatattaacagcagatttctcagcagaaaccctacatgccagaagggattggagccctatcttcagcctccgtaaacaaaacaattatcagccaagaattttgtatccagcaaaactaaacctcatatatggtgcttagctatttattttgttatctattgttgttgctcaaactgttcaagctttggccattgggagctctttcacattggctcttgtgtacttttggcatgccctcatccactttgtttggagcacttcctctttctggcaccacaggatgctccaggctcatcttgtgttttcttctctgcattggccctagacttagtcatttctcctaggagccctggttcttttttttttttttttttttgatgaatggccttagaaaccaagatcttgggatggggtgtgctcattgctactgtgatgacactgcttctacacattctaaatgaacagaactaggaaatattggtnatgtgtactaccacatgtatatacatatccataaattatggttcctatatgcatatatattaaactaaacatttagttcactgacattanaanatgtatgaggagtattgggatggaaaaaattaaaatcatgcctttatcttcccaatcttctataattggtttaatttataacaaaaacaaatgttctttttataaaacgaaataaa

SEQ ID NO: 496421 - DNA, 796 bp, Homo sapiens
  misc_feature (303)..(303): n is a, c, g, or t
gtgataggcgcaggtggtagcgacgggggctaagcaagctcgggaatgggtgaaagaatcagcatgattcttcagagagctctctcaggattctccgtcatgtcatccggtcagccgtctccacctccgatttgccggaggaacactccgtctgttcacaggaagaggcgacttatgaatataggatagcgtttgaatccgtgaatagcccatgatagactcgtatccgctggtagcaaatgaatccaagatgacatgacacacattcttatagtcgcatgagagcgatcgtgcgcagtgacncatgttcgtaggtgcttcaggtatcgaggagttagtcccagcgaacgtaggcttggcgtagtacgggaattgacttgccaacgtcatcaaggcacaaatgtataggtagatgtcaggaccatgatagtatcagtgggtccacgaccatttcgacaagttaggaacgaatgcccaaaatatgcgaaaggatcgagtcggataggaactcccgaggacgctgcaagcaacactaacaggatcaaaacatgcgaagtcgtggctcacaatttgctcagcggactctagtccgttacaacctagctaagagacgtcttcaggactaagacatgctattctcactaaatctgtcaagagtgcttctttgtaattcctgagttccagcactaacaactccatttcgcgtgactcgtttgcccaatacaactcgtatgatacctcatacccctacaggtagggtgcgagctttggtgagcgcgcccagcacgcgagctca

SEQ ID NO: 496422 - DNA, 358 bp, Homo sapiens
ctgagccttcctgctgcacttgtacagtacttgcctggatgctgacactgaggttggagaaagttactgctgtgcatgtactgttgtctgttgagcaggtgtgtgagatgttgctaccatagacaactgctgcatcttagatgaaagatgctgtatgtattgaccaactacctgtggcattggacatttcctgtctacttatcaaaccaaagtagacaaggatctacagtctttggatgacatcttacatcaagtacgaaaacataacatcataagtcaaacagctgatgcaatccaactgacttataatactgatgaatcatctgaacctatgattgacgctgatactttggttcgg

SEQ ID NO: 496423 - DNA, 125 bp, Homo sapiens
gcacttaatgctagtgtggttcatgtgtctgagataaacatacctagtgacaccccatgtttcttgtgttatccttagatactgatgagtgtggagagattccagtcacagagagacgtgcttgt

SEQ ID NO: 496424 - DNA, 1129 bp, Homo sapiens
  misc_feature (20)..(20): n is a, c, g, or t
  misc_feature (285)..(285): n is a, c, g, or t
  misc_feature (293)..(293): n is a, c, g, or t
  misc_feature (300)..(300): n is a, c, g, or t
  misc_feature (716)..(716): n is a, c, g, or t
  misc_feature (842)..(842): n is a, c, g, or t
  misc_feature (848)..(848): n is a, c, g, or t
  misc_feature (860)..(862): n is a, c, g, or t
  misc_feature (867)..(868): n is a, c, g, or t
  misc_feature (873)..(873): n is a, c, g, or t
  misc_feature (886)..(886): n is a, c, g, or t
  misc_feature (893)..(893): n is a, c, g, or t
  misc_feature (902)..(902): n is a, c, g, or t
  misc_feature (911)..(911): n is a, c, g, or t
  misc_feature (914)..(915): n is a, c, g, or t
  misc_feature (920)..(920): n is a, c, g, or t
  misc_feature (925)..(926): n is a, c, g, or t
  misc_feature (931)..(931): n is a, c, g, or t
ggccccctgcccctcgccgnccgccgcctgcctgggccgggccgaggatgcggcgcagcgcctcggcggccaggcttgctcccctccggcacgcctgctaacttcccccgctacgtccccgttctgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccatgtcctcgggcggtcatgcntgcccctnctgcctncgtggccgcccttgcttgcttggcctgcctgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggttggagaagcccctgcacacactgatgcacgggcaaggcgtgtgcaatggagctggcggagatcgaggccatccaggaaagccttgcagccctctgacagggacgagggtgaccaccccaaaaaaagcttcagcccctgtagcgcccatgaccgcaggtgcctgcaggaagncacttcgccaaaaattcgagaccggagcaccagtgggggcaagatgaaggtcaatgggggcgccccgggaggatgccggcctgtgccccagggctcctgccagaagcgagctgcaccgggcgctgnagcgcntggccgcttcannnagagnncgaanccacgaggacctnctaattnatcccgatncccaattgnganncgaanggaannttcancccaagcaagtgtcacccacgcttctggtattgggcagcgtggccatgtgcctggtgttttggaccggacaaacgggggcttaacgccttccggggggcctggagcccaaggggggacccggctggccaccaggtggtctacgggtttcaggatggggcctgccaccaggcagggaccccggtccgcgggaaccgtgc

SEQ ID NO: 496425 - DNA, 431 bp, Homo sapiens
tagaacatctgcagagatggacgatgtatcttgctaccctgcgacattttgatgcttgctgaagtggatcagatgtagagattaggtatcgctgaacaagttgaagatattatacatgaatcctacaaaactgattctgaagacaatcctcagactttagcttattactgcaactcggccacaggtgggttaatacaaagttggcaaaaaatacatgaacatcccatgatatgaacaggttgacctatgtggaaaaatgactcaaaaggctgcaactactgtggaacatttggccatccagtgtcattggcctcagaggccagcgagttatcggagatgtccttcaagtctacaggggggtctgaagggagggctattatttgctgtgagaccaagacgaatgtaacttaaatggccatgaatccacacat

SEQ ID NO: 496426 - DNA, 1135 bp, Homo sapiens
  misc_feature (20)..(20): n is a, c, g, or t
  misc_feature (251)..(251): n is a, c, g, or t
  misc_feature (271)..(271): n is a, c, g, or t
  misc_feature (280)..(280): n is a, c, g, or t
  misc_feature (284)..(284): n is a, c, g, or t
  misc_feature (287)..(287): n is a, c, g, or t
  misc_feature (290)..(290): n is a, c, g, or t
  misc_feature (294)..(294): n is a, c, g, or t
  misc_feature (296)..(296): n is a, c, g, or t
  misc_feature (299)..(299): n is a, c, g, or t
  misc_feature (301)..(301): n is a, c, g, or t
  misc_feature (312)..(312): n is a, c, g, or t
  misc_feature (318)..(319): n is a, c, g, or t
  misc_feature (722)..(722): n is a, c, g, or t
  misc_feature (848)..(848): n is a, c, g, or t
  misc_feature (854)..(854): n is a, c, g, or t
  misc_feature (866)..(868): n is a, c, g, or t
  misc_feature (873)..(874): n is a, c, g, or t
  misc_feature (879)..(879): n is a, c, g, or t
  misc_feature (892)..(892): n is a, c, g, or t
  misc_feature (899)..(899): n is a, c, g, or t
  misc_feature (908)..(908): n is a, c, g, or t
  misc_feature (917)..(917): n is a, c, g, or t
  misc_feature (920)..(921): n is a, c, g, or t
  misc_feature (926)..(926): n is a, c, g, or t
  misc_feature (931)..(932): n is a, c, g, or t
  misc_feature (937)..(937): n is a, c, g, or t
ggccccctgcccctcgccgnccgccgcctgcctgggccgggccgaggatgcggcgcagcgcctcggcggccaggcttgctcccctccggcacgcctgctaacttcccccgctacgtccccgttctgcccgccgggccgccccgtctccccgcgccctccgggtcgggtcctccaggagcgccaggcgctgccgccgtgtgccctccgccgctcgcccgcgcgcccgcgctccccgcctgcgcccagcgggngggggcgcgggggggggagncggtcgggnggtnatnttntttntnttntnttttcttgtgnttgttnntgctgcttggcctgcctgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggttggagaagcccctgcacacactgatgcacgggcaaggcgtgtgcaatggagctggcggagatcgaggccatccaggaaagccttgcagccctctgacagggacgagggtgaccaccccaaaaaaagcttcagcccctgtagcgcccatgaccgcaggtgcctgcaggaagncacttcgccaaaaattcgagaccggagcaccagtgggggcaagatgaaggtcaatgggggcgccccgggaggatgccggcctgtgccccagggctcctgccagaagcgagctgcaccgggcgctgnagcgcntggccgcttcannnagagnncgaanccacgaggacctnctaattnatcccgatncccaattgnganncgaanggaannttcancccaagcaagtgtcacccacgcttctggtattgggcagcgtggccatgtgcctggtgttttggaccggacaaacgggggcttaacgccttccggggggcctggagcccaaggggggacccggctggccaccaggtggtctacgggtttcaggatggggcctgccaccaggcagggaccccggtccgcgggaaccgtgc

SEQ ID NO: 496427 - DNA, 159 bp, Homo sapiens
gaacgctacatgggataaggaacgtactgggatgaggaacgtactggcgatgaggaacgtcactgggatgagcgaacgctactgggactgaggccaagaaaggctgtataactctagcgctaccaaagaagaaatctgtattcaacttctctggccctg

SEQ ID NO: 496428 - DNA, 536 bp, Homo sapiens
tggtcagtgaaatgcttcaattttaaaggaatattttcaaaacacccatataatagaacacataaaagacagccaacaaggaataaaaatttctacaaaatttttgaaagaaaatttaaattttggagaaattagtttacttaattcactacttacagaaaactataaaataaaagtaactttagattctgagaaaaaatttcagtgacctgatgaaattgaaaaattacacacgggaatttatatagccaactttttatcaacaaaagattcagaaaagtaccacggaattttaaaaatagactttaaaaaaccttcaattgcagaactaattttgtttgatttacttcaaattgaaggaactcttttaggttttgttgaaatagtaaaagaaattcgattagtaattcaatcaaagaataatgaattgacaaattctgacataaaaacagccaaagaatatcatttagaacaactaagatcgcttaaaaaaaacttcaaattaacaaatataatttataatttattgcactatg

SEQ ID NO: 496429 - DNA, 511 bp, Homo sapiens
ataaccatagaggatgtttaactattctgctttgaatacattattcatgatgtgtaaatgtattctatagccctgcatgatagcagacagcctaatgattttcaaaagtgttaagtggctctattttctcttagtaaatgtgagtgctgattgaagcaagctgttgggaggtgaaatatggctgatatccatttggtttctggagatgttctgagtggttttctggattagagcttataatactatgagaattaaatgctcttattttatatgatactaattaggtatacaagttagtcctttagttactggtgtgagtagttggctcctttgggctaatgtgactgtgggatcaataaacttagtcccaggtactgagtcctaagtgaaaggttttttagcattgattaagcataagaggattggacttcttcaaaatagccatcctttagaaaaagaatcctttcatatactttaagttatctatgaggtttttggttgtccagagtta

SEQ ID NO: 496430 - DNA, 289 bp, Homo sapiens
gcggcgcccttttttatgggtgtatagggaaatagagaaacatttctgtgtaacataaactagaaaaagtcatagatacaaagttatattgcattatagaacctataccgagttaaaaatgcaattaaaagaacctatacgagtaaagaacgcaattacaggctacatgcatataatcccagcactatcgggaggctgaggcaggagaataggtgtgaaaccaggaggagatcgcgccactgcactccagcaactctaacctgggttgacagagccagactccatctca

SEQ ID NO: 496431 - DNA, 163 bp, Homo sapiens
ccactgtgttgggacatttcctgggaattggggctctgatctggtccctgtgcgctcagccccgagttgccatcgatgcctgcacgatctgccagtgccagctgtgctgttatgcaagctgtcctttgtatgaggattaccgtcgtggcatgaacgagctagg

SEQ ID NO: 496432 - DNA, 428 bp, Homo sapiens
cctaggagtgtttccctccgcttagtatatcgcttattatatagcaagaggataacattaaacaattggaagcttcaattgtggcactgaataatctacacagggcatcttcaaggctacaattaaggatcccacctttaaaaaacttttttccaaggcaatacaagcccgattgagatcttcatggtcccactttttttgggcttttggaccattcatgttttatgccttgaaatttctttttaattgcatccttggagcttgcataagatcattttacttttcagaggtgctagttctggtgcccacaagaaaaaacatcaactcttcttttctggattctttggtttcaaagcttgcatcatacaaagcatagcgacaatcctttttcaggaagcattcccaacaaaatgcttaacgcggatcag

SEQ ID NO: 496433 - DNA, 225 bp, Homo sapiens
tgatggaacactttcgatgctggatcagaggcagagacttgagcctggaggatgtgcccggggcagagcgggactatggctgcagacgtggaggattacgacgcggagaatgacgtgcagctctccaagacgctggagctgcgcgtggcaaatctggaccccctggagctcagcgaggggaaggtgctttccgttacctcgtaaacaggcagtgcaggtcagtga

SEQ ID NO: 496434 - DNA, 120 bp, Homo sapiens
tagtaattctccccccaccactttattatatgactgcaaaagatgagaaggagataatagatacttagcgctgaatttggcatccagagttaacatttctcccctcactcccttgctggt

SEQ ID NO: 496435 - DNA, 110 bp, Homo sapiens
tggagtctgatcttatttatttgttacttaaaaaatcttatttttgactggattcatacttagaagtagaagctcgcatagaggaaagtctgcgtctctttgcaatttgt

SEQ ID NO: 496436 - DNA, 228 bp, Homo sapiens
  misc_feature (206)..(206): n is a, c, g, or t
agtacaagatcctcttctccgaaaggcacatcatctggtccaacctacaagtatcgcgcaatgacaccatccctgaggacttccaagagtttcaaacccagaaatttcgaccgcttcgataattaaaccaaggaagcaatctagtaactagctttatcggaacactaaaaaccatatatatatttaactatcaattattctttagncatttaccaacccacaatatat

SEQ ID NO: 496437 - DNA, 544 bp, Homo sapiens
  misc_feature (425)..(425): n is a, c, g, or t
atgtgggaggaacgcttgttcttacttatttacataatgtattacaatctggctgggaagattaggggaatgtcgttggagatagataactctgagctgctgcatatgttagagtcttttgagtttcttggttttaaggtggatgaagttgtagtagttctataggcttattatgttaagaaagaagttgttcagaaggtgggtgctgttgctgctgctatttcttagataaggaaaaattgatttaaaagttaaataattctttatggaatttaacttaaggtttgaagacttttagcttgtttctatggactttaatattaaggattataaattgtaaatttaataggttattttgtattaaaaggttaattatgaagtacttagaattttttaattatacgaatatgttctttgggttctgntgtggcccagacagtgttaactttttttttattgtgggttttgattttttcccccagaagttggttttatttgatgtacccaagtcttacgtttcccaataaagaaaaaaaatctccat

SEQ ID NO: 496438 - DNA, 193 bp, Homo sapiens
tgcctagatcgggcggtgatgcgagtgatgtctgctgtatccagatttggaggtggatatagatggtgagtaggagtcagacagctggcacatgggaaacttgtatataaaaatacaaaattagtcggtgtggtggtgacactgtaatccagctattgggaggtgagattggagaatggttgaacccaagagg

SEQ ID NO: 496439 - DNA, 304 bp, Homo sapiens
gccaaagtacaagaaggcggttcaggcttctcagctggggaaaagcagttgattagttttgcccgaacgattgttaaagatccaaaaattttgattttagatgaagcgaccgccaatgttggacacagagaacggaagtatttgattcaacaatcactccggaaaatgcgccagaatcggacaacaattgcgattgcgcaccgcttgttcgaccatcaaggatgctgacttaattctcgtgttagataaaggcgaagtggtcgagcgggggacgcatgatggcttactggcgcaacgccgcttt

SEQ ID NO: 496440 - DNA, 136 bp, Homo sapiens
  misc_feature (74)..(74): n is a, c, g, or t
  misc_feature (76)..(76): n is a, c, g, or t
tacatgtgaggctttaaggggcctatgttctctgtcaccactactcccatctgctggtgttacacaaaagcagncnaacaaagtatattaattaatatctatgttctattgtttataaaagctggcaagaggcttc

SEQ ID NO: 496441 - DNA, 279 bp, Homo sapiens
  misc_feature (10)..(10): n is a, c, g, or t
agacgttgantgagcaagatcatgccactatactccagctgggtgactgagcaagaccctgtctaaaacaacaacaacaacaacaacaaaaaaagcaccaaacctatcatttaagactcttttgactctttcaccttattttcatcatttataaaatatggaaagtaatagcagcttaccagagggttaccaggagaattatgtgaatgtgcatgaagcttaatgcctgatatatgataaacactaaggaaacgccatgcattgcaacacggtctctca

SEQ ID NO: 496442 - DNA, 188 bp, Homo sapiens
cagtcttctcccatcagaatacagaatgagagaggacacacacaacacgttatctgtaacagacgtttactatggtcaccactagatggcacccttgtattagtaaggagatttttctcagaaattatagggcttcgggatgacttctaataaaaatagatagtaattaatcaatagctgaaactgcg

SEQ ID NO: 496443 - DNA, 208 bp, Homo sapiens
  misc_feature (43)..(43): n is a, c, g, or t
  misc_feature (45)..(45): n is a, c, g, or t
  misc_feature (57)..(57): n is a, c, g, or t
  misc_feature (86)..(86): n is a, c, g, or t
  misc_feature (172)..(172): n is a, c, g, or t
  misc_feature (186)..(186): n is a, c, g, or t
  misc_feature (195)..(195): n is a, c, g, or t
ctaagtgtgtcacggtgcgccgtctgatgtggtcccggctgcngnttcggcaggcgnccatcagtctgtggcactcacttgcggcnatggctgcaggctcccggccgtccctgctcctggcttttgccctgctctgcctgccctggcttctagcggctggtgccgtcctaancgttccgttacccngctttttgncccgcttagctcc

SEQ ID NO: 496444 - DNA, 605 bp, Homo sapiens
  misc_feature (499)..(499): n is a, c, g, or t
ctaattttatttaaaacatttttcagagacagggtcttgctacattgcccaggctggtctctaactcctgacctcaaggtatcctcccactttggcctcccaaagtgttggtgattacaggcatgagctactgtgccagtctatcatacactattttttttttttttgagacggagtcttgctctgtcaccaggctggagtgcagtggtgcgatcttggctcactgcagcctctgcctcccaggttcaagtggtgtccctgccccagcctccggagtagctggaactacaggcgcgtgccaccgtgcccggctaattttttgtattttagtagagatggggtttcaccatgttggtcaggatggactcgatctcctgacctcatgatctgcccgcttaggcctcctgggataaagtgctgggattacaggtgtgagccaccacacccagccccatatgctattcttaacaataaaaaggttttaaaaatttgtctttgngaggctgaggtgcgtggatcacctgaggtcaggagttcgagaccagcctggccaacgtggggaaatcccgtctataccataccaacctccatacatacgccgcccg

SEQ ID NO: 496445 - DNA, 504 bp, Homo sapiens
tactcttagaaccatatctcttcaacctgcagaaggcaaaaaaggcggaagagagagaacaaaagtgatatgcagaactatagcaaaataaataacaacatggtagatataaatccttccatatcaataattatattacatataagtgaattagaaactcaatacagagcagagatagccagactgccttacaagcaggatccaactatatatggtctctaagagtcacctactagattcaaagacatagttgccagtcaaatgatggaaaaagatgacatgcaaacagtaataagaacgctagagtgactgtactaaaatcagacaaaattggctgggtgcagtggctcacacctgtaatcccagcattttgggaggctgaggcagacagatcactcgaggtcaggagttcacgaccagtctggtcaacatggtgaaacctctgtctctactacaaattagctgggtatggtggcaaatgcctgtagtcccagctacttggga

SEQ ID NO: 496446 - DNA, 959 bp, Homo sapiens
tctggcatgatggtacacacctgtagtccagctactggtggacttagatggaaaattgcttggagccgggagtcaaagttgcagtaagccaagattggcaccactacactccagcctgtgtgacaaagtgagaccctgtctcatgtttttacttaataggaaaagattacaatggcaattggattgatctgtttataaggctttagtaaaattagctttagcatttataatacactggcacaaagttagaatttggatttctcttttgaacaagatttttgtatacattaataagaaatagtaaaagatttttgtttaccttttgagtaaactgcaaaaaatattagtaataagaggagagaatttccctaatgctgtttttattatgtcttttgattgtttggaaaactgaatctcccctctgtcaaagagtaaaatttttgctttttgaaatttttgaattatcagtttggctaaatgaataactattatcttacagtgacctgtaatcttattttgatcaagtgttttaaacctttgatatttgacaaactttccaaaatcaaatgtaaaattctaacttaaatgttttcgacctcaagctaacttttgggcattaaagcccttggaagtccaaatagggcccctggaagtccaaaagaaacatattaggctaatttggtatattaaaatcatacaggaagctgatcaaataaaaaatgttgtttaattttctttgagttgtatttgtataaatctgttattaatatgcatcccaaaattgtatcatattgctaaaatgttgatagatcttgttatatgttattggtaataattgttatcctgttaaattattgtataccacagaaataatgaaatttctttgtcaattgcatctagtaatcatggctcttctaagtcttttgtcattcacagataattattgtttacttgattct

SEQ ID NO: 496447 - DNA, 378 bp, Homo sapiens
gggtgtttaagttgttgatgttagactggagttgaccttcgtttcgttttgattgttagtgtgattacgctttactatcgggggcatggtaaatataatggattcgagtattgtggacaaggatccttttaccgttaagggagagtgttagcttttcgccgatactgatatctacatagttaagcacgatttcctttcgaagttttcgctcgcccttcacgactaagtaatcctttcgaggacttctaataacggctacgtccctaatgcggagcccgacgatctctaggatgtagcgtctaagggaggattttcggacggtatccatagaccgacctagccctatccctatcgtggcctatccgacggatggcctac

SEQ ID NO: 496448 - DNA, 115 bp, Homo sapiens
tctagatcgaggcttaccgacaggccagcatgtcgcagatgtttcagtgcttatgggcatgtaactacccattcccaatgttgcattttatacagaaaaccgagcaggaccattg

SEQ ID NO: 496449 - DNA, 1099 bp, Homo sapiens
  misc_feature (1081)..(1081): n is a, c, g, or t
ccacctggcgtatcttccccggctcaacccccctgctcatccggaccctttgcccgtagtggccggattcggcgtgggcttctgggcccatcggctgggagtggtcccttcttcctgccccttattatccagacagggggcgcctgccgcccagtcgtttcgcgtgggagttgcccttccctgggccccgctggtctaactgcccttcctgtcgcctggtcgcggtgcccgggcccctggcactgtccggagcggttttctccaggtcacctgctctttgcttcctggtacctctaatgctgtataccagcgtccccacgcccctttgcgcctggagccgatgccttggttgtataccctcgtatcccctgtggtgtatggtcatccatctgttttcgtacgtcggtgttgtcaggcctctggcctaccattcgtacgctcggtctgtgcatgcgcagtatacgttctctacgtagtgtttcgggcatagccaggtgtgaccgccttgggatctctcatgcccgttggttagcctggttgagtaatccgggcggtaacggtgcttcaaccgcagcgctgcatcccaggaatagtccaccgccatgtgatcctctctgagatcaatggaagccgtctgctgcccttgccacccggatcgttgaccacgcagtctgtgatggcgctttgatcctgtgcctccttcggacactaatcctatctcctatcgttcagtgcctagagagggctacagtccctatcagccactggaaacacacattgctctcttcttccggtctactggctctgccaacactatacacgatgcgagcggcgtgagaggcccgaggaagggagtggtctgcggggctctgataccgcaaccagggtcctgtaacaggatgtatgctggactgtgcgcggacatgatggctcaacgttccacctctaactgacctggaggcgccgcatcgaggacgacgactgagggggagcgggagtgggactgagcgtccgcagaggtgaccgataaagccgtatgatgatgttcccgatttctctgttggtcaggagtcggccagtntacccggaggcagcagag

SEQ ID NO: 496450 - DNA, 104 bp, Homo sapiens
  misc_feature (5)..(5): n is a, c, g, or t
ggtantgttagatggtcatattcacctgccacaatctgctggaatcccttgatggtctccttcaggagtaccagcttccccatataacctgtgaaggacctcag

SEQ ID NO: 496451 - DNA, 240 bp, Homo sapiens
aagaaaaaaagtaaatccactttatgggggacttcagctatggacaaatttgggatcagggttctcccgtctgaacataatcttctgttacctgggagagagtggtcaggtactgccagctcagggcagccacaaacatgacgaactacaggttgatgggggagtagtggcttcgcgaaatcagctgaatgttgggaagaccctgagctcggatggtggagatgatctgcctcgaggtgc

SEQ ID NO: 496452 - DNA, 846 bp, Homo sapiens
agtgcccgcgaatgtgagcacccgcgcagtgtcagcagacgcgtggtgggctcccgacacgggcacgggttcacgcatagatgggggtaacacccagcgggtggggtgagcccacaaatggccccagggcccaaggcatctccgcgcatggagacacaaccctctgtcgaaggcggggaacatacgggagcttgtggcgcaccagcagagagaatggggcggcatcaagtccggcgggacgccgacggtcgtgcgcccagaagtgtgatgcgtcgattgcggcccggagaggcggtgtattcccccgggtgtctccgtgaaagggggggtgttccccccgacgtattatggcgagagattggggcacccaccactgttggtgagagcactggtggcgtcctccctgtggtccctaccatgctattcccagggagtacttcaagaatgtttgcgccgacaagattgagaaatccacgtggagtgcccctccctggcctcaaatcgaacttcccttttgaaatttgccaggggcggggcatctcccccctcctgcgaagttgtcgtgccagaaaatgtcccccccacaaggagaagcccataccgggccgcccctggtgccacaacgcagtaccactgggcatcaccgaatggaatgaaacaccggggctgattcgcagctgctggcggccaacacgcgggaggaatgttccatcggcgtacgctccacccccaccagggggtagaccccggtcagtcattacagggcggggccgcaaactggcgtggtggcaaaaaacacaaaacccccctgtagtcgttaataggaaaagtcttcgcacacatgac

SEQ ID NO: 496453 - DNA, 82 bp, Homo sapiens
ggcggagggaggaggcccgcagccgggaccaggaattctacatcccctaccggcccaaggactttgacagcgaaccgggccc

SEQ ID NO: 496454 - DNA, 272 bp, Homo sapiens
  misc_feature (6)..(6): n is a, c, g, or t
  misc_feature (10)..(10): n is a, c, g, or t
ctcgtncgcntcgatcagaggttccttttccagtgggtgataaaccatcaaaaagagcttcctgttgatgttacagatgttataacttcacttatcactgtttgatctccccttgcatcctaccctcggggcaggagtctgtcagctcaaagcagagataagggggccacatgtcccagggcttggcagttggagccctgaacccagacctcagtaggaagcatcagcgtgcatccattcccagtagcctctgagcaggagcaggcaaaagt

SEQ ID NO: 496455 - DNA, 298 bp, Homo sapiens
  misc_feature (21)..(21): n is a, c, g, or t
tttccccccccctttcaaaantggtggaggttaggtcaggggcctcccaaccctgcccaaagtatggggcctcaaggtttgggccgaaccttaaacctgcctggggcaacccctggaaacttttgggaactttcctcgaatgtgtggggccaaggccccccccttttttacccccatgtccttgggcctaaaggattgtccccctttttccaaggcccgcccccccagccccagcccccttgggaacagtggccggggtgggggggcctgcctggtccataaacccctgtttctccca

SEQ ID NO: 496456 - DNA, 286 bp, Homo sapiens
ccccctccccgggtaacagtaataagatttcaccacaaaaggcaggttggcattctagcttcagaacttaaaccgggccaggggcagtggctcacacccataatctttgggaggccaaggcagggaggactgcttgagcccaggagttcgagacaggtttgggcaacagagtgagaccttgtctctacaaaaaaaaaatgttttatttagccagccacaggggtgggcacctacagggccagctgtttggaaggctgaggtggaagaatgctttgagccaggaagt

SEQ ID NO: 496457 - DNA, 1006 bp, Homo sapiens
gctctgagcccgcccaagcgcggtcgcacgggctctcggcgagcgatggcagcatgagaggactacgcgtctagtagcaaggaaacaggttaagaagttcttacaagagttctaccaggatgatgaagctcgtggcaagagagcaggttcaaggtatgggtaaccgagttgtgttcgagcgtggcactcatcgagggaaccacggtggcgtcgtgtgatgctggatccgtggacggacggtagccgagggatgacccctgagttggtggacgtcaatttggtgagaatgccagggcggctacgcgaagctcttggctgatgccgtacaagagctgctgcctcgagtacaaggacgagggaagtggtaaataaagatgtcctggaccgttgacagttgagcatcgggcttaatgatggagcagcaggagtcggggacccgtgggatggtccgaaggcccctagaagcagtatcctgcctgaactcatgcgcagactttgagctgtatatgcaaggccctagcaggaacaaggctcgtgtgatccgggaagtcgcgggctagactcatgtgggggaagtggtaacggtgcgtggaatcgtcactcgtgtctctgaagtcaaagccgagatggtggtgcgcagttaacacttgtgaacagtgtggggcagagaactaccagccgatccagtctccccatgtgcatgcctctgatcatggtgcccagccaggagtgcagacaaacgtcaggagggcggtgaatctgcagacgcggggttcaggattcatcaagttcccaggcatgaagatgcaagaactatgggatcagtgcctgggggaaatacccttgtagtactcacgggctggacaaggagagaacacaggattgcagcctgaaacagcgtagcgtaacggaatatactggccaacctgagcagggtcagaagggcacaggtgacccaaacgcacggagcactggtgaaaaatacgggaggaaacactggggaacc

SEQ ID NO: 496458 - DNA, 265 bp, Homo sapiens
gtctagctgggcgacagagcgagactccgtctcataaaaaaaaaaaattacgtaggatatgggctggcatgcaccttgtagtcgcatctactcgggaggctgaggtggggaaaatcacccgagcccaggaaatccaggctgcagtgagctgtgatggtgccaccgcagcccagctggggcaacagagcaagactcgggcttaaaaaataagttatcacaggcggggcgcggtgggtcacaccgtgttaatcccagccactagtgg

SEQ ID NO: 496459 - DNA, 430 bp, Homo sapiens
  misc_feature (404)..(404): n is a, c, g, or t
aactggaagaatttatataataagcacttcagacaatactttaaaacaaaatagtttccttcataatgaataataattcaaactacttctccatttataatttaatgttgatacaatgatctacagtgacatgagaggaagatcattttcagttagtgtctgagagcaagttggcaaatatggaacctacctctgagctgacacttttaagactaaaaagggaccagtcatgacagcttacatgtgtaatcccagcaatttggggaggctgaggcagggagggactgattgtgcccatgagtttgaggaccaacctggggccaacattggcaaggaccccatcttcttaccaaaaattttttttaaacttaggctggggcatgggtgggccacacacctggcantccccagtgccttcagggggatttgg

SEQ ID NO: 496460 - DNA, 147 bp, Homo sapiens
tgagggtatacctgacgctcatgcgtacaacagggttgtatcatgcctggaagtgaccgggaggctctgaccatttagccaccaaatgtaggtgtagttctcactcttaggttcactggcgaggctaggacactggcgaggctagga

SEQ ID NO: 496461 - DNA, 484 bp, Homo sapiens
ggttagagtaggaattgtgttcttatacgtgtttccttggatatattatgagatgacttagatgtggacacaatcatgcctcaggattctggatgagtaagtgaggagggattggtcaccgtccatcactgggtgacgcgacccagctccccgctctgtgtctaggccgtctcacctgcccctccccggctccacatctgtctgtagcctgctgactccacagatctgtcccccgccctcccacctggggagtttgcccctggcggtctttacgtggctattcattaagcagctgagattcatttggtctaaaatggggctccggctgtcttatcccaccagaaatctcttcctttcctgtctcagtagattcccaccaccactcccatctcccaagcccaaaactggctgtcatcctcacttcctcctgcaccgtcccccaagggtccctctgatttaagtatgtctggattccgtactcacc

SEQ ID NO: 496462 - DNA, 227 bp, Homo sapiens
agaaggcagctatattattaaaactggaaagtaaaccgagataatagatgagaaaagaaaatgatgacttccctgtatattaaccagatgaaaatttgagccattatacccataaatttcattttgggaaataatttccctaatttttttatactttaagttttagggtactactgccccatgtagcaggttagttacattattacggggggtaccgagctctcatt

SEQ ID NO: 496463 - DNA, 515 bp, Homo sapiens
agagttggctggtccactgagcatgtactgcaaagggggtattggggttattttctggtaggaatagcatgtcactaaagcaggccttttgatattaaattttttaaaaagcaaaattataggagtttagattttaatccaatttgtaggggttctaggtaatttttacagaattgcttgtttgcttcaactgtctcctacctctgctcttggaggagatggggacagggctggagtccaaacccttgtaattttgtatcttgatgtctttgttaaggctgctgaagaattatttttttttttttataataaggaataaaccccccctttattccttcctttcatctacccttttttggttcttggtgttggctggggcaggcccgctgtggtttttttttgccctgacaactttttattgccctgttcagtatgttcaaagtccaataactcctccttgttaaccaactgtggtactgccccaagccgccctttttaatcagccttacctaaga

SEQ ID NO: 496464 - DNA, 240 bp, Homo sapiens
cccgggcccccccccccccccccccggggggtattttttattttgtccaaaccgttccccaaaaaccaccgtccggtttttttggatggggaaaaagggaccccctttttttttcctaaacccttttgggggagatttacccccggggggtttttccccaacggggttttttttattttccaacccccgggatttccaattaaaaaaggtcccccaaaatttaaatttttttttttttta

SEQ ID NO: 496465 - DNA, 627 bp, Homo sapiens
gtgcggcacagcacgaggcagaccagcatcccggccgcaaaaatggggcactacctccccggagccaaggtacagcgatagctccgctcgtggggccccccgcggatcattgtgcgggcaccatacctgttggccagaacactgaagagcgggcagttaattatcccggaaagaacacctggggaaaatcatgcggcccccgcacagatgaggatgtataaaattgggatctccggacgacgagacgaccctggtaatgaaactttgcgccccacgcatccagaagagaatctttgactagtacgtgttatctcgtattcatttcggcaaatactttgtgcctccgcggattttgtttatgatgagcaaaataggtgccgccaaaggggaagagcttgggtccgccacaaggtggcatactctgagaagggaggactcttctcgacaagcatctgtgcgatccttgatagaccgcgtggatccctggactgatttaccgcaagagaggggcaccggctctcttggtaacaaggacagccgcgaagcaagcaagtatttctattccatttcaagcccccgtctttttcttggcagaaaccagaaaaaaaatacgttcccccatgacga

SEQ ID NO: 496466 - DNA, 281 bp, Homo sapiens
gacagatatgggatgctggaggacatctgggggccacaaatgctccttctcctggagacgcaactcaagttctcatggagttttcattgtctcgtgcaatgccatcgaccttgaatttcagcataggacccatatgaagtgccgctgttaatgctgggagcactccaggaagcagagaaaagttatgacatttcaagaaaaatctgaattgcttgatatgttccacagattgaggtctgtacctatggttgcccactatttcaatagtcagtgtaagcggc

SEQ ID NO: 496467 - DNA, 124 bp, Homo sapiens
agtggtcatccacccagtctcaaagtggtgaaggacgcagtgttgactacagttatctgcaaccaggtcaagatgctatgcccaatatgctcagtattcacaggattatcagcagttttatcaa

SEQ ID NO: 496468 - DNA, 940 bp, Homo sapiens
gggggtgggaaaggtggcgtcgctctaggtggagtcttcaaggcatagcactatgtcaagagactcaggtgtatcccttccttcatatgagggagatcaggggtcaaagttcattcgatgagctaaagaggccccattggtgcccgttgtaatagcgggtgtcgcagcaattgtggcatatgggatcatatagacggtgacagtatcagcgggaaggagtattagaatgtccttttattggatcacagatgcgtgtggatgcccaaggcgtagtggtgaggagcaaggaatggttggtatgggctattgcgcatgtgtcgggaattcgtgggtaagaacctaaagagcttgagaaggaagagatggtgtaagttgggtcttgtaggcggaggctgggtctgagttagatgtccttgttattaatatggttactattatcgtcggagaatatatagtatgtagggtagtgggatgcagagtgggtaagcatgggggttggagaatattgagtatgcatctgttggcagggcttgagtgggcttggtggccgaagggagtagtgactaattaagtaactacgtcatggatgcaagtcagtttaatttaaacatggtccagcttcaaggcacttggatggtgtttgaagtgtcagcttcgtaatgtgcaagatggacttaggtgtaaagtaggtgcagggtcatctgaggtaggcccgaggctgcgaggtcaattgcgggtgaatagaggcccatggccaataatcagaaagcttgcggtttggaatgctggcgtgtaaactggccaaagggggggatatcggaagtccaaggcattttgtggttacgacaatgaagaggtatataacaacggcgaaagggggtgggaatatggggaaaaatagagaaagagaagtttaaaactgtcctgatgcttgattgtt

SEQ ID NO: 496469 - DNA, 90 bp, Homo sapiens
ggatgatgattttttttgtgataacagtattgtgctttttgtggggaaagtgaggttttttttttatatacatatatacctgatatcttt

SEQ ID NO: 496470 - DNA, 124 bp, Homo sapiens
gtactctacggagcttaatgctactccacaaacagtgtatagacaggttggaatgtgtgcaatatgtatgtgtgtgagtatgtatatagtataggtgtataaaggtgtgtgtgtgtatgtatgt

SEQ ID NO: 496471 - DNA, 101 bp, Homo sapiens
taaatggtaggcgtcagtgttcctctccgagcactcgcatgtcgcctgcctcttccatgtgaaatggtggcgtccacggggtcctcctcagcactcgcatg

SEQ ID NO: 496472 - DNA, 133 bp, Homo sapiens
tcagactcctcttatctgcacaggtttattccttacatctctaaaacagcatgtaaatatttactcgagcgtcccctttacttcagttagcatccccaccctcatttgtaagctgtgccctctatcgtataaa

SEQ ID NO: 496473 - DNA, 287 bp, Homo sapiens
cggcaagaggccccaaatgggtttattccttttgttcccgcataccgtatatttaggaatattcttatcatccaaatccaaaacctaggcatcatcttaaaaattcccacatcccactcctacatttctaatcaatcactagttttgcaaattctctctcctcgttagctgttaagtccatctcctcactaccattgccactatgacttaaaattcatctctgcactgggtatggggaaatagctgtcaattgtcacaatctataagaaaaaaaacatttgcggccg

SEQ ID NO: 496474 - DNA, 126 bp, Homo sapiens
caggggcccccttccccggccaaaacgggcagggttgccccttaccttaaactcccgattggggcccccctcccgggcagctcccggccttgccggcccaataagggctttcaaagtgttccctta

SEQ ID NO: 496475 - DNA, 124 bp, Homo sapiens
ctgatcaacatcgaggtcgtacacctattgttgatatatagataggattgcgctgtatccactagggtcactgttccgttggtcaagttattggatcaattgagtatagtagttcgctttgact

SEQ ID NO: 496476 - DNA, 321 bp, Homo sapiens
ctgaatgagggaaaattatggaaaaaaaacagaacggttaaagtgggagataccttgggtcttttccttggagaggataaaaaagcaggaacaaagacagttattcggattttcttgaaaaaagtgtttgaaaagaagactgaaagtgaaaaatacagagtggtggttcggcggtggaaaagtttaaagttgcctaaaaaaagaatgtttaaataaatggattgctttttagccataaagctgctttttagtggtaaaggaaggggtcccctgaaaaataggacctttttattaaaataaagttctcttagcggttgtgga

SEQ ID NO: 496477 - DNA, 135 bp, Homo sapiens
tacccgatagtgagtagaattagaattgtgaagatgataagtgtagagagaaggttaatgtttgatattgttatggtggcgtcttctaattagatgcataattaggtagtctgcaatcgagcgtggaatggtagg

SEQ ID NO: 496478 - DNA, 500 bp, Homo sapiens
  misc_feature (35)..(35): n is a, c, g, or t
  misc_feature (48)..(48): n is a, c, g, or t
  misc_feature (65)..(65): n is a, c, g, or t
  misc_feature (109)..(109): n is a, c, g, or t
  misc_feature (117)..(117): n is a, c, g, or t
  misc_feature (165)..(165): n is a, c, g, or t
aggaccccctggatccacagttgcccccctcaaanaaaaccccccccnggtataacctggggacncctgaacctgaagcccccctagtcccctggaaccccccccttcnccccccantgtgccaccataccagggcctaatagggtaataaaatattcctgtggnccccccattccagataacccccacagtaaagtgaaatacctgcaataaagcaaagtcaccccagaattttttaaatttccccccagtgccatataaaagttatgtttaacacctatactgtagcctattaagtgtgcaatagtattatgttttttaaaagcccaatgtacataccttaatttaaaaattctttattgtgaaaagatgctaacgatcatctgagccttcagcgagtcgtaatctttttgctggtagagggtcctgccttgatgttgatggctgctgactgctcaaggtggtggctactaaaggttggagtgactgtggcaatttct

SEQ ID NO: 496479 - DNA, 258 bp, Homo sapiens
ccggcatctttactaatgaccggcgtctttactgatgaccggcatttttactaactggccggcatctttactgaatgccggcatctttacctacatgacggcatctttactactgtccggcatctttactaatacacccggcatctttactaatgacccggcatctttacataatgagcggcatctttacctacttgggcggcatctttactcatgacccggcatctttactagtagaaccggcatctttaactaatg

SEQ ID NO: 496480 - DNA, 455 bp, Homo sapiens
gaaatgtcatgtaaataaatgtacagcttaaagataggtgttgtaatacaagatggaatgtcttggcaaagacttattgatgggaccagtggaaagcttcagtaaaccaattacatcactgtgcttcaattttaaattatagccaacaagaaatctaatattaaaaacaggagtggccgagtgccgtgtcacgcctataatcccagcactttggaaggctgaggcgggtggatcacctgaggtcaggagttcaagaccagcctggaccaacatggcaaaaccccatctccacaaaaaatacaaaaatttgctgagtgcactgtcaggcacctgtactcccagctactcaggaggctgaggcaggagaatcacttgaacctgagaggcagaggttgcagtgagccgggagcacaccactgcactccagcctgggtgacagagtgagaccccatctc

SEQ ID NO: 496481 - DNA, 179 bp, Homo sapiens
gggggcaaccctctgtggcttgtctcacaccgaccgagtcacagcaggatcccatgcgcgcaggcaccgggtcagatgtcacatgtgctctggctggttgtcaatctctgcacgcatccatcataagccctctgaactcctgctgacatcggccctttgaacatcctctaacccctggg

SEQ ID NO: 496482 - DNA, 144 bp, Homo sapiens
gaagaggcacttttgacgtcaatctctcagttgtacttggtgacctgcctcccagccctgggagaatgttttttagtattgctcagatcataccgggcagagcagtccagaacactgaaggcaccgtggctgagtacactcacg

SEQ ID NO: 496483 - DNA, 235 bp, Homo sapiens
tgtcctggttgtaaacaggatggtgagtgtaaccagcgggctgggtctcatcgctggccgctgagtgtacccggtcgtgcggtcaatgtgcgccccccgagtcctacctggccgcgtgctgtaatcatccgcctgagtcacagcgcccagccaataatcccctatcgtttagctcataccccctgtgctcctttccctcgtgcggggtacctagcacggaatgcagaaatcatgg

SEQ ID NO: 496484 - DNA, 132 bp, Homo sapiens
ctgccagtgtgcatggcatcatttgccagcacattctggctcagccgcacattccagccaccatggctggcctgttcatcagttggcatctgcagctcggtcaccaagcttggtgtcaatccatggtccatc

SEQ ID NO: 496485 - DNA, 789 bp, Homo sapiens
attcggcacgaggtaagtccaatgggatgatggagcatctgcctgggctcagagccttggctcccatgggtccctctcagctgccagctccagcctgctgccctggccccacctggccttgcctgttccaccctacacagtaactgctgctacccagcaccccaggagggcatgggtgcatgccaggtcaggacagggctcacaggcccagacatggcacccgcgttttgccccaagctgacagcacaagggcacatgcagtgggtggctgggcagggggacgagcctctccccgaccctaacccagaggcctcatgtgtcccagttcaaaggttgcagtccccatggggattgtcttctctcccgtgtcggttgggcccatgagacacagagatacctggctcaacctcactcaccccagccagggcatcacacgcccatcctgggctggcagaggtggggagctccttgcacatgctaaattgcagggcgagcctccagatacccgtgggatcctacactcaccgcatgagtattccagtgcccagcaagcatgacattaagtagcaaattaaaatgccttgaccaattgacagaccatagaagaaaggaggaacctttgtattttgagcgcctaggatggcacttttatcttgctctttgaacaaggggctctcatttgcattttgcactgcaaatgatgtggcaggtcctggctccaggaatggggaagctgatcattgcccttatttggcatcaggaaaggcctatcttataagttaaaaaaaa

SEQ ID NO: 496486 - DNA, 968 bp, Homo sapiens
ggaatgtgttgccatccaagagtgtggtcccagagatcccctttgtgcacgtgatggagcagggggagagtggatgattcagaactccgtgcggtacctggctagcaacagataccattcctcgtgaagagagtctcacaccatagctgggacaatatgaaatcctagtaagagatggagatgggcctagagcaagaagaaccatatgcggtgataaatagggacagggacgggatgttcgaagaagtggagggatgggagcgcgtccattcacacgctagtgcccatggagggtatgtccctggaaatcgccccatgagctcttgagacgtgggatggtcagaaatagtagtgtgtgggtatgctgcgcaagggttagggagaacgacgcagacgtgtgatatgtagagctattgaattggatgaggctaggagaggatgaaaggtgtgtgatcagggattgcatgcattgacagagggatgggttatcatggattgatgtgttgctggatgcatgaattatggtaaggcttggctaggggagtgtggagttgagacttttgagaggctaggaatattcgtcagaggaaattggctcgaggaacgcacgtagaaagggatggcgcagtattgtagggctataacgaagaaggttgggaggttgtgtgaaagggaaaactaaaatttggtcgaagtggtttgacacgatagaatatggagagatttgcccaggctttggaagggcaaccccattaacacgggggaagcaataggacgcaattacttgaagcaggagaaaccttggcattaagggggagagtcctccagacaccggtatgtacccatttagggacaccagcttgtgcccgtgcaaggggacttgcagaactaccattttatgcaaggtggaacgctgtacaaatttgtcctagagcgaaaggagaacttgcgttgtgtgacccctgagt

SEQ ID NO: 496487 - DNA, 998 bp, Homo sapiens
tgtaaatgatgctgtggtcaagcatatgcagtgattactgctataaaaagctccgatgtacagtagcatattggcagtggatgttctaggttggaactctgacacccagtgttgcttgcgaaacgatctattcactttctcttggttgacatagctatatcgactactcttctgctcacggaacttacggccactaataggccaattgtgagtactaatttgtctacgacctttaattaataatcatacgtcacacaatttgaagtcattgctcaccattcatgctcacgtatatagggcccgaagtgaacctaggattcaagttcaaagcaatggacttgataagcatgatgttcaagtcacagtgtattaaaatacattctgggcttaaaaagttaagaggtgtacgttatcggcaaaacttgtggaaagttgtgtgagcgccgttttggaaacaaaggttcactatgcatggaggcataagttggtgtaagttcaaggttgattaaccctttttattcgcaatttttaacagactttttcaccgtggaacttaagggcgttagtaggccttagcggaacaccacaaggttcccttggcagtgggggaaactacgttctgggaatacaaattggcatatgttgggccagtttgaaacacagtccctaatatagagattacaaggataatgctgggctgtgacagctaagctttaaacccagttaagctctataacgtcgaagttccggtccgttcatatgtaaatttcgccggtttgcgaaaccgtgttggtatccgggtgagatcatttcccttgcgcaacgtattatagtttgggtgcaacttggtttgtaacggctaaacctaatacccgtattcaaggcgagttgtaagtaattagccttatatcacaggcaagtattacgaggaacgttccttggagtgagcccttaattttgtacccttgtgaccagttttcgtgataaccctaagttgt

SEQ ID NO: 496488 - DNA, 256 bp, Homo sapiens
cacaactagggcagttttgcaggtggtagcatttaccaagatagttgtaggtaagaagggcagatatattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgtt

SEQ ID NO: 496489 - DNA, 408 bp, Homo sapiens
  misc_feature (233)..(233): n is a, c, g, or t
  misc_feature (236)..(236): n is a, c, g, or t
  misc_feature (362)..(362): n is a, c, g, or t
  misc_feature (379)..(379): n is a, c, g, or t
ttggataatagctattcctgggctacttactttcatgtcaaagatttattttaattcaaataagggcatttctgccaagaactttattttattctccttattctaaaaacacaaatcattcatattctagaccctgctttctagttaatgcgggcatgcaagtcactgtgtctctcacaacactggcccagagctgcagggcaaaacacgtggtgggagagggaaagagacanaanaacagacattcggcattggcctttggccttccccacgaagctagatcatttcccacttgaaggaaataaggattaacctatttccaacgaaatttgtggatatatactgggatatgtttttaagtnaagttattattttttancaaccgaattttttttaaaaaatagaagg

SEQ ID NO: 496490 - DNA, 229 bp, Homo sapiens
gtggcgactgtacttacttaaaagcacatcgcttaactacactaaggagtactatgatcgtcacttacgacaaaaggtaacgatggccgaacgggtgggaattggcctggaccttgatccccagttagcggccggttatgaactcttacagggcgccatgaccgctcttgaagagcacgatgttgaccaattaatggacctcttggttcaccaaatgggacgtgccagc

SEQ ID NO: 496491 - DNA, 477 bp, Homo sapiens
  misc_feature (433)..(433): n is a, c, g, or t
  misc_feature (453)..(454): n is a, c, g, or t
ccacaccctcatcaccagccttgggcacagctccacccatcaccccagaacaccccgcagaaagtgcctgtgcatcagcattccccgtcggagccctttctagagaaaccagtgccggatatgactcagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcaggaatctgttgatgcagaaggcccngtggtagaaaaaattgagcnntcgttcagtacaaagcgaagatg

SEQ ID NO: 496492 - DNA, 857 bp, Homo sapiens
  misc_feature (403)..(403): n is a, c, g, or t
  misc_feature (408)..(408): n is a, c, g, or t
  misc_feature (476)..(476): n is a, c, g, or t
  misc_feature (483)..(483): n is a, c, g, or t
  misc_feature (813)..(813): n is a, c, g, or t
  misc_feature (833)..(834): n is a, c, g, or t
ccacaccctcatcaccagccttgggcacagctccacccatcaccccagaacaccccgcagaaagtgcctgtgcatcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaanagccnaaggaacccaagaccccgaaagcccctaagattcccaaagagccaaaggaaaagaaagcaaaaactgncacgccnaaacccaaatccagcaaaaagtcaagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcaggaatctgttgatgcagaaggcccngtggtagaaaaaattgagcnntcgttcagtacaaagcgaagatg

SEQ ID NO: 496493 - DNA, 868 bp, Homo sapiens
  misc_feature (414)..(414): n is a, c, g, or t
  misc_feature (419)..(419): n is a, c, g, or t
  misc_feature (487)..(487): n is a, c, g, or t
  misc_feature (494)..(494): n is a, c, g, or t
  misc_feature (824)..(824): n is a, c, g, or t
  misc_feature (844)..(845): n is a, c, g, or t
ggcgctgggatatcagccactaactttcagttcttttctttactgtgaagaatgataatctaatttcaattcctatttgtgtctctcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaanagccnaaggaacccaagaccccgaaagcccctaagattcccaaagagccaaaggaaaagaaagcaaaaactgncacgccnaaacccaaatccagcaaaaagtcaagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcagaagagacggtccagcagacaggtgaagagaaagcgctacactgaagacctggagttcaagatttctgatgaggaggcagatgatgcagatgctgctgggagggattccccctccaacacctcccagtcagaacagcaggaatctgttgatgcagaaggcccngtggtagaaaaaattgagcnntcgttcagtacaaagcgaagatg

SEQ ID NO: 496494 - DNA, 141 bp, Homo sapiens
atgtgtttcaaccttcacacatgagactgtcgcttctgctgctcctcttcgacatgggtgcccagtttcactcattttgcatatacaatatcctcctggtacgggttttgcttgttctgctctgagaccgtctgtatgttt

SEQ ID NO: 496495 - DNA, 365 bp, Homo sapiens
  misc_feature (19)..(19): n is a, c, g, or t
  misc_feature (86)..(86): n is a, c, g, or t
  misc_feature (103)..(103): n is a, c, g, or t
  misc_feature (110)..(110): n is a, c, g, or t
  misc_feature (127)..(127): n is a, c, g, or t
  misc_feature (218)..(218): n is a, c, g, or t
  misc_feature (265)..(265): n is a, c, g, or t
  misc_feature (319)..(319): n is a, c, g, or t
taacttaatgctctggggnaaggggcctaagaactcttggtgggcgggtccgctccctcttaaccataaaagcttctgctcgaagnatgcgctggccctcggnatggctnccatgcgcaggtcgggntggtacttgttcttcgggatcatgtgtctgatgctctgacgtggcgcgagcattcttgttgatggtggccgcacataggaggtggcagctncgctggccggatctccgcttaataccaccacgacacctttcgtcggntgccgctccacgcccacagtcttcggtaatcagccgttgtagcggaagaattgnggccttcaagttattggctcagtctgtaggctcttatccacttgat

SEQ ID NO: 496496 - DNA, 276 bp, Homo sapiens
  misc_feature (21)..(21): n is a, c, g, or t
aggattcagagagcagagcgncagggagcaccgagggcaccctgagaaagactcccagtaaaagtcggttgtttgcccaaaggaggcagaagtaaactacgggcaggcaaccacaggcttgctctgacaaattaaacacgagaagaaaaatgtaaacctacactggcccaatcactttccaagagcctaattcatggtaaaaccagcagtccaagatctgatttggataaatcacttcctgacgctgcatagattttactctctggacgactgtga

SEQ ID NO: 496497 - DNA, 286 bp, Homo sapiens
acttaggcgcttctgcgctgtcacagttgcgttcgagatctagagcggcgccgcaatagctcgaggtgtccgggacctatcagcggctggcgtgtcactggatgaggctcgagagcgtgaccttcttcgagttactggtcatgtgcgagatcgtgatctccttcgggtgaccggagatgttctggatcttgatcttctgcgactgatacgctaagttctgcttcgagatcgcctcctggttcctggtggagtcctggatctggacgcagaacgcgcctcatggcgt

SEQ ID NO: 496498 - DNA, 110 bp, Homo sapiens
aagagccagtgtgggatacgggctgagcacgcaggggcagaatcatcatattgtttatctttttttccccccctttcttggatccccagtcagcactggtgctcgtgccg

SEQ ID NO: 496499 - DNA, 252 bp, Homo sapiens
cccccccccggggggggggtccctttggcccccccccccccccgggggtttaccccctgcccccccccccccccccggggccccaggggggggggggacccccctttttggggggggtttttcccccttttttccccccccccaaggtttttccccccccccccgggttgttttttgcccccctttgggggggggggggggggggggccccccctttttttttccccccctttggggcccttggtttcccca

SEQ ID NO: 496500 - DNA, 857 bp, Homo sapiens
cgggacgaggggggcgacaaccccacccaatgtcccgaaagtgtgacaccgatatttgtttggccgattccacaccaacgtgtggtgggccgcacgaagtggggcgccgctttcaccacacaagtgggcttcgtctcgcagaaggtgttgtccgccttttctcgcccccttctcatcgatccattgtgggcgcgttctattatatggtcccaccgcggcggctcgttcgccctcagcccgcccacgtggtacgatcttctgcggggcccacgatgggttggcgcacgcacgcggtttcttcttcagcaccgaccagcagtgtttttgtgtcgtcggcggggccgcttcatagctcccccacgcctgttcctcaggtgggcagcagagttatattcttcgcgaaatattagagggggggcgacggtcctccaaagcaacaaatcaccttcttcctgtttcttgtcgcctctcgctcaccccgctggtggcggcgtcgacactttctgcgcgcgggaagatactcttctctacgggggggtgttttatccccaggagccacatacttttgttgtggaccgcccccacattattttatgacacaaccacccgccggggaccccgtttttttttgtttctgctgctgctgatcctctcctcctcgcgcagcgcgctttcttgacgaccgcggcagtagattttttttcagcccctcccgcgggtcccccccctccccccccccccttcaccaaaataaccccttttctccccgggaacacaccccttttttttacacaccctttcccccttttttttcttttccccccccccccaacacatttccgggggtttttttttta

SEQ ID NO: 496501 - DNA, 1290 bp, Homo sapiens
  misc_feature (1000)..(1000): n is a, c, g, or t
ggaggcattgaggcagccaagcgccagggcgcttctcgctcgcagcggggcagcgcggagcttggaggaaaccgccagcataagtttttttcctcctttgcaaagcatcagcagcattcaataccacactacttcaaaacaatatcagtccaatcaggttcactaacgcatattggcttagcgtttaagtttttaacggtaattttacatagcttcaagccattttaagcagaacaattatgacagcacttcagaagcagtcagcatgcacggacaggacaacaggatcaaaacagggttttcttaagaaacattgaccggcagggttcgcagcaatgcaaaggctttctttccattgcgcagtcacacacaacatggtattttaacaagcaaacattgcagcagcaaagggcactaccagacgcccccggaagttcaattacacagatacgaagggcaaatgcgtattctagcatttcaccaattgcaaggggtgacttcaaaaccagctcttaaaacgctcttaagtttttacacacaggttcggtcagggctgcacttacacacattaatttttggcaacagcggcggaatcctttgtttcaaaaacggaagcatttaaagaaccccaaaaggggttgactctcacaagaacgaccctttggaaaaattcccaattgcagcggctaggggcacgcaactctcggcggttccactttttcacacgaggagcccgttaggtgtttcaaaccgccccacgtgtttaacccttgaaagtacggccaaaggaaactgtcaaccacagactcgggggtcacaacacggcatgtctacactttctgcggaggcagcgctggcgaatcagcgcgaattggacacacacccccaacactctttgggcacgcacaacgccaatcaggaacacgcgttgtctcgaacaagcgttggggacaacacaccacctgggcggtaccaagtcaaccctaggacaacaacgccnttacactgagggcggaaaagcgggcccggaaacagacaacaacacgacacatacggccacgaaacagcaaattctcgggggaaccaccacttctatggcaactcgtactgtttacgtaccacgcagtgtaacactctttttacgccgcaacacgccaaccacaccacaacgagccaccttcacactagttctagcccaccgcccttgacacacacggtctctagtggacaaggtcataacagcgaccacaagccgcacaccacacggtcgtcacgagcaaccaccaccga

SEQ ID NO: 496502 - DNA, 375 bp, Homo sapiens
tttttttgggggggggggtaggtaattggctataatttcatgagaaaatatccctgcctataatgagtactcataaaagaacactcaaactcctaacacacctcagacaaactactatgaattcaataccattctttagggttcccatgttccttagtcacagtacactggatagcccttccttggagaaaaacaaaaacaaaaaaccctactcaatgtattattcccaaagccctcaggatttatggagtctcaattagatttactacagtctaagtagtttctcctaaggtaggctgagatcgcccctcaatgtccagtatggtttggtttggtttggttttgttctgttttgttttgttttttttttttttt

SEQ ID NO: 496503 - DNA, 225 bp, Homo sapiens
ttttaaaaggggaaaaaaaaaaaaaaaagaaccccttttgtttccccgggcccatttcaaaacattcccctcccaaatttaaggttttggattccaggttgggagttttccaatgttaatgtaaacaaaacgggccccccccccttaaaatgaatgtaattattattcctcttgcgggtcccccccgtcgcttttaatttttctttctttgggggaatttattta

SEQ ID NO: 496504 - DNA, 217 bp, Homo sapiens
gctgtagtcagctgtgatcactcgactgcactccagtctgggcgacagagtgagaccctgtctcaaaaaataaaaataaaataaaataacatggtgaattgtatttcatatgaatatatctccacttaaaaatctggggggctgcagctcatcttggggggagctggactcagatgcccccgtaggtgcaaaagcaccatccacttctcccccccca

SEQ ID NO: 496505 - DNA, 336 bp, Homo sapiens
gaacgatctcctctcttagtagatcctgtgtcggtgtcctttagcccagtgccatcactggcagagattgtggagcggacatccccgggtagaaccagggggccggtaccgacctgcaggttgtgagccccgatccggaacagccatcattgtgcctcatcgctagcccgggagcaccaccctgcgccgtgctgcatctaaccacctgcaccccgtttgtcgcagggccagagcttgcttatggcatctatgtcatccaccaggctggaaatggacatttacagggaaaactgttgaacgttggggtgcgagaggccctccgttatgaagagtggg

SEQ ID NO: 496506 - DNA, 105 bp, Homo sapiens
tggttcttgtgctgaaaaaaatacaatccctgcatctgttataaagtataaatgaagactgtcctagtaaaaacaaaaaataaaattcgtgtggttctttgctgc

SEQ ID NO: 496507 - DNA, 809 bp, Homo sapiens
tgtatgtggcgcggaggacgcaggcttgcctgactccccctgaggtgcccgcggaaccaatgtgccctgagtccactgggccgtgagcagaccaccgactggggtgcaacttggcactatagaaccgcagacagggacgtcggttatgctatctgggactcgcgggaggccacgatggagatcctgtatagaatgtggaagccgatataagcagagtaatatgctgtctagtcaccatgacaaacgagccgctgcagtcacctgcccgaagtcctgccagactgcaccagctcagctgcaccctgtggtgaagacggtggagggattgtggcagcctagatgaatgggcagccgcaggtatgtcatgcaatgtttcaagccaaaggacgggcaagctgctgtcaacagtagtgcggactcttgccacccagagccccttcaagtgaccggccgatgtgcatgatctgctcacgagggcagcagccaagaggacttgctctactccactgttgaatgtatcagggacctctggtggaccacgacatcggagctgcctgtgagccctggctgacatcctacaaaaaggcgctgcgtaattggataaactcgtgcccacgatcagggtaatgcggacgaggcgccatccctgggccagttactgggagtggctgagaaaccctggccccgagcataagcaggcggtctgttagcgagatggttgccacgtgttataaagtccctgccgcattcggttactgaacgcggcgcgtgacccgactatacggcaccgagatgtgcgcatgggctag

SEQ ID NO: 496508 - DNA, 220 bp, Homo sapiens
cctatctcttcccccgaccctgtataatacctagcttgggctggctgaaagcctaagtatcctgtatctagggtccgtgaggtaacggcagttctgatgtccaggtactagtaggtaggtaggggatagtagtagtattataggtataacagatagacatagtatagcgagagacaagagcggaagaatacctagagaaataccatatagagatagtacc

SEQ ID NO: 496509 - DNA, 307 bp, Homo sapiens
  misc_feature (40)..(40): n is a, c, g, or t
  misc_feature (92)..(92): n is a, c, g, or t
tgtcatggcagcataatgatgttttggttaaggatggacntgtggtatacaatggctggtcccataatattataatagagcggggaactttnctaccacctgtcatactccacagacaacacattactcgtgtttgtggtgaacctggtattaaaaaccctacggtactgccagttctatcaaagtgtagcacatgtaattctgtgccatatataatacttgatagtgataagaaatgactgtgttgctcgtttatatatttactatattatacttttatccttagagcacactccttctacttatt

SEQ ID NO: 496510 - DNA, 295 bp, Homo sapiens
cgcagtcagtcagtgagagctgaggaggagaatggagtgaacactgggaggcagagtttgcagtgagccgagatcgcgccactgcactccagcctgagcgacacagcgagactccatctcaaaaaaaaaaaaaaaaaaaggagagaaaagtttggccacttctggcttaagggtgattctagaaaactggtacccaggttaaattatagtagagcacctggtgagttacttgaaattaaaccttgcccacaccttcagacattgctcaagggcccccttgggggttcccggcatt

SEQ ID NO: 496511 - DNA, 326 bp, Homo sapiens
acgcattttacttagcgctgtcttatttccagtctaattttacactgtaccagaaccacatggctgctctctggaactatggatcttgaccccctggatatattattttattccaagaaagatcacgtacgtcaaacgatgacaggatacatagacactacatatactagatatctataactgtgctgacttatacataggctagaaatatgtgccagctacttcattgctgtaaatactcttgctgagctctaaatatggcacgaaataaacatgaccaatatcaatacgacttcttgaggctactataagttttgagtacgttc

SEQ ID NO: 496512 - DNA, 186 bp, Homo sapiens
cggctggagtcatcatcagcatcatccacagctccctggctgagccacgcgtagcgtcgggagggctaggcccgtgcccccgctgccaccggaggtcactccaccatccccaccaccaacacaagaaagacgaacgaggtttgaaagaacagtagaggatacatgccccaagatgtcaagagggga

SEQ ID NO: 496513 - DNA, 269 bp, Homo sapiens
  misc_feature (1)..(1): n is a, c, g, or t
  misc_feature (71)..(71): n is a, c, g, or t
  misc_feature (74)..(74): n is a, c, g, or t
  misc_feature (78)..(78): n is a, c, g, or t
  misc_feature (87)..(87): n is a, c, g, or t
  misc_feature (104)..(104): n is a, c, g, or t
  misc_feature (121)..(121): n is a, c, g, or t
  misc_feature (148)..(148): n is a, c, g, or t
  misc_feature (186)..(186): n is a, c, g, or t
  misc_feature (203)..(203): n is a, c, g, or t
  misc_feature (220)..(220): n is a, c, g, or t
  misc_feature (234)..(234): n is a, c, g, or t
  misc_feature (237)..(237): n is a, c, g, or t
  misc_feature (243)..(243): n is a, c, g, or t
  misc_feature (250)..(250): n is a, c, g, or t
  misc_feature (259)..(259): n is a, c, g, or t
  misc_feature (264)..(264): n is a, c, g, or t
ntcctcctcttcaaattggcttgaatcttctctgaccccccacgagtgcagcacagtctgggaagaaaggngtnaggntggtgaagntgaacagtaaccccagngagaagggaaccaagcngccttcagttgaggatggcttccaganggtgcctgtgatgagtgggttggaggttaatgacttanagctgcctggtccaganaaggtgattgtgaaganaagaagggaatatnagngggaanagaagancaaagggangttcngggtg

SEQ ID NO: 496514 - DNA, 245 bp, Homo sapiens
agtgtttggtggtgcatgcctgtagttaccagctactgggagggctagtggcatggaggatcgcttgagcctggacggatcaaagccgcagtgagccacgacagagcaagaccctgtgtcaaaagagtagatactccatccatgaaaaaaaatcgatacttttccaaagagcccttggaaattatacttaggacaatttatcagaaagaataaggaatcaaagagatggtaacagaataaagaag

SEQ ID NO: 496515 - DNA, 118 bp, Homo sapiens
acggaggaattgctcagccccagcaactacagtctgggatgcaaggccagccatgatgacagtggtccagcatggtcaacctttgaacattgctccacaaccaggattgggccaggta

SEQ ID NO: 496516 - DNA, 364 bp, Homo sapiens
cgatggcatccatctgttagataaatacggttttctgggcacacacacatgcacattgtaacatactgtctatagctgcttctgctacaactgcagagttgagtagctgcaattaagagtgtataacccacaaagccagaaatataggctatctgggcctcgacaggcaaagtttaccaatccctggaatacctgaaacgtgtcacttaccactctgggaggaaaccaggatggctctgaggcatctaaagcagagagtaaggcatgggcagtatccttctcaaaagagggcatatcggtcccttaccagcatcctcaggctgggatcaggggccccagcatcacagcctgagcaggagagcct

SEQ ID NO: 496517 - DNA, 1215 bp, Homo sapiens
tgtaagtgttgagatgggtttgtgttttatggattgtgtcatgtgaagtttgtttgtcacattttttgatttttgtactgttgttgtctgtataagtttttgatgttggagaaagggtttagttgctgaatgataaaggtatgaagtgttcgtaactttatgttaaagacgtttacagtggtgttgtatgaaatctttaatctcttatcgtatggttaatacatggccttgtccgtgtattctgtgatatctgtatacatgtttacctttgcggtttcttgttggggcgcttgctatcctgtggtggctgggtttggtgggtggttgcggtgcgggtgtagtctttgtgtgttaggttgtggtctttggggttgggtgcttgtaggggcgtcggtgctgatccctgcgtttggtctctgttttggtgccgattatgtgtacataggacgcgcgcagggatcttttggttacactggttggaggggttataggagttccttgagggtattatggtcatggagtctgtctcacatagctgatcgtgtcaagtagtggcttaggtgacttgggtagtgctatttattttgatgtgaataagagtgttatgcactgttggatatattgaagtggatagtagcacatcattaggctttatgtactgtgtgtgtggttgtgtgtagtgtaagtacagtgatgtgttagttgtacagatgtgtggggtttgtgttttatgatacattagcagccttatgtgatttgttggtttatggacatagctgccctttcattttgttttcgttttgccagtgtcttacggtgagtctcaaattaggaaatgcatttaaccagtgtaatatagatgagtgctagaagtatagcgtgttgttagggccctttgccagataggtagtcagttcaatgctgggtattgattcttttcagctaactaaccatgaatctgagaaagcgtttatatatagactgatgatgcagcataacgagcagagtttgcataaatattaccatgattgctttatgtttatatttaacttgtatttttgtacatactagattgtgtaagatatatgttgaagtttcagtgatttagacagtctgtccaagcttgttcatgatttttatgagcacagacttttcaactataatatcttgtctattattacataacaatctgcccataatcagcttatgacgccc

SEQ ID NO: 496518 - DNA, 271 bp, Homo sapiens
tgaactgggttaggtgccggtggtgataatgtggtttaatatacaaccgaagccagacatgggactggaggacaaacaaaaaatgcttaccgaatccggagatcctgaggaggaggactgaggattatgaggaattatggccactactgagggtttgaaaacgtacttgcatcctttgaaggcgggaacgtgatacttttacctactgcttagcatctgaaaggggttggggaccggattctgccatttatgaagttatgtggttctacca

SEQ ID NO: 496519 - DNA, 1223 bp, Homo sapiens
gctggatcgccgagcgcgagtgagggagccgagccgccgacgcgccgcctccgcctcccctccgcgaacaggagcccgggcctggggcccggaacgccagccccagcccagtccctcggcgtcaggccgcgagggtagctgcgcgcgaagcgagcgagggggagggcagagcgagcgagcgccgggcaggaggcggacggaccgagcgggccgcccgagcgttgatgagcggatgacgggaggaaacgccctgcttgcaccggaaacataagcaacaacagacgacacagacaggcgagagtagaacaaagcaaaagagcaacagcaagcagcagaaaccaagagacgaacgagagtcaacaacaaaacaaaatcacaagacacaagcaacagaggagacaagcgaaacagaagaccgacacaaggacgaaaaaagaaggacagaagaagggagaaggaaccacaaggcagcgaacaaagaagcagcagagaagccgaggagaaagagaaaaaagcaagaagcacagaacacagcgaggcgaggacaggcgacagaaagctgaagcagaaaccaacacagcaccggagacacaacaaaacggaaagaagacaaggaaagcaaaacagagagaagagaacaacaacaaggcaagaaagagcggcgaccgaggacgaaagaaaacagcaacgaggaacacaaacgcacagaacacaaggacaagacgagcaaagaacaaaagagacaccgagccgacgaaccgcgaggaaggagggaaacgagcaaacaggggagaagcaaggacgaaggcggaaagcgggaagaagacgaacaggagacaagggggagagagggaaggagggagactaagagagagacgaacaagacagaccacccagagaacacagaaaggaaaaagaggaagaacgaaaagggaagcgagccacgcccaaaaaagacgcccgcgcagcaaacacaagaacaggaaggcaacacaggcaagaagcgaggcaacaaaagaaagcaagaagagagccgacacaagacacacgacaggaaagagacgagggacaaagaaaaaagcacccacagaaaccgaaggacggagagagaggcaagaaaaaaagagagacaggaacaccacacacagacgcagaaacacacagcgacaaagccaaacagggaagaaaacaccacacacaagaacgacagagaacagaccggg

SEQ ID NO: 496520 - DNA, 264 bp, Homo sapiens
acaggggctttttttttgcccccgtgtttgggggggggccccccccccctttttttttccccctaaaaaaacccggggggggtccccccccccggttttttttttgggggggggggggggatactttttttccccggagaacctttttccctttgggccttttttggggcccctttaaaacgtttttttttaaaaaaaaggggggggggggggcggggatttcccgggatttttttcccccccgggccgccccccggggcgcga

SEQ ID NO: 496521 - DNA, 786 bp, Homo sapiens
agcggtaaagttggaagatacaaaatcaataatcaataacatttctacatgccaacagcaaaaattctgaaaaaggaatcaatgtgattccatttatgacaggcacaaataaaataaaatatctaggaataaactcaatcaaaaaagtacataattctcactataatgagaattatgcaatattgatgcaggatattatacgaacacagcacagtacgacacacgacactgacagcagcacacagcacagcacaaatggaaaggcatttcacattcgatggattaggaacgaatccatattgtgaaagatatccatattacccaagagcaatctacaagattcagtgcaattgactatcgatatagctaatgatactcttctgcaacatgtgaggacaagagatatttcttagagtgtctatgaactcacgaaagacccagtatatagccagagccaccctgagcagaagagaacaaaactggcaggagtcacattatgtgacttgcatagttgttctgcagagctatagtaatcaaaatagcatggtactgacataaaaacagacacacaggcctgttgggaacagggccccccgagaacctggccatctgaactggcctcagaaagtgtcctatagagaaaggatctctgcagcactgtgatatgtgcgtagatggccataatgcccatgctagaaggttgtgggcttacttggaatgagggcaagaacatctggcccacctgggtggaaaacggcttaagggcattcttagactacaacaacg

SEQ ID NO: 496522 - DNA, 140 bp, Homo sapiens
ccacgcgtcgcaaaccttacggccaacgtttcttctagtatgatggacagtttctttttgtctttgctctgaataaaactgaactgtgggttctcaaaaaacaaaaaaaaatagaaatacgaacaagacaagaagcgggg

SEQ ID NO: 496523 - DNA, 282 bp, Homo sapiens
  misc_feature (5)..(5): n is a, c, g, or t
gctantgatggataaataggatggatggataggataggatggatggatgcactggaagtttggatgatggataatggataaatggatggatggatgaaggaataaatagtgtttcatgctttattgtggcttcaccatatgctagcgcttactgccatgttactcccttctttccatctcccacatgccagagaaactccagagtgaactatacccaaggattcaagagcgtgtataagggttccctacattctcatctacaccctacctacccatacccat

SEQ ID NO: 496524 - DNA, 179 bp, Homo sapiens
gcacaatgttggcaggtggtcttgaactcctgaacccaggtgatccactcagctgggcctcccaaagtgctgggattacagtcttgagccaccgtgcccagactaaaaagtagtttgcgtaatgtaactatataagtagctaggtaatttattacaagaaccctgttcaattctgcagt

SEQ ID NO: 496525 - DNA, 177 bp, Homo sapiens
  misc_feature (36)..(36): n is a, c, g, or t
  misc_feature (75)..(75): n is a, c, g, or t
aattgtcctaaccatggacataaaacagttgtactncccttgctactgtgtagaatcactttgcacttaattttncccccagatcacagggggatacctgacctgtttttcaaagtgtttatttactgctgttactatttgattagaatgtattaaataaaaaaaacctgattttct

SEQ ID NO: 496526 - DNA, 105 bp, Homo sapiens
tgtagctcatctggtagaattctttttattaatatgtagcagagagagtctcagtcgtgtcacccaggctgaagtgtggtggtatgatctacagatcattgaagg

SEQ ID NO: 496527 - DNA, 565 bp, Homo sapiens
cattcgatgggcgggcacttaccaagcggtgacagagaaacactccgttatatggaggcttcagttaacagtaactgctgaacaaatagaaaacatgtaggtgatagatttcagcaccatctgttagaagatagtttcaaaatgcatacaccccctaaattcacataaacctaggaaatttacccatcattccctctgcatctacaccaaaaatcaagagttctgtactcgaactaccctttccgtgtgccaaaaataagaaatatttaaaaatctatccaattaagttaataggacacaaacatgttccccaaaaaaggagggaagttaccaatcaagcatgatgtgtctaaagtacaaacttagggagtttctctgaacctactctggttcaaggggctgcaaaaaatacacatttttaatacactggtacctattattcgatgaaggctaaattacaagagatttaccaatttgaacctcataaggttactgctaaatatactttaaaaagtcatctaaaaaatgttttagaaatacaacagaatagctgatagaaaaaaaa

SEQ ID NO: 496528 - DNA, 160 bp, Homo sapiens
tctttttttcccgggaaattaaatttaaattttcaaaaaaatgggggtttgattgaagcccctttaaaccctttttggggatgccccggtttttaaataaggaaaaaaaaaaacatgcccagctgggcatggggccccaaaaaaaaatttgctttcctta

SEQ ID NO: 496529 - DNA, 256 bp, Homo sapiens
ctaattggttcttcgatgacgcaggcatagagcagagatatcaaagtagacaatgacgattcagtgcttcaataggatgacactgtctgtgacctggaggcaagtgcctatctcatttctacatgcaagattatgtcctggtcagtgtttcacttctgatgacatctttgagaaaattaaccataagagaacaggttggtcaaggactgaggaccaagtaaataattaggacgtccgtcatcgaagaaccaattag

SEQ ID NO: 496530 - DNA, 103 bp, Homo sapiens
gagcgagtctccatatcaagaaaaaaaaaacaaaggcttaagagtcaatgtggaataaacttgatacttttggcggctttctggaggagttttaaggtaggcg

SEQ ID NO: 496531 - DNA, 763 bp, Homo sapiens
  misc_feature (20)..(20): n is a, c, g, or t
  misc_feature (84)..(84): n is a, c, g, or t
  misc_feature (88)..(88): n is a, c, g, or t
  misc_feature (104)..(104): n is a, c, g, or t
  misc_feature (117)..(117): n is a, c, g, or t
  misc_feature (128)..(128): n is a, c, g, or t
  misc_feature (131)..(131): n is a, c, g, or t
  misc_feature (133)..(133): n is a, c, g, or t
  misc_feature (233)..(233): n is a, c, g, or t
  misc_feature (250)..(250): n is a, c, g, or t
  misc_feature (300)..(300): n is a, c, g, or t
  misc_feature (318)..(319): n is a, c, g, or t
  misc_feature (451)..(452): n is a, c, g, or t
  misc_feature (456)..(456): n is a, c, g, or t
  misc_feature (483)..(483): n is a, c, g, or t
  misc_feature (525)..(525): n is a, c, g, or t
  misc_feature (644)..(644): n is a, c, g, or t
  misc_feature (653)..(653): n is a, c, g, or t
  misc_feature (658)..(658): n is a, c, g, or t
  misc_feature (661)..(662): n is a, c, g, or t
  misc_feature (667)..(667): n is a, c, g, or t
  misc_feature (673)..(673): n is a, c, g, or t
  misc_feature (690)..(690): n is a, c, g, or t
  misc_feature (693)..(693): n is a, c, g, or t
  misc_feature (696)..(696): n is a, c, g, or t
  misc_feature (720)..(720): n is a, c, g, or t
gaggtgattcagataaggcnacagttagggatccttctttcccctatacatacacagacatacaaacacacgcacccgggtgantganagggaccatcaggggncagattgaagggnagaggggaggnggngncctccgagagttggcccggacccaagggtgggctgagacctgggccagggggagccgttccgaggggttatgcctgagcagtttggagatgaggtcctgngctcccgtgggcacggnagcggggaactttaggtccacccttgacgatgcggcgataggtttttttntgtgatgcactcttaaanngtgggcttccccaccagcagctcatagcaaagccctccaatgcaccacagatccaccttctcattgtgcatgcgcccctcaattatctctgggggcaggtagtccagggtgccacacattgtgttcctgctnngggngggcgcatgcacagaccagccgaagtnagcaatcttcagctctcccttgagccctaagagcagattttntggctttatgtctttgtgaattatcttcttcccatgggagtacattagagcatctgccaactcctccatgatcgtggctgttcgctgctcgtcaaatgtgcagctcttctgcagctccntgtagagcnccccncgnngggcntactcnagaatcaagtagatccnccnccngtcataaaaatagttgtagagacncaggatgttgggatggccatactgcaggtgggcctggatttcg

SEQ ID NO: 496532 - DNA, 177 bp, Homo sapiens
ctatcaggattggtagcacaagagaacacttaacagatgagagggatgagatctgtttatttttctcgagtgtgctttctgggatacccaagggattaagctctttaaatctgccccaggaggcggggcatggtggctcacacctataatcccagcacttgggtaggccaaggcagg

SEQ ID NO: 496533 - DNA, 162 bp, Homo sapiens
gattaaggatcccctggtgctagtgtagcaggatgccttgaggtggcctccgaagctgcttcacacttcttgagggggcgtatttggcaggtttttctagacgcaggtcaggtcacactgacacgttggtagtgggacacggaaagccatgccagtgagctt

SEQ ID NO: 496534 - DNA, 373 bp, Homo sapiens
  misc_feature (87)..(87): n is a, c, g, or t
cagggtggagcatatggacaagccatccccaccagcccctgagacatgtgagagaggccagaacaggccatccggaccccactgtgntggtggatgagacagcagaaggaatatcaacctaccaacagaatcctgagaaatgctcactcttacttcaagctgctgcattttgatgttatgaaaccataaataacttatgaagtcatctttgctgacttaaagttttccataactttattataacatatcaaaattatgaaaaatgtgaaaagtagaaaactgatgaattttgcttcttcatatggtctttaagaatctcaaaggcactgaagttttttatcttttctgtcttagaataaaaaaccttgaatga

SEQ ID NO: 496535 - DNA, 108 bp, Homo sapiens
cgcatctgggaggtgacggtgagtagccaagatcatgcactgctttctagcctgggtgacagagggagactctgtcttaaaaaaaggtgcctggcatgtgataagaac

SEQ ID NO: 496536 - DNA, 134 bp, Homo sapiens
  misc_feature (35)..(35): n is a, c, g, or t
atgagtggtgggcagtacagctagtcaccactacnaaaatgctggggcatgcttcctggctgtaagaacagttactggtgagtggagaccgttggtacccaccacatgcctcttgccccaccattggcctcgtg

SEQ ID NO: 496537 - DNA, 145 bp, Homo sapiens
  misc_feature (127)..(127): n is a, c, g, or t
gtcacatgaccatcgcctaaaaaataaaagagcaaaaatgaatcagtgcaaccggtatacgaaaaataataattatttataaatagggaaagggaaagtttactttttgccaaaactggaggcagantgtgtcatgggacgggtt

SEQ ID NO: 496538 - DNA, 430 bp, Homo sapiens
  misc_feature (79)..(79): n is a, c, g, or t
  misc_feature (90)..(90): n is a, c, g, or t
  misc_feature (389)..(389): n is a, c, g, or t
  misc_feature (404)..(404): n is a, c, g, or t
actattccatggaatccccatacttgtgaaatttacccctactttcctaaaaatgtattttgtaaagcctaaaaaatcnaatatatatgncccttttcaagtccattccatgggcatgtacaaagaagcaaaaaatttgaagtcactcggctgggcgcggtgacatgcctgtaatcctagcacttcgggaggccaaggcgggcaggggcagatcacgaggtcaggagattgggaccatcctggctaacacagtgaggccccatctctactaaaaatgcaaaaaattggccgggcatggtgcaggcgcctgtggtcccggctgcttgtgaggctgaggcgggagaatggcgtgaacccgggaggcggagcttgcagtgagctgagatcgngccaccgcactccancctgggcgacagagggagactgtctc

SEQ ID NO: 496539 - DNA, 595 bp, Homo sapiens
  misc_feature (2)..(2): n is a, c, g, or t
  misc_feature (77)..(77): n is a, c, g, or t
  misc_feature (158)..(158): n is a, c, g, or t
  misc_feature (234)..(234): n is a, c, g, or t
  misc_feature (241)..(241): n is a, c, g, or t
  misc_feature (287)..(287): n is a, c, g, or t
  misc_feature (404)..(404): n is a, c, g, or t
  misc_feature (407)..(407): n is a, c, g, or t
  misc_feature (412)..(412): n is a, c, g, or t
  misc_feature (419)..(419): n is a, c, g, or t
  misc_feature (441)..(441): n is a, c, g, or t
  misc_feature (470)..(473): n is a, c, g, or t
  misc_feature (487)..(487): n is a, c, g, or t
  misc_feature (593)..(593): n is a, c, g, or t
anaacaagataataaaatagcgtgcactttatttaaaaccaaccaagcactgataaaaaatatatatcactgcagcngtaattccacatcaaacctgaacagtaagatttgggcatttattcttcacatcatgtgccaagcctggcagagaaggacanccacctccactagagcctcaaaggaaaagtggcccctaaccaccaagacagggtaccctggtggagaggggcagcnggcagcncaccctgctctctgcagagcacgtgaagggaaaggagcggcctgtntccctcccgggctgccggggtgggcactggtcagccactccttctcggtttcaggttgtggagcgatggggagagaggtgcatgctgttgttcagataagggggtgggttctccctnctnttttngggtttntgatacccccacagggcatatnatgcccagcaaggtcccacttgcaggggnnnncctcctaagcagcngctatcttttgctttggctgatggggaatcaagattctgagagttacttctcttttcttgacaaaaagcagcaacagaacactttcctacatacagtttggcagcngg

SEQ ID NO: 496540 - DNA, 595 bp, Homo sapiens
agcccagtttaggattttgacctttatcctaaaggaagtggtacaccatgaaggaagtgtcatgaacaaatttatgttttaaaaaaatttctctggctaatgtgtggaaaatgagtttatgtattagaaaatatggtagacgtaataatggcctcctaaagatatccacatattaatacccagaatctgtaaatatgttgttacatggcaaaagggaggtaattagctaatcagctgaccttaagataaagagattaccttggattatccagggggccccaaagtaatcgcaagggtccttaaaagtagaacatggggacaaaagacatggagtgactatggaagaatggtcaaagagatacaacatggctgactttggagatgaaggaaggaggtcacaagccaaggtatgtgggtagcttctagaagcttgaaaaaccacggaaatagattctctcatacaacctttagaagggaatcaaactcaccttgattttagcccattgagatgcatgtaagatttcttcagaaatgtaagaaaataaattagtgttgtttttaagccactgcgtttgtggtaatttgttctagcagc

SEQ ID NO: 496541 - DNA, 171 bp, Homo sapiens
tatcgcaggcttaggctcgactgtggtgcgactagaaagaggccctgttgcgcttctgtgtcacgtggaacaccaatctcgcggcactgccacgaggcccaggccgtgctgggtgtgctcttgaggctgagaggcccccgatggacccgctgtgcctatcagcacatgcct

SEQ ID NO: 496542 - DNA, 600 bp, Homo sapiens
agcggaacaggcaagatggcggcccatcaccggacagaacacagcaggcggaggaaagtgcaggtttcctatgtcattcgagatgaagtggagaagtacaaccgaaatggagtcaatagctactgcagctggatccagcactaaatagacttatacacagaccggtcgtagactctactcataagaatatggacgtgtcaactcagcacgacgccaagatccatatactagcatctactggaaccaccataactagatctggcgctcacacgaccacttgcacctctagtctcgtcaactcgcggcaaaacaattaactctctcgcttacttcctagacaacgaccagcacacacccgtactaggcaaagcacacccacacggggccactatccggcacctgtacacaacaacatttcaacagggaacaccaactacacaacgcgcacttaacaggcttccaaaaggagcccattaacgccattacgtgccccccacgcgcgaattaatacatcgaaacgttacagaacgaccacatcacacgacttggagatcacggcaccaagacaggcacagtacttacgcccctcttagccgaaca

SEQ ID NO: 496543 - DNA, 961 bp, Homo sapiens
  misc_feature (790)..(790): n is a, c, g, or t
gatattaaccacatttccgtaagaaagaaaaagggctcgctttgttgacttgaggcatcatctcagccgacctcaacgtgtaaacatatgtgatgtaaataggaaagattacttcctcataggcgattactcttcttctgcacaattctatgttacctttgcagtctttgtgttcctgtactgcattgctgccctctgctttatgttggctacacgagtctgtatctggatagtcgcaaacttcctatgatagactatgttgctacactttttgccacttttttgcggctggtgagcacttcagcctgggctaaagctctcaccgatattaaaatagctcctgaccacaatattattgatgaacttacgacttgtaagaagaaagcagtactgagtcacttaggctttgtgaccaagatggcatccctaaatgtatctatgatattccgctctctaaatatcatcctctaggccaggaaatgccagctttgtgtacaaacgagacagtcctaccgatgcattatatacaatatccccctctcgtccaacgcaggataccccctcgtaccggactctaaccagagggagaacaacacaccgaatgaactatacgctagaagctatcaactcgtctccaacactctttacagccatttatagacactaaaacaaccactagcctgccctatctatatacccacgactgacatcatcgtcccctgaaagggtaatttaattgcaagatattttatgttagacactttactcccctcatccctaccttttcccntacctccccaaactatgaaacaatcataccactcaaagccgtataaagtgtcactgatatcaattaacattaaatacctttattttgaaaacccattgagatccctaaagataattcgagcctttaattatcacaaaacctcaaacccaaaacaaccataagactcgcatg

SEQ ID NO: 496544 - DNA, 980 bp, Homo sapiens
  misc_feature (13)..(13): n is a, c, g, or t
  misc_feature (888)..(888): n is a, c, g, or t
taatcgtcattcnctttaataatagataatcccattgtccttcaaccgtctgccaatcaactctctgtgtgggaacaccaaagtttcgtgattaccagaggttccaagtctctaacacaccctgttttaacccatagggcaccctgccctatgtctacaccaccccccctgtgtttctatagccacccgggatggcgtctccaaaaaagcgctgtttttcacaccaggtgccctgtgagcccacacgaagctttcacctccttaggaaaaccctcaggcgcttcaaacattaagtcccctctccgcctctcgcccggttgttttaggccgcctattctccttgcgaagcctattttcgccgggttgttcgggcttctcctggtattatccccacccccaaaacaactgctggtggacacactcctccttccttctaagaaagacagctgtcgtaatccacactcaaaaggtcttacctacgtcataggaccttcctctctctaataccaccgccgttcataaatatgtgtcatgctccctcccatctcctccttgaatgacatgttcttggcgtacactattctccagggcaccacccactgtgactccgttctccccaggagaagaactcctttatcgctacttaacaagagaaatcatgaataacatgttctaaatctttcctttcaaactttacaacaattacattcttattgtctttccggataatctctgtaagccccacactgtttctcctcctttcggtatccccttgatttcagtccactaatcctccccctcgtcctccccccgaccacacctgtcgccccaatagaccccttattcatgactcagcaactactgtcggaaggtgtctccgccctccgntaacgacaccaagctcatttcgttgttcaggtgagttcgaaaaaacgaccgcaccatcttcgaatagcaacacaaaaagaaaacatcacaag

SEQ ID NO: 496545 - DNA, 510 bp, Homo sapiens
acgctgaactatgtgaagctaacatacaatatatgtttaagagtccagatgtggtggcacacggctatcgtcccagctacttgggaggctgaggcaggagaatgtcgtgaacccgggaggcagaggttgcagtgagccgagattgcaccactgcacgctagcctgggcgacagagcgagacttggcccccaaaaaaaaatagtttcctgaggaaaaaaaaactttcaaaataatactaaactacccgtttatgtcacaggaacatttatttatttattttttttcttttgaggaagcacattgtataccatgtacggggggttgtttgctcacttttattataatatttttattaatttatgtacgtactaggttcagggggtacatgtgcaggtttgttccatgtgtaaattacatattgctgaggtttggtgtatgaatgatcttatctcccaggtagtgagcatagagtttttcatttcacattccccctcaccctttccactctag

SEQ ID NO: 496546 - DNA, 592 bp, Homo sapiens
ctgaacattgcagcatggagccgttcctgatttatggatttttggttgctgccagagaattacacactcatccaaaaaacaccaaagtagaatatgtaaggtctgagatatcaaaaaactcaaactctgcgttaactataaacatgatcatttatgaaggtgcggaagaacatgctctcccaaaagatcaagagtacgcatatgttgttcgtgactcatcgcatcaacggtcaaaatcacctcatccacaccgcgggattcaagcgctctgagtgcgactataatatcatcaggtgtaccaaccatgatcgatgggctgagctctatgagtttgtcaagggttcgcttatattctacaatacgttgaataccggcaaagtactcataccgtaggttccttagccaatggcaaataaatatccaaaatgaactgaacataagccaaggctcgcattcttacctcagccaatgcaagttgctcgatcaagctgccaatgaaaaattgggacataataaccatatgaattattcacaccgatcattaactgggagttgcgctttctaatggatcgcggtaagcgcttatacactc

SEQ ID NO: 496547 - DNA, 426 bp, Homo sapiens
  misc_feature (1)..(1): n is a, c, g, or t
  misc_feature (12)..(12): n is a, c, g, or t
  misc_feature (19)..(19): n is a, c, g, or t
  misc_feature (99)..(99): n is a, c, g, or t
  misc_feature (337)..(337): n is a, c, g, or t
  misc_feature (367)..(367): n is a, c, g, or t
  misc_feature (413)..(413): n is a, c, g, or t
nccgtcaatccnaggtttnaaaagccccaagaaatgcaattaaggtaatttgcccctaaaaactctcccctcccccttcccccctactccccccccaanaggcccctggtatgtgatgttacccctccctgtgtcccctgtgttcctcaatgttcaactccctacttatgagtgagaacatgcggtgtttggttttctgtttctgtgttagtttgctgaggatgatggtttccagcttcagccatgtcgctgcaaaggacattaactcattcgtttttctggctgcatagtattccatggtgtgtaggcgccacgttttctttatccagtctgtcanttgatgggcatttgggttggttccaagtcntttctattgcaaatagtgctgcaataaacatatgtgtgcatgtgtntttaaaaaaaaaa

SEQ ID NO: 496548 - DNA, 257 bp, Homo sapiens
tcccaggttcaagcgattctcctgccagctcagtccagctcagcccagcctagtccagcccagcccatcacaggtcagcccagcttagcttagcccaggtcagtccagctcagctcagtccacttaagctcacccaggtcagctccgtccagctcagcccagcctagcccagcttagcccagcccagcccaacacaggtcagcccagctcagcctagcccagcccagctcagcacaggtcagaccagctcagtgcag

SEQ ID NO: 496549 - DNA, 689 bp, Homo sapiens
  misc_feature (481)..(481): n is a, c, g, or t
aaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgctgcagacatattcccttgagaagccatttggagaaagcccgctcaggcgtacaggacccaggctcccttcgcagactcttgacgaaggcaccgtcaagtgacctcgaagcaacggagaacgttcagcgctcaagcgtgcgcantcgtacttcctggcaggcagcgcatgcaagcagcacgtatgcaggccagaccggcgcggcacatcgtacaagcggcaacacgtgagctgacaggtcgaacgtggcagagccttgaaacgcagaactccaggacaagaaacagcatctggcataaaacatgggctgatgtggagaatctcaacagtcagaatgaagctgagctccgaac

SEQ ID NO: 496550 - DNA, 340 bp, Homo sapiens
tcgatatggcaagtactagttgagcaaagtgagaaagatctttggtgggcacaaggaggaatcgcgtcatctggtgatctcatgatgcccgcatccatccggtaccccgatcccctcatcaaggtgagtgataccattcagattgatttatcagactggccagattactgatttcatcaagttcgacatctggttacctgttgtgtggtttgtttcgtgaaacctaggaagaattggtgtgatcaccaacagagagaggcaccctggatcttttgacgtggttcacgtgaaagatgccaatggcaacagctttgccactcgactttccaacatttttgtt

SEQ ID NO: 496551 - DNA, 393 bp, Homo sapiens
tgacatgcaagaacattgagccacctagagttgcaccagtgggactctgcttaccactttctaaggctgaagatgcaggggaggaaatagtgttacccggagcacagatatgtgcagagctggcagaggatggcgaccatcttgcaagagctacagctgtgcagtgaagctgccactgtcaaaaccacagagccctcttaacattgcttaagctcgcatcccagactacttatcgttatgttgtggctcttagtagtcattctagttccaaataatttttagaatttctgccttaatttcattgtttacccaaaagtcatacaggagcaagttgcttgtacccgctgagcgaaacaggaaagcagagccattgccttacctaaggctaccaga

SEQ ID NO: 496552 - DNA, 114 bp, Homo sapiens
tggacgcggctcgtcccagccctctagctgacggccctcgggggtctcctgatcgcggcggtacttgccggagagcaggccgccggcgagcgggctccagaccagaaccgagca

SEQ ID NO: 496553 - DNA, 539 bp, Homo sapiens
gaaggcggctggggagaaggtgtactgatgtgccgggaccaggctcggctgggctgcgcagccgcgccataacccaggtccaccgcatcatggtcatgcgcagcactgcatcagcctgacctggcaggcctggaggccttgagggaacgggagcggtcccaccacggccagcaggaggacccagacaagattccagttcagcttgtgctttcaagaggtgttcctcctgaaaaggccagcgatttatgggggacatccaaggaccgtcaggactggactgggagtcccagtgaagccatgtttggcagaggagctccgagccgccaccaaggtgtttccaatccacgagggacttccattcactatgttggtttacgaaactcttgtcttcttcaagcgtcgagggtcttgggtccctcggggtcccagggattcgggtgtgtctcatctcgcggaaagtcaacggctacacgtttgcgggggctcctgtaaaaagcgtgcgctcgtgcacacactttcacttctctaggtcagagtgt

SEQ ID NO: 496554 - DNA, 393 bp, Homo sapiens
  misc_feature (153)..(153): n is a, c, g, or t
  misc_feature (222)..(222): n is a, c, g, or t
  misc_feature (267)..(267): n is a, c, g, or t
  misc_feature (307)..(307): n is a, c, g, or t
tatatatgcacccaacacaggaacacccagattcataaagtaagttcttagagtacaaagaggctcccacacaataatagtaggagactttaacacaccactgatagtcatagacagatcatcaaggtagaaaattaacaatgatattcaggntctgaacccaacattccaccgaatgagtctgatagacatctacagaactctccatccaaaaacaacagnatatacattcttctcatctccacatggcacatgctctaaaattgnccacataatgcctttcttttcagtggtccatatgtaaggnttttgaaagtggcagcatctctactgctcatgcttgttgcaagggactctactggaatacaagggcttttactaatctctaatgct

SEQ ID NO: 496555 - DNA, 276 bp, Homo sapiens
cttgattatttgagatagggcgaacaaccttcccagtttgcctgggactgagagattctcctgaacctgggactttcagggctaaaaccggggatatctaggggaccgatgggacaagtaaggtcgccctaagttgactagtgcgcagaggaatcacaggaagtcaggaatcagccgggcacaccaacagggtgacggtggccaggatcagcctcctggatgatccaccccatgtgtagacctcagcacccacatgtgctgctcatgaaaaggcgc

SEQ ID NO: 496556 - DNA, 578 bp, Homo sapiens
  misc_feature (578)..(578): n is a, c, g, or t
aaagcagccaggagggaggctgtactctgcaaagccacaggggcggagctgcacaagaccatgggaacctatctcttgcatcagcatgacctgaatgtgagacatggagtcaaaggagatcattatggagctttaaaatttgactgccccactggatttcagacttgcatggaccctgtaacccctttgttttggccaatttctctcatttggaacagctgtatttacccaatacctgtaccccccattgtatctaggaggtaactagcttgcttttacaggcttgtaagtggaagggacttgccttgtctcagatgagactttggactgtggacttttgggttaatgctgaaatgagttaagactttggggaactgttgggaaggaatgattggttttgaaatgtgaggattatgaaatttggaggagcccaaggaggaaagatatggttttggctgtgtccccacccaaaatttaaactttgaaattgttatcttcccacaaatttcccacatttttgtggggaagggaccccattggggaggtaaatttgaattaatgggaggccccgttttttn

SEQ ID NO: 496557 - DNA, 253 bp, Homo sapiens
gatctaccagatcccaacaacttcgtccattgcgatttgcaacaacttcgtccatcaggatctctcggactcgcggcgtgtggtggttcggcgtgtgcagcaacaacttcgtccacccggacctccgaaaatccaaaggctttaaaagcgcatagtgtggagcttcggcgtgtgcatgcacacgccgaataaccatactgcacacgccgagcaccgcttccacatgagcaaatccggatggacgaagttgttg

SEQ ID NO: 496558 - DNA, 111 bp, Homo sapiens
gaccagttaagtcgggacgcgcttcatcccctactgcctacccctactacgccagcgccttctccatgatagctggggctcttcatcttcagacatcgtctatcttgcaca

SEQ ID NO: 496559 - DNA, 484 bp, Homo sapiens
  misc_feature (76)..(76): n is a, c, g, or t
  misc_feature (82)..(83): n is a, c, g, or t
  misc_feature (86)..(89): n is a, c, g, or t
  misc_feature (91)..(93): n is a, c, g, or t
  misc_feature (95)..(95): n is a, c, g, or t
  misc_feature (103)..(103): n is a, c, g, or t
  misc_feature (116)..(116): n is a, c, g, or t
  misc_feature (118)..(118): n is a, c, g, or t
  misc_feature (140)..(140): n is a, c, g, or t
  misc_feature (180)..(180): n is a, c, g, or t
  misc_feature (209)..(210): n is a, c, g, or t
  misc_feature (259)..(259): n is a, c, g, or t
gagcggggcggaggccgagtgggagtgtggaaagcgccgcatcccgggtgggaggcgaggcttcccataccccgcnctcccnnggnnnncnnncnctgccagnggcttggcagatngntaggagcacggcggggggactntccccggcagagctggagctgggctctggtgcgcgcgcgngtgtgccgaccgagccggagggactggtnnggttgagagagagagaggaagggaatcccgggctgccgaaccgcacgtnctagcccgctccgctcctgcagggcagactttcgtgctctctgcgcgcgaagccgagtcccgggcgggtggggcgggggtccactgagaccgtaccggccctcggcgctgacgggatcgcgcggggccgctacccgctgtaaggcagcccggggccgtggccggacttggtcctgcgcagtcgggcgctggggcacgcgcagcgggaggaaggcgagaggtgctg

SEQ ID NO: 496560 - DNA, 165 bp, Homo sapiens
ggaaacaaacgacatttatgtgcaatggatgtgtagatagttgcatctcatccaaaaaactagagataacagtactcagctacatgggctgggagaataaaatgtgataaccacaggccgggtgccgtgggctcatgccctgcaatacccagcactttgtggaga

SEQ ID NO: 496561 - DNA, 378 bp, Homo sapiens
ggatccccgggcacgatctttgctgtggctgtttctcatcacctttcactactcatagggtagctagagtacatttaacagcctgcttcaactgtagaatttataagagtgggaatctcatctgatctttatacctaatttttagatgcagattagcttctaccatattatcttgatttgcatgccatattcactcttagaacaactgatttagtacagtcacttgactgagtacagaatttcttttttaaccactttacatatttactcctgtacacagactattcaagataaacatcatggtttctttaattgttcagacgtcttagactagacttgacttttgggcttcagcaagatgtggaaacttttttataa

SEQ ID NO: 496562 - DNA, 958 bp, Homo sapiens
  misc_feature (206)..(206): n is a, c, g, or t
ctccagtgagggcgcgagtggctggtggtgggccagcttcgatgtctctgtcctcttgacaagtggtggtcgggggacattgagcacaccgagtcccgcaggctactgctctgccgaacaagaacccctgcatctgccaggcacgttcgtaatgtatctatagtctggctgatgccacaatggagtccaggggtctctgcatctgntcacacaggctggagtgcatgtggtgtgatctatgggcgtcatctgtaacctccaccgtcgctcgtggatgctagatgtgattcatcatgccttctagctctcccgagtagcatgggatgtacaggtggtgacgtatccaatggagtgactccgtccggaggaaaccatgactccccagtcgcgtgctgcggacgacacgtgttcctgctgagtctgctcttccgtggtccaaggtgcccacgggcaaggggccacagggaagactttcgcttctgcagctcagcggaaccatgagcaccacaggagcaggctccagtacaaagcccacaccagaccatgcgcatctccatcgagaactccgaagaggccctcacagtccatgcccctttccctgcaggccagccctgttcccgattccttccctgacccaaggtgccttctaagcaacttctgcctctactggtaaccgagcatgactgggcgaattacagtctcctctaggggcaagacgtgacctatcatgattgaggtgacaaaaagccacttaggcctctcggattccaggcacaaggaggagagcctggcttcagggcccccgatgtgaggccaatcatggtacccccggggggagcctaaaaacacagccggccagggccgacaggttaagcttacactacaaggacgcccacggacgaacaaggcacggggaaggtgacaaaggaccccaggcgacagacaggaaaaccagagg

SEQ ID NO: 496563 - DNA, 892 bp, Homo sapiens
cacacggagcatattttcacctccgctagcataatcatcgctatccccaccggcgtcaaagtatttagctgactcgccacactccacggaagcaagtatgaaatgatctgctgcagtgctgctgagccctcaggatgtcatctttctttgtacaacccgtatggtggccgtgacgtgggaatttgtatgtgatgcgaagactctatcacttagacatcgtactacgagcagagcgagctgatactacagttgtaagctcatctccccactagtgtccctaatcaggatatgaggaggcgggtatgtggcgcatcgtaaagagaggcttcattcattgaatttccccataattctcaggctacaccctaagaccaaacctacagccaaaatccatgtcactatcatattcatctggcgtaaatctaaactttcttcaaccacaacgctttgtcggcctatccggaagtgccccgacggtttactcggactaccccgatgcttacaccacgatggatacatccttatcatctgttggctcatacattgctctcaacgaaggcagtaatattgaataattatcatgattagagaagcgttcgcttcggaaacgacaagtccctaatagtagaatgaacctccagtaaacgctggagtgactatattggatgccggctacctactagacgtgcggaagaaccgcgtattcgatccaatctatgacacaaaggagggatctgatcgcgacaaaggtggtttcaaggcaacccattgggcgcatgacgttttgcttaaaaaatggctccaatagaacagttggggcggctggccgcaaaaggtttcaaaacatggtggggggggggcccaaataagactgggccccagaaaaagggga

SEQ ID NO: 496564 - DNA, 1600 bp, Homo sapiens
taaaaaaagttttactctgtcccctaggagaaaaattgcaggtgacccgagaattgtgctgtggcgtgccctctcttacccgtgggtgtgcacaggtgtgtgagaacgtgtgtctctcaaaaaaaaaaaaaaagattcccctcccccgaggttggggccgtgaaataacccggtgtgttagggacacttgtgtggaaaaaatatccgcgggccatatattatatatgtataacgcacaatatgatgtgtgtgggcccattatacacaagagaggccccggggaacattcctggtatagcgtggcgtgccctcgacggggtgtgtatagcgcgcggttccacaaagagagggggggcgacgaggggggagagagaagcgcggagagagagagaacacacaaggtggggaggagagagaggggcgagtctctcacaccgctgtgagacacacacacagagagaaagtatatctcccactacagaaggtcccagagaacatctctctaccctgtgtgtgacactctcagagaggggcgccccccgaggagagcacagactatacacactatgtattcccccccagagcgtgtcgacacagaccactctctctcctgaggaggggagacacacagagaggcaccactatagtgtaagaaagagagagagagagtactcacacacaagagagagagcacctatgtgggggcccagagggcaccactgggagagaggcgcgctacacacaccccaggcgagaaacctcaccacacaacacattgtttggggacgaagagagagccacgagagagcgcgtgaggggggagcaacacacaccctgatgaggagggagacgacaggagaggagaatatccatccagaagagaccccaccactctctcgtgggggggggccaacccaacataaacataataggcggaacaccctatcaaaacgacagcacagcaccccacatatcactctccgctgataagaccatcgacggggggcgcataaacaaaacacccccgctggggggggacaagacggggacaacttacaacaacaacatttgtgcgtcgccccagcacgataaacgtgtggggtgaggccacacacacacatacagctggtgagaaacgagacgcccgcccgcctatatcccaccaccagagggggggggccacacccaacgacaggacgcgagtgggatacattgccccaccctatcatgaattaccacacgcgatggagagaaaagaggatacacacaaaacagaggataactcggacggaaaacagatacttcctcctcgcacgagtctctctcatttcatcacactctatcatcgacggggtggtactcaccccaaccggcgagcctcttctatccttcctccagacaaaaagaagagagcctggcgaccaagcagtcattctctgctgtgtggttcgccgcccacggagtgtcgagcgtccctctgttggtgaacaactggtgtggggttgcacctactaacccaacaacaatcgtgtggtcgtgtccccccaggattcttactcaccgtgatgagaaatcattcttatcggggtggtgacacccc

SEQ ID NO: 496565 - DNA, 241 bp, Homo sapiens
  misc_feature (76)..(76): n is a, c, g, or t
  misc_feature (105)..(105): n is a, c, g, or t
  misc_feature (107)..(107): n is a, c, g, or t
tagacgttgcacaagatatggttacagtcagaataaccatattataaactggatgttcgggtcttgggacacatcnctgggggggggggggggtatgactacttnangaccaacaattctgcagccaagctacaaaaaagagaaaaggttaaatgagttaagaaggaaaagaccaccagtcttacaaaattacattgtggaacattcaccaattctttaccaaagttgatgaccacctggg

SEQ ID NO: 496566 - DNA, 886 bp, Homo sapiens
ggcccggccccctggtccggacacttggcgggtgccacgaaggacccgcagcagcacgtgcggtcccccggcgttcctgggcgtgttccggcgcgtgtgcggacctctggggagttggggcgtgggggcgggggggtggggcggacatgccggggtgcgcacttggtgcccccctggcatggcgggaaggtggacctgagactccacgatggaaggaggcgaaatcctttctgaagggcctgagtgacaagcagcgggagtgaacattacttctgcaaggactttgtcaggctgaagaagatcccgacatgtgaaggagatgtcgaaaggggtggctgtgaaggtggaggagcccaggtataacacaggacaagcagctcaatgagaaaatctccctgctccgagcgacatcaccaagctggaggtggacgccatcgtcaacgccgccaacagtccctgctcggaggcggtggctgtggaccggcttgcattcatcgggccgacggcccctgttaccgacgagtgcggaccctgaagagctgtaagactggcaaggccaagatcaccggcggtatcggctccggcaagtacgtatccaacacagtgggggccatcgctacgggagccaggcagcaggtgcgagctcgaagtgtactgagcagtctgactgctgttgagaacgggtcgtcggggggtccctgattcaccggtgttggtacccttaagcggcgcgaacgtgtggcaactggaatgtgagagacagcaaaacgcttgaccgtccattaagtcaagcgactgtggtgaccttttcgcccccaagaaatttcgggaaaacaaaacaaaacaaacaaaaaaaacacctggaaagtccctaacgaaaaaaaac

SEQ ID NO: 496567 - DNA, 493 bp, Homo sapiens
  misc_feature (17)..(17): n is a, c, g, or t
tccggatgcagtaagtnaatcgtgtgcggcgaacggcggatgaggatgcggtcttgctgcaccaggctggcaaaggtctgcatgtcgaaattgacgctgatatccgcccgcgcacaatttccaccacgatctggctggagtcgggcaggacgatgggccggttcgacagcgcatgcggggcaatcggcacgagcacgatgccgcccagggtcggatgcagcagggggcgccggccgacagcgagtacgcggtcgagcccgtgggcgtggaaatgatcaagccatccgaacgctggttgtacatgaagtggccgtcgacttcgacgcgcaattcggccatcgccgcaccgccgccgcgcgagacgacgacatcgttgacggccatgcccacgtgaatcgactcgccgtcgccgagcacgctgcgcttcgagcaaggtgcggcgttcggccttgaagcggccaccgagaatttgcgccagcgcgggcacgtgcgc

SEQ ID NO: 496568 - DNA, 103 bp, Homo sapiens
  misc_feature (35)..(35): n is a, c, g, or t
cgtatagtctagaggatccgctccaccgagtaggntggacgctctctagtgagctgttataagactggcgccatgccaccctgaaagctagtgcgggtaccga

SEQ ID NO: 496569 - DNA, 287 bp, Homo sapiens
tttctttaaaatgctttgggggcccttttgtaaacaaattgcttttagattgttccaaaccaagcctaaaacccatctgtgaatacttaaatttgtagcttaatccccttttagacttgtgagttgaatgccaaaccagttgaacaaaaattatggcctttaaaaatttaacatgttttacctgtaaaaataaaaaagtgttggttggttttaaaatctggtaaccccctgatgaaaaaaaattttttttatacgggttatgtctctaaaaaagtattcctttgata

SEQ ID NO: 496570 - DNA, 218 bp, Homo sapiens
gcttctgcttcagggtgtccgacaaatcagaatatggtgttggtatgaagcggggtctcctcctccggcgggttccaagaaggtggtagtggcccgagcgggacaggtccgctcggacgacatgaaccactgctactcccgcctgcggtgaactggtacccggaaagttcccagagagagcactccagactatagccaggtggaaatcctacagcgcc

SEQ ID NO: 496571 - DNA, 109 bp, Homo sapiens
catacctggacttctggcataccttgaccttctggcatacctgaccttctgcatacctgaccttctggcatacctgaccttctggtatgccagaaggtccaggtatgcc

SEQ ID NO: 496572 - DNA, 500 bp, Homo sapiens
agtgctgtgattacagagcgtgaaccaccgagacccagtcctgaaatgtaatgtcataggaaatcgaagatttgatctaacaattattcgcgtaccaggcaataatatgaaactcagtgtattgtcataaagatatctaagctattactttttgaagttgtataaaaaggtgaagttaacatgttttaaatgaagtcgatgtgtctgtccctacatagggttgccatttctgtttttaaactttatgttgggttttaaagtacctgaattttcacatggactcatgctgggggacattgggatacaatactgtatggggtatatgcatcccataagggagtctgtcttaaattaacggcatatatccccctatccatgaatgtactctgttagtattgagcatcaagagtaatttttagcataaatgataacctaagaatatgtttcctttgtctgatcatgactgggattgtctgtgaatgccctcatggtattgaggt

SEQ ID NO: 496573 - DNA, 316 bp, Homo sapiens
ttaaggaagggtccccaggcttggggagagccccaaagttgagaacaagtaagtgaacaattattgtactgaaccacttgttacgaaacacgctgatcataaacaacctgtgtgtaatatttttcccctacacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 496574 - DNA, 483 bp, Homo sapiens
  misc_feature (209)..(209): n is a, c, g, or t
ccaagctggcttctcctctgaacaatgggatacctgcctcaggggttgctgcgaggactgagtgcttagcacagcacttggacaggaaactcaaaaatccaacggagctctcagtggtttcacagaggaggtggcagctgaggatctggcctcagaggatgttaggatttcactccgttactcatctgtccctttggccattgccatcntggtctgtctccacagctcctagaaggaaaggtcggggctgagactgactttcggctggcacagggcctggacgaatgaggccagtgaggcatttcagatgcagagtttaccggaatgccagcaaattgcatgataatattttaatccaatgtggtaaaaaaaaaagtttttaattaatgcaaaagtccatgatgaataaaatatcaaaaattaaagacaggatccgactttgcacgaccctgcctcactcacttcctgctaatccacggaacc

SEQ ID NO: 496575 - DNA, 1444 bp, Homo sapiens
cgtgctcctgtgatccccgtgtgcgagggttaacgctgaggccccggcctcggtccccggactaggcctgtgacccctgggtgccatgaatgcagtgagtggctcgagcgctggcagccgcgtgctgcgggaacaaggctgaaacctgccgccctggcggaggagaacaatgaacccccacctgccggccggccccccaggatgtgggagatgacaagaggagggcagcgacgggatggcgaggtcacacgggggacggcagactggcaacgacgggcggacgagcacgcggcatgagacaacttccccagcgagacgctgggaccacaagtcaccattggaaggacattcaagggacgcacggatgaaaaccagcctacgaaccaaaacggccgggtttcgaggcaaaggaagcgcgagcattcgctgcctgcgtgggcctcattgcggtcatgccgtgaccctttccgacattcaacggccggccttcaaacgccaccatagtaggtacctggtcttacagcggcattgtaggcaacgggggcattattctttccaaccgttcgagcgcttaagtggcgcaactcgggaggaaccgtatatttaggcatcccagcgcatataccttggcgaaagcgagaccgcagttgggcacacacccagggaacgcgccttggaattactacgaaggatataccccagatacgcacgcagacacacggggggcaacaaaatagcatttgcaggatacgaaacgaaaccgccactatccctttggcacctttgaaaaggagtggcgacacggcccataagttcttcacagagcagtcccattcgattgggcatcgatacatttccatatgagttgcagcacccaaggtcacgggcacgggcttacgcagcaagcgacgtggccacctaggacacagcaatcctcatggcagtatgacctcttgcatttgcacggaagaagaattctcaggtctaccttcaagacaaatccccgggccggtgtgcccatataaacaagccagtttagttaggccgcggcaacgggtgggttacactatatttaaatttcaagcggaccccggcgggctcataactggaaagcgtacccctggaggaacacacagtcattggacattagtatgatgtcgagccaacgattccttttgacgaatatccgcgcggagccatcccggaacagggacatcggcaattaggcgaataaaccgccagacacgcggcaacagccaacccacttgttgagaacaccaccagtcgggcggggcaaaccgataacccatacgacatggtaacacaccgggcgatagaaaacctggtgctacgagcactaggtacccaggagcaggcccaacaacgatggcaggtcgcagagcacctcaacacggcgcggaccacacggccgaggggcagatcg

SEQ ID NO: 496576 - DNA, 1054 bp, Homo sapiens
  misc_feature (503)..(503): n is a, c, g, or t
cgtcttttttctctgtgttgtttggggtgtatgatggataaaagaagatatgaaggaagagcacagggggcggaggaatggtttgtttacaacggaggcttgtctactatatatgtggggccatcgtctagcatatcgatggtcttactcgtaagacgtgattatagatgtcctcccgcccgaaaatgtgctgttttgagggactcttaccctaggggcccgtttcccgtagtgaccaaagttcccgcccccgggggtcctgccctcttcccaaactggtgttttcaacttccctcggcccgattgctttcctgcccccgagggtggcccgtgtggaatggcttacccaggccacctgacagggagaatcctggcttcaacggggatttgacacgcggattctccccccccctgtgtcctggactgggccacccttggggtcatagcacccgtcccgtccatcggcgatcccccgcgtaattgtggtactccagccagagganatatgacactccccgaacggagaagaactgattggggcttccacaccgccctcctctccccagagaatcccggctcctctccccaggaatcccggtgctttcccgacttcccaagggtattttaaatagccatactcttctctcttagcccttggcccactttctcctggatcctgccctgctttcagccattagtgaaggacccgacccttaggagttctgcgagagcctcccttggttccctcgtgaagacccatataacacggatcgcctttggccatagccctgagcctagagggccctctgatgccccacctgaggtgctgttggtttattgctggccacgtgaattctctcacaggggttctaggaaggggcacttttggagactgcctgacaccacacccctatcccctgcctccccctctcagaagagggtggaagatgaaatgaaagactatgggactcttggaggataccccgtgtctatttctgggttagagaagtgcttactaaaggggttttctaataaaaaccaatgccccccttga

SEQ ID NO: 496577 - DNA, 818 bp, Homo sapiens
cagagtttctatcaaacttatttttgtgatatctccagcatatcttttctgtagtgacagacacttcacgatacgtgcttggtttaacaatgcatgcatcaattcttgcatatatgtttaattggggttgaagaaggaagaaaataagtacatcattaaatcctggaaatccagttaacaaccaaatctttcttcaggaatatgtggctaactctccttaacgtcggccttccctcacctacaagatgctcaagtaaacgcgtcttagtgacagggcttttcagcttaaatcaagatgattcctgcttttcaaggaacatttaagagatttcctagttcaagataaaggaatttgcaggtgaagacacttctgactttgttttatggacacgagagacgaaaatagccctagcggcaggctgactgaaggagaaacagtaaggacgtcaaatgtctgtcccgtggcatctttaatccagcatgagattccagaagaaatgtgtgattaaaatccaagattcatgctgtttctggtctctgcaactcgttcagcagaggaaaacagcatgttggggtattcgtcagacaaaatgatgccaacttttgtaaattcaaggatgtcacctattggcccttttgtcttatgtgtcttatgtataagaaattttctgtgaaatatccttccattgtttaagcgtgcgttcagggtccatctttattagtttggcatggaagttgaccattaggcttgttacaaagtttcacttcttgccattttgtgctgggcggggcagaggggccctccatggaaatctttc

SEQ ID NO: 496578 - DNA, 407 bp, Homo sapiens
agagcagaacttggactgagtcctgcaggacacaggtattagcttttctcttttatttgctttatgtttcatttacttctttggatcgaatagctccaattgtattgctgttatttggtttttcattttgttgttgggttttttgatgtggcgtttttttgttttgctctgtttctttttggctttttagaaagagggttttcctgtattgccctgactgaagtacattgccgtgattactggtcactacagtctatatcttatttctgtcctcaagcaatccttctgtctccattttctgagcagcatgtgctctagccatgtgccaccggcccaacattgtctagaccttttgatactgaatcctttccgcatactttggttgatggacttgcttattcctttac

SEQ ID NO: 496579 - DNA, 498 bp, Homo sapiens
ggacagctgtggaaaagaactgacaaggctggcacagtgactcacacctgtaatcccataggcagcactttgggaggccgagcaatgcagatcgcttgagttcaggaattcaagaccagtttgggcaacaaagcaagaccctgtctctacaaaaaaaaaatacaaaaactagctgggcatggtggcatgggcctgtagtcccagctactcgagaggctgaggtgggaggatggcttgggcctgggaggcagaggttgcagtgagccaagatcgtgccactgcactccagcctgggtgacagagccagattctgtgtcaaaaaaataaaattaaaaaattggaccaacaaaatttcagggcagtaactaaagggcgtgtttacaggagttaaacactaggactgatgtgttcaagaacagtacagggatgggtacgggggcttacacctgtgattccagcacttgtgggaggcccacacagtcagctggaactcaggaa

SEQ ID NO: 496580 - DNA, 173 bp, Homo sapiens
ccctaagtatcctttgattcgattcaaaaaggactttgatatctctcagggcttcagggctatcattgtgagcaattgtcttttatatacgggactgtaaccaaactaggcccgtctgtggcattctctaaatgtttcttttttaccccataaattccttatatccgcttgga

SEQ ID NO: 496581 - DNA, 112 bp, Homo sapiens
gcgcagacagttccagccgagagttcccatatcttcttccatctcattctacactggtaaaactacacccaccaaagacactgcagcccaagcaatcctgcctgacaagcaa

SEQ ID NO: 496582 - DNA, 388 bp, Homo sapiens
aaaaaaaaaggggttttcccccccccggaaaaaacttttttttttatcaccagccaaccccccccccgcttttggggggaaagggccaaaaaggatggcccctttttaaaaaaaaaagttatttcccaaatcccgggggaaaggtccccccgatttttttttccccgggggaggaaattcttttttttaaaaaaatccttttttcgcccccaaggggggccccttcccgacccaaaaaaaggggggcccttttccccaaaaaagggggaccaagtttgggttttttaacccccttcctttggggggttttttttttctttggtgccttaaaattccaacccaaaaagttgtttgccggggggggaaaaaagttaattccaatttttta

SEQ ID NO: 496583 - DNA, 267 bp, Homo sapiens
agcaccttctcattagttcatttagtcccataaattattattttctctgcttgatcttggtggacagatttcatgaagctgtcagttagttcattaaagtttaggaaattctcagacagtgcagtggtatcagaaacttgtattccagagtacaggtcagagtcttcttttcttttctttttgagatgtagtcttgctctgttgccagactggcgtgcagtgttgccatctgcgctcactgcaatctccacctcccgggttctagcc

SEQ ID NO: 496584 - DNA, 324 bp, Homo sapiens
gacaggttagttttaccctactgatgatgtgttgttgcttggcctggagacggatacttggctttggttaagaatcttcctcactgatatgatcatctatcagggtcaatataaaacggcgatcagcccttgcatcacttgagcagctctccaggtatccatttctcagccacagatcacaggggcgggggcccgggaggcatcagagggcgctcatccagctggcgacgtgccactttgcccctaggggagtacagaataacatgttaaaggctcctttatttgatggtcctacaggctcctccccattcagggggggggcaa

SEQ ID NO: 496585 - DNA, 667 bp, Homo sapiens
tagcccggtgtgtatggatacaatcgagacatacgactttaatctttaaaaaaaatgcattaataaatcactactcactaaatacaaaaaatctgatcaaaaaaaatgcctcgccctcttgggaaaaatgccgtttggacattgaacagagatcaggatgaggggaggtgatacatgtcgacccaagtaaaaagggagcctgttttgaaagagttggttgccgcagagtacagatgtgaaggcgtccccatcataagagcatatttggtgatcgagctctgaacccgttcgggaggaattagcatcgggaaggcttcttgagctgtctgcccccttgatggaccaatgaccccctcagattgttagatcggccccgtggagtcagaagcccctacctgcttgatgattaagcgaaggctcaatggatcaggaatgaaggggagccctccaattctttattgtcttgggggtcctgaaaaaattctcatggcggatgaatgaccagtgctgcaaataagcacacattgtgaccatgtcgggatgaccgcatagataccaggggtctgatattgtggccatggcacccaagttctgttcaccgatcgctgcgaataagaccctttttgcccatgagttcgatgctggaaaacgcaacttccgtatgaaa

SEQ ID NO: 496586 - DNA, 212 bp, Homo sapiens
cgccaccacagtaacacatcccggcaggacacaaacacatacacacgcagacacacacacacacgcacacacataccacatttcaataagtcttcatggttctgggtccttacctttcctgtcctcctgttatatgaacacacacacacacacacacacacacacgcgcgcacaccatatttcagtgtgtgcatggtgtgggggcataacgg

SEQ ID NO: 496587 - DNA, 595 bp, Homo sapiens
gaggttgcgggttcgagccttatatcccccgcccgtgattcctgttgtccagtaaagttctgctaagtaggtattaccttctgattattggatctacgaagagttgccctcctttattacccctaccgagtgagcgcctagaagcaactagcctgctcacttaatagttatgtcatccgctcttattaattcatcatcctagcccctaagatctggcctatgagtgagcgtacaacaatgggagttagacctgacaccgtacacaaataaaaaacaacaaaagatatataagaacaagaggcaatgtgtgttcgcgccgtgtgggtcccagcaataattgttaggacagcaagccggtaggggtggcgggaccccccgggagggcgggagacatacgcgggcgaagcccgaggattccacaaaagatgacacgtgcggaagccatgaagggcagccgggaggctatgccctcctgtataaaaaactaccgaggggcgaacaacgagacacgtcccggaccaaaaacaaaaagggcggtcacgagagggcccaacgggggctctacaaacacggggtgcccaggggacgcaattaa

SEQ ID NO: 496588 - DNA, 432 bp, Homo sapiens
ggccctgcgtgttctcctcctcgcaggacacccttcctttctccgcatcaggctgcttcttccttatgtactctcacagcacttactatgctgtggtatcttactgggtgtgattctttgtccgttttcctacctaccccttaaggtctgtgtgcgcaggtactgtgtcttccttggctgagcctagtatcctaactgcctgctgtggtgcctgacacatagtaggcattgaatacatatttgctgaatgaaataatgagtaaaagctaggtaatagaaataatacttaggtctaagagggaccagtctttaataagtagttgtttagctacttcatttagttaaaaaggacatcttaataactaattacttagtgccattactgccatctagtggtgactgatgttattatactgctgggtccattctcaa

SEQ ID NO: 496589 - DNA, 802 bp, Homo sapiens
aagtagaagcaacagttgaaagctgttatatcattatcacgatgtgatagtttgtggaaggtccaggagacaccttgagtgccttgtagtgcactaaaggagaagtactcgtaagagtgtttgcgtccttggttgcttcgttggcttagaggacccctgtgccaagagcattgttttgcgttgcgtagctacaagggaaagtccctttgactgtgcggtcaccagtccttggttggcatgaggctcacgacataggtttgtcgtaacagaatcactaagtatggctcctactagaagggctaatcgttagatcacttagtgcttcaaagtcgtgatagcagctctgtgcttttgctgtgagccgttaacggatagaaagtcgttttgcccttattggagctaaggagtggaggactgcatagcaaacacagttggataagtgctatgacttgagtcgtaggcgtgcgtccttggaaaaagtttttgcagtgacctgtcgaaatggtactctgccgtatgttacaggcatggatattaccattcattttattaaggcttaaaccataaggattcataaatttgttcccactgaatatagggcccagctggtaacctcgcgtggtcaaatggaaagttgttggacttgtggaattggaaggcagacacttgtgaatcgttattagttgtcaaaggagatgtgggaggaggtgactttaaccttgggtattggattgatcccttcaatactgatgaaaatggggggtaaagtagtagacatttttaactatttaattaataaggg

SEQ ID NO: 496590 - DNA, 234 bp, Homo sapiens
acacccaggactccccttataagtcattgtctcagatgttgctcatctggaaatccagatatctccctatttaagattcttagctggtctgccgcagcctcctggtggcttggattaccggctcctgccacctggctgggttgttggtttttggtgtctgcggtggaggctggggttccaccatgttgacccagaccgggcctgggactccctggacctacaggagatctaggc

SEQ ID NO: 496591 - DNA, 783 bp, Homo sapiens
gtcccagggcatatcagtacaagaaggccctttttccatagccccccaccaaagtagtgtgtgtgtgtgcattttaaccatcatgcagtagtaaaaatatcttattctgaattccacgtctcatggtttacccaatgaagtttcaactttatattcgttttacatcattttcgtgaaccttttgtgcaagaacattcttctcagcattatgcacgtactaaatccagtatttttcctttattctgacttctctgaagaatttactttctttataatattttactggagacagagtctacttggtggacacaggatgggagtgacagtgggtgaagaatctcaggatacaatggggaaagacatcaggacaatcacggggattacaaggcgatatctccgtgccatcgagcctcacggagatagcggggaattaacaggcaccgtgccaaccaatggcacaagcatacataaacgggaggtacaacacgaaggagaatgacggtacacaacactgtaggaccaggaatgggatcatcgaaagatcctgacacatcggtgatgcgggcacccaacactgggggacatgccacaaaaacggggacggggggactcaaccacgagctggtggaagcacaacacaaaagcctggaccatacaagacaaagtgtaagagcatatcaacgaaaaaacactctcaatcatataaccccaaacacatgacataacacagatacataaagatgaatcacgagcacacccataaatctacagaaataatccacc

SEQ ID NO: 496592 - DNA, 417 bp, Homo sapiens
  misc_feature (147)..(147): n is a, c, g, or t
tgaataggaaaaaataaagttagttttgggaatgggaaccttgctattttattattcttaaacccttaacctttcatggcctagccaccaggagccagtagctgtgagttagtgtggaaatggctctttgtagagggaaccagaggntgcagacagcaaaggtgagaggatgttggctttggagagggccgttccccaactgcctccagcccagagcagggtggggaaagccctgagagtctttgggcagaagctggagtgggtggagaggggaagctccggcccctgtgtccaggtagcaaagccctgtcctcacattttttacttgcaaccaggacctacatgtgaaatgatcacttctcattaaaaaccaccttcactgcactccagcctggggaacagagcaagactccatcc

SEQ ID NO: 496593 - DNA, 1312 bp, Homo sapiens
gggaaccgttggtgcgaggcggtggtgaccatcgaaaggtgcaagagccagatcacctgttgacagtccgatggtgcctttcgtccaagaaggtatttggacaatatctcaccaaaaattattgtgaagacgaattacactctactgtgactggttgcagcggtagttgctaacaggcagccggagatgcttaccggaattacgttgacttccagaattaagccagggacgacaggaagaggcagcgaagaccgaggcattcaaatttgcaattaatcgtggtcacactgtctggtctggagcttccttgagcttgaacgactttggggagaccagatactgctatctgatcgctactcttccccctgtgcatctcgctctcttcgtgtcgtgcctgccctcggctgtgtcctgcggcgacgcgttctgctccgtggccctgccggctagtgcgggctgggtgcgtgcccccctgttgggcgtcacctggatctttgccgcttggcgttcctcttctggggccctgtttggccctttgagtgggtcactcccgcggggtcgcgcaggtcacactgcgtggtttctgtgtgcgacgctctctctcgccgtggttggttggcccaaggcccctctgtgagctgtgctgattcttcttgttgtccatcccattgggtaggtattaggtgtcctcgagatgcgtagtcgttccttggtacgcgcactcttactatgcgggggtcttgtggtcttcgctccgcgtggttcgctctctcgcggcggtaagaagcctctggcgtcttttgtagggttttaccccggcgcggcagtctggtgggtgtgtttccgtcgtcttttggggggtttcccaccttcgctgtcccctcccagttttccgtgctgtcttcttggcggcgtcccgcctggtttgactcgcgtgtttgacggcatggattcttgctttacgactctcggtgaacatacgtctggttccccgcttcgccagcacacgcgcttgtgttggctttgcccggtcttgatccgcgtttgcctgggtcgctgtggtcctcctcatgtttctgtgcttcatcactttaccctgggccccttatccggctgctgattttgcaaatacccctggtccacatcttggtgttctctctggtgttttgctccctccaacactctctccagtgactctggattgccgcatacctttgcgctcctaatcgcctgctctttcagttatcaagtcgcggctgactaatgtttgccttgatgcgcgcctattcttatctccgtgtcatgacaaagt

SEQ ID NO: 496594 - DNA, 242 bp, Homo sapiens
gtacaaaaaaaagagggggggctttttgtccccctttgggtttttggggggggcccccctttggggggggggggaaaaaaccccccgccccccccccccccccccccgggggggggggggtttttttttcaaaggggggcctttttccccccccaaaatgttgttggggcccccccctttttttttgggggggtttttttttttttttggccccccccccctttttttttcccgggggggga

SEQ ID NO: 496595 - DNA, 516 bp, Homo sapiens
ttgttttgccaaagcccaccctgtaacacaattgtattagtcagggttctctagagggacagaactaataggatagatgtatatataaaagggagtttattaaggagtactgactcacgatcacaagctgaggtcccataataggccgtctgcaagctgaggggaaaggaaggcagtctgagtcccaaagctgaagaacttggagtccaatgttcgagggcaggaagcatccagtacgggagaaggatgtaggccagaagactaaaccagtctagtctttccaagttcttctgcctgcttttattctggttgtgctggcagctgattagattgtgcccatccagattgagggtgggtctgcctttcccagtccactgacccaaatgttaatctcctttggcaacaccgtcatggacacacccaggagcgatactttgcatctttcaatccaatcaagttgacactcaatattaaccatcacaacaacttaaatgttctcaagtattaaaaaaaaaa

SEQ ID NO: 496596 - DNA, 1021 bp, Homo sapiens
cgtccacaaggcacgggggaacgagtggaccagctcttcaactttgatgttcatgacgatgtgcggttgctcagatgacgccacatgtggagaaggatgagtcccagtgcaggcaaggtggtgctgagcgagctggtacgagaagaacaatgctaagcatctttcccgcacagtgcgcgtgggaacccgtacgagccgtgaaaagaagtgggacgaacgtacttcgagtccgcgtgacgtcactccaggagtgctgcagcgtgccccggtctcctcagctccctcagtgtgccccgtgggtagtcaccgggagctccagagcaaccactgacttcgctccctggccgaagactagttggcgcaggacaacgtcatgagggaagggatgggaacggtcaagctagtatcctgtgtcacttgactcgcacttgaccaatcagtcacgttgtaactggcttatagtatcgtatttacgcaagtgaaacggaaggatgcaacgtgatcaaagagctgagaggcagcacatggcgatttttgagtgcaggaaaaaatgccctagataatacaaaaaggaaaacagtcaccaaatagaaacctagtacaacctaagcgatagatccaacagagtcacattacccatgttacattaacctacggaactgctaggaaacaacacaattgggggagatggaattggcaggatcagacttaattgtgccgaacccattcaggaagggaagttggctgattcctgactggcactcccagcgcacggaccgtggcgtttacgatccgtggtgtgcgccatcccagtcgataatagcgctgaagtgtctcccacgttgggagaatgtacgcgagaagttaaaagcatcaagcttgtcaatatactatgccagagggcggtaacggctacgcaagagcactgcacttagtatcagttgtaggaacaccagacttatggatcttagcaacgtaacccaatgacatactcggtgacagtgttcggaaagcacctaac

SEQ ID NO: 496597 - DNA, 684 bp, Homo sapiens
gcaccccttggggccccccagagaaaggtttccccaggaaacattttagagaatgggcgacacatgtcccctgcgcaatatagaggggagaatatttgtgcagagagacaaattttgtggagaattttctgggtgttctcctctgtgtgtgtctcacaaagacattgcacgctgttctccggtagacaccccccatggggtgtcctataggagacagagaggagagtgggcgggtggggtgctcacaggagaccccccttggagagggcgccccacacaccccctgttctcctctcccgaggagcgtcccttctttcacacactgctggtggcggcaccacagggcctgtggagaggaaaggagaacttctcctcgctgttagatttgtgggctcgatataagaagatgtgctcttttgtgttaatattaatagtctcgtggccactagggtgtaagaagagtagagggcaagaagagcctcgtttggcctctctctgtcgctccttcttccttctttcccccacagaattgagactcttctgcccctctgattcagccccaacctggcctagacccgccgacagagcccggagaggctcaatgcatttcgcagcccccacccccaaggttttcccacatcacagcccagcccaccccctgggtaaaaaaaatggtttgtggga

SEQ ID NO: 496598 - DNA, 426 bp, Homo sapiens
  misc_feature (419)..(419): n is a, c, g, or t
atttccttactgcctcttgctgtcaagagtacaatctatgttaaacgaaaaacatacttgagtaataccatcacacagattctgagtgtatggcccataggtaccacggtggaggcgtgcataccattgacgcgtctaagtccgaggagcacgaccacccacatgccttgcagttcttgagaaaggattgcaccaacgtcaatggtgagtagaaacggtaattttacaaacagataattgatatgatccggatgcgtactcagttaagctggtggcgtcaaatgagctgactaaattgcatggagcagtgatgcttaaacgatctgctgggagatggtatgccagtctatctacttgcatctatataacgtacatcgaataataataggcgtgctgataaaagctggcattaacgcttnctcttct

SEQ ID NO: 496599 - DNA, 422 bp, Homo sapiens
cagggtggcagagaccacagctcaatggagccaaggccaacactgcaaccccaaggcactgcctggtccagactccccctcacacacccagggccagctacttttccggtctgtcttctgggatccccaggactacctcctgctcctagcttccctcacaccagggggcgcagtagagcaatcagcacccactccccatcccatttcatacccaagccttcagtctcatagacagttttgtgctcgacccaaatggcactagtggccacgaagactctggtatggtatagacctgagagttacccagctgatctaccaaccaacatctacacactcagctaagaacaaaggattcctcagactcagcacagagcattttaggtttattaaataaaaattataatttatacaagaaaaaaaaa

SEQ ID NO: 496600 - DNA, 171 bp, Homo sapiens
tttcacacacatacacacatacacatgcattcacagcacatgctcacacacgtcacacatacacttacactcacagtcacatacacccacattccacatggactatacactagtttgtgtgacgtagcactggtgtaccgacgctcgcaattcgtgaatcatcggtcagta

SEQ ID NO: 496601 - DNA, 349 bp, Homo sapiens
gcctacctcaggtgtctccgacagcccaaaggacagagcccgctgaggactcgggggagtcagaggcgctggagtgcagttcgcagcatccatcccagctcctgcctcctgaccctgcccctcggtttgccacgtcgcgtgtgcccatttcccaggatgcgcaggtcccacagaagatgagcgtgtccctgcccgagggaccagcgtccccagtagtccctaccccagactccgtggagcaggagaagttcctccgtcaccactttgagacactgactgagtccccctgcagagagctcttccccgcagctctgggagacagtgtgagtgccctccgtgaagcgtgaaa

SEQ ID NO: 496602 - DNA, 814 bp, Homo sapiens
  misc_feature (20)..(20): n is a, c, g, or t
  misc_feature (92)..(93): n is a, c, g, or t
  misc_feature (132)..(132): n is a, c, g, or t
  misc_feature (145)..(145): n is a, c, g, or t
  misc_feature (147)..(149): n is a, c, g, or t
  misc_feature (151)..(151): n is a, c, g, or t
  misc_feature (153)..(153): n is a, c, g, or t
  misc_feature (158)..(158): n is a, c, g, or t
  misc_feature (162)..(163): n is a, c, g, or t
  misc_feature (179)..(179): n is a, c, g, or t
  misc_feature (181)..(182): n is a, c, g, or t
  misc_feature (184)..(184): n is a, c, g, or t
  misc_feature (186)..(186): n is a, c, g, or t
  misc_feature (191)..(191): n is a, c, g, or t
  misc_feature (193)..(193): n is a, c, g, or t
  misc_feature (195)..(195): n is a, c, g, or t
  misc_feature (200)..(201): n is a, c, g, or t
  misc_feature (212)..(212): n is a, c, g, or t
  misc_feature (219)..(219): n is a, c, g, or t
  misc_feature (236)..(236): n is a, c, g, or t
  misc_feature (244)..(244): n is a, c, g, or t
  misc_feature (246)..(247): n is a, c, g, or t
  misc_feature (256)..(256): n is a, c, g, or t
  misc_feature (265)..(265): n is a, c, g, or t
  misc_feature (268)..(268): n is a, c, g, or t
  misc_feature (270)..(270): n is a, c, g, or t
  misc_feature (276)..(276): n is a, c, g, or t
  misc_feature (282)..(282): n is a, c, g, or t
  misc_feature (288)..(289): n is a, c, g, or t
  misc_feature (294)..(294): n is a, c, g, or t
  misc_feature (300)..(301): n is a, c, g, or t
  misc_feature (322)..(322): n is a, c, g, or t
  misc_feature (331)..(332): n is a, c, g, or t
  misc_feature (335)..(335): n is a, c, g, or t
  misc_feature (341)..(341): n is a, c, g, or t
  misc_feature (349)..(349): n is a, c, g, or t
  misc_feature (360)..(360): n is a, c, g, or t
  misc_feature (370)..(370): n is a, c, g, or t
  misc_feature (376)..(376): n is a, c, g, or t
  misc_feature (389)..(389): n is a, c, g, or t
  misc_feature (440)..(440): n is a, c, g, or t
  misc_feature (462)..(462): n is a, c, g, or t
  misc_feature (466)..(467): n is a, c, g, or t
  misc_feature (469)..(473): n is a, c, g, or t
  misc_feature (475)..(475): n is a, c, g, or t
  misc_feature (478)..(478): n is a, c, g, or t
  misc_feature (480)..(480): n is a, c, g, or t
  misc_feature (517)..(517): n is a, c, g, or t
  misc_feature (519)..(520): n is a, c, g, or t
  misc_feature (526)..(526): n is a, c, g, or t
  misc_feature (533)..(533): n is a, c, g, or t
  misc_feature (537)..(537): n is a, c, g, or t
  misc_feature (558)..(558): n is a, c, g, or t
  misc_feature (562)..(562): n is a, c, g, or t
  misc_feature (564)..(564): n is a, c, g, or t
  misc_feature (568)..(568): n is a, c, g, or t
  misc_feature (573)..(574): n is a, c, g, or t
  misc_feature (577)..(577): n is a, c, g, or t
  misc_feature (582)..(582): n is a, c, g, or t
  misc_feature (593)..(593): n is a, c, g, or t
  misc_feature (597)..(598): n is a, c, g, or t
  misc_feature (602)..(602): n is a, c, g, or t
  misc_feature (614)..(614): n is a, c, g, or t
  misc_feature (648)..(648): n is a, c, g, or t
  misc_feature (657)..(657): n is a, c, g, or t
  misc_feature (674)..(674): n is a, c, g, or t
  misc_feature (680)..(680): n is a, c, g, or t
  misc_feature (702)..(702): n is a, c, g, or t
  misc_feature (707)..(707): n is a, c, g, or t
  misc_feature (711)..(711): n is a, c, g, or t
  misc_feature (715)..(715): n is a, c, g, or t
  misc_feature (718)..(718): n is a, c, g, or t
  misc_feature (726)..(726): n is a, c, g, or t
  misc_feature (728)..(728): n is a, c, g, or t
  misc_feature (731)..(731): n is a, c, g, or t
  misc_feature (746)..(747): n is a, c, g, or t
  misc_feature (768)..(768): n is a, c, g, or t
gccctggctgcctccacccnctcccagggggaccaaaagccttcatacatctcaagttggggggcaaaaaaggggggggggggggggggggnncgtcgttcgggataaaacaaagtgagagggtgttggggnggggttggggggntnnngngntgcgnggtnngcgcgggggcggtgcngnngncnccccngngngggcnnggggggggggngggccantctccttgggggggggngggggggngnnggggggggnggggggctnccngngacggngcgtcncgtgtnnggggnggctgnngggggagcggcggggggcggncggggtccnnggncgcatngggggctngggggggggcncgctccggcnggcggnggtcgccttcgcngttccggtttttgggtccggggtcgggccgggggggggggaaaaaccgggncggggcgggaaaaacaaatagngccnngnnnnncncancntgttttctgcgcaagttaggttttgtcaagaaagggngnnagcaantaagtcntggnccgcctagaagcatttgcggnggangntggnggggnnggnctcgncatactcctgnttgnngatncacgtctgatgnaaggtggacagcgaggccagggtggggccgccgntccacacanaaaaaaagcgctccggnggggcnttgttcttgttcttctttgtgntgggngccngggnggnggtctccntntgnttcctgtcggctttnnctgggtttttggtggtgtcgncagaccgcactgtgttggcgtacaggtctttgcgggtgtccacgtc

SEQ ID NO: 496603 - DNA, 863 bp, Homo sapiens
  misc_feature (35)..(35): n is a, c, g, or t
  misc_feature (63)..(63): n is a, c, g, or t
  misc_feature (73)..(73): n is a, c, g, or t
  misc_feature (115)..(115): n is a, c, g, or t
  misc_feature (118)..(118): n is a, c, g, or t
  misc_feature (120)..(120): n is a, c, g, or t
  misc_feature (165)..(165): n is a, c, g, or t
  misc_feature (167)..(167): n is a, c, g, or t
  misc_feature (189)..(189): n is a, c, g, or t
  misc_feature (191)..(191): n is a, c, g, or t
  misc_feature (199)..(199): n is a, c, g, or t
  misc_feature (318)..(319): n is a, c, g, or t
  misc_feature (333)..(333): n is a, c, g, or t
  misc_feature (349)..(349): n is a, c, g, or t
  misc_feature (357)..(357): n is a, c, g, or t
  misc_feature (418)..(418): n is a, c, g, or t
  misc_feature (451)..(451): n is a, c, g, or t
  misc_feature (567)..(567): n is a, c, g, or t
  misc_feature (585)..(585): n is a, c, g, or t
  misc_feature (616)..(616): n is a, c, g, or t
  misc_feature (620)..(620): n is a, c, g, or t
  misc_feature (670)..(670): n is a, c, g, or t
  misc_feature (676)..(676): n is a, c, g, or t
  misc_feature (682)..(682): n is a, c, g, or t
  misc_feature (753)..(753): n is a, c, g, or t
  misc_feature (765)..(765): n is a, c, g, or t
  misc_feature (778)..(779): n is a, c, g, or t
  misc_feature (787)..(787): n is a, c, g, or t
  misc_feature (823)..(823): n is a, c, g, or t
gacaccaaagaacaaggtaagtacaaaaaagcagngcagggaccggaccggaaaacccgggancgcaggagcngcgcctgggtccccatggcgcagaggccggctccgcgtacgncgncnatcctggcgcaggccgtgggctgcgtcttcctgctggagccagancngccaggctcggcgctgcgctcncnctggagcncgctgtgtctggggcccgcgcctgcgcccccgggacccgtctcccccgagggccggttggcggcagctgggacgcgcttatcgtgcggccagtccggcgctggcgccgcgtggcagtanngtgagtgccaacgnggcctgggtctctgancctccgangacggccttggaggtcgggcggacgcgcagaaacagggcttctcagaggtccccgggaggngcagctgtccgcgcaggccccttggcgagaagngtcggacgtctgagtggaacccggttcgtcaccgctgctctttccactcggctggcctctgcgcctttctctcatcccggttcttctttgcggtccagtaggtccaaagcaacaanagcttcttgatgacaatntctttgttccaccagagtcattgcaggaagnggangagttccacctcattttagagtatcaagcaggtagaaaccaccaaaacanacaacnccactngtattccagttcacctagagctggccagtatgactaacagggagctcatgagcagcattgtccatcagcangtctttcccgcngtgacttcccttnngctgaatnaacatgagctgttatttctcacccagtcagcctctngacctcactcttctctctcttcctggaacggtgttcctga

SEQ ID NO: 496604 - DNA, 375 bp, Homo sapiens
gagctgcctcttagccccaaagtgctgggattacaggcgtgagccaccacacccggccaacaattgtgtttttattgagagttgctatatgtcaggcactattttcagtgctttatatatcttaacaaatttagtctttacaacagccttaagaataggcccattttttagtcttcattttactgataaaagaactgaggtacacagtagttaagtaagtcgcccatggtcacacagttaagaagtggcagaggctagaagacatactccatctttagagtgctcagatttaaccactgttatctttccttttagatatttgagcatgctattatggcacgatgtagtgtggctatagtggagatgcagtgggat

SEQ ID NO: 496605 - DNA, 458 bp, Homo sapiens
gagtccaccttagaaaaacagcctgtcgctctctcagaacctttgctatgtgtgaccccctagagccttcatgtggatcgcagcatgttaagaacgctgtatctgtatctgcctgagagtgattagagggtcttcacgttaagcagctgcctctgtcccaccatgggagggataaggggtcatagcagctgcctctgtcctgcctgagagtgataaggagtcttcacgttgagcagctgcccctgtcccacctggaagaggattaggggtcttcacattgagcactgtggctgaaggttcatgtactgttgtcttaattttctttactcctcctccatgcagtgtccttgaatccgacccctactttgggtttgaagaagcacagaggaagttacaagaaagaccctggctcgtgaattcctacagcgagtggcttcagagattaaaggtatgtggag

SEQ ID NO: 496606 - DNA, 269 bp, Homo sapiens
acgagaaatgcgagccaaaaacccagtgccccagctgcgtaaatttacaaccaatgtgtcacccttttcgacaaaatgattcaatctagtcatagccagaagagtgggtctcctatttcctcagaagagcggcggcgcagggatcagcagcatctggatgacttcacagcagctcgggcttctaccaatttcaccatatgcccaggcagatgctctccataagaagaatcctgggcacttcacagacacaggacaaacccgaatcatga

SEQ ID NO: 496607 - DNA, 231 bp, Homo sapiens
gggttttggcccaaaaaaaaaaaattttttaccacaagggggaaaacccggggggggggtttttaccccccccgggttttaccccccttggcccttttttttttggggggccccccccccccccccccacctcctggtttttttttttttggcccaagggggggttccccggaaaaccccctggggggggggggggggccccccttcttttttttaccccttgggggttta

SEQ ID NO: 496608 - DNA, 399 bp, Homo sapiens
  misc_feature (358)..(358): n is a, c, g, or t
gtacaagtagtcaaaatctctgatctgaaccagagaatgagacctcacatttggtagactaagatgtggtattcctaggtacaacagcttcccaggtatttaaacactcccatggtggaagtgagaggattagcagaaagaagaatgaaaaatcataaccaaatgacagctggtggggggtccccatccaaaatcttgcccagccaggcacagtggctcatgcctgtaatcccagtgctttgggaggccaacacaggtggatcatatgaggtcaggagtttgagaccatcttggccaacacagtgaaactccgtctctactaaaatacaaaagtagctgggtgtgtggcgcacgcctntatcccagctacccagacccggggattaaatcctgagagtc

SEQ ID NO: 496609 - DNA, 506 bp, Homo sapiens
ctgtctgcagcgtcgaatctatcaaggtcccctcggcattatattgacgagcttgacgtgtatgacttggctcagcagaagagtgcccaaatgtcgtgactaggggactaggtcatagaagattccaaatgtggctacttccaggctgtacccaaagagagctggctgatttcaacttacctaggaatcttattatgcttcctgaaaagccccaacattttccaggcttcctgagttctcccagcccttaaaaagaggatagctatacagttgagagaggtggctggccaatcctgagcagtctgtctgatgggttggctttcatacgcagatttgatatcagcagcacagtcagcaaatgccacctgaagctctggtgggtgcttgtcccttgccatgagcatcgggatctcttctctcaggtcactgcggaaagtatgaccatattctttactttccaaattttaggaatcacttctagccgattggccacatccaatgcttgg

SEQ ID NO: 496610 - DNA, 358 bp, Homo sapiens
gtacaagtagtcaaaatctctgatctgaaccagagaatgagacctcacatttggtagactaagatgtggtattcctaggtacaacagcttcccaggtatttaaacactcccatggtggaagtgagaggattagcagaaagaagaatgaaaaatcataaccaaatgacaatgcccagagagaaataagtagcacgttacaggaagtttcaaaatcgaaaactcagctggttgccatggctcacacctgtgatcccagcacaaccttgtggaccagggtcttggcgagggtggaaaaattctggtttggggtgtttccggcagcaacaaacagctacaacctgcagcacaacctgggtcc

SEQ ID NO: 496611 - DNA, 888 bp, Homo sapiens
  misc_feature (662)..(662): n is a, c, g, or t
tattaaggattcctgagattttgcttgagcaggattacataaggtgttctttaaatgtctgaaatggaacaggatttcaaaaaaaaatcccacaatctagggtgggaaaaggaaggaaggatgtgaataggctgatgggcaaaaatgcattttatccatcagttccagccttctctcaaggagaaggcacaccgaaaggagatacaggtggagacatctggaaagttttgctccactggaaaacgtgtgtaggtatctgtatgtgatattatctgtgaaaatatatgaggctacagaactaaaaattaaaacctctttgtgtcccttgggtcctggaaccgatttatgtaccgtttcaaagaaaacaaaaatcatcctttacagaagagatttgatgtatgtaatagcatagtagcagctctgaaggtactatatgtcatagccgaatagagtcatctgaattgaagaaacaactattatgggacataaatcatcaggaaagagagcaccacgtggatggagttctctagaagctccagtgaatacgagatgtgactctaaagttgatttaagggcaggatggtggtttacgcctataatccaggcattggagagtccgcgtggcaagatacttgaactcaggaggttcagatacagcttgngcattgggagactgtctctatttaatacaagactgatggaatgggggtgtcctttactgcacaattgtggcgtaggagggaactgacccgagtaagccaatgagcagggtccatgcctcccaggcaaagagagccttccaatatatatacgacaaaaaaaaatctgcgccgaattacaatgcgccagaaaactatcacactgagattacacacccgactatgtcaa

SEQ ID NO: 496612 - DNA, 627 bp, Homo sapiens
  misc_feature (267)..(267): n is a, c, g, or t
  misc_feature (273)..(273): n is a, c, g, or t
gcgtagctgccttgagagttgcagtgttggtgagatccagagtccatgtcggacctgtcatactatctgggcctgattgggggcctgtactctcttactgctgtctgacgctgctggcctttgccgatgtactcaggactactggctggggtggaacgtgattgctgggtcaccccccagtccgcaacgctcacgtgtgtgcctacaagttccacatggggctctagtggctgagactgggctggcttttcactgagagctgcagcntctctnccaagctccgctccatcgctgtctactatgacaacccccacatggtgccccctgataagtgccgatgtgccgtgggcagcatcctgagtgaaggtgaggaatcgccctcccctgagctcatcgacctctaccagaaatttggcttcaaggtgttctccttcccggcacccagccatgtggtgacagccaccttcccctacaccaccattctgtccatctggctggctacccgccgttccatcctggcttggatagcctacatcaaggagcggaaggctgtgtgcctatactcggctggtgatcttaccggaagacccgatcgtttcatggttgcccccgtggcacggctgggca

SEQ ID NO: 496613 - DNA, 1226 bp, Homo sapiens
acgaccaaagcccgcgcgcctgatacatcccgcgatcagacagctactgtaccgctgccgtcgccgccgccgacatgcccaagagaaaggctgaaggggatgctaagggcagataaagcaaaggtgaaggacgaaccgacagagaagatccgcgaggttgctctgctaaacctgctcctccgaaagccagagcccaagcctaaaaaggcccctgtaaagcaagggagagcaaggtacccaaagggcacaaagggaaacgctgatgctggcaaggagagggaataacccatgcagaacaatggagcattgccaaaacagaccaggcaacagacaagctgcacaggtgctgcgagatgccaagtgaaagtgtgctgccattacaggataactggtgtactatcatggtgactgtacagttagaacctacatactgatgaatcaaggtaaaaataaaagattgcagcaatagaggaaataacattataataaaagagataaaaaagaaaatagatggaaagaagcaagaggaaaaaataaatagaagataaaaggggagacaagggggcacatatgaacaaataactacaacagtgtctaccacaagcattggaatagaatgtgaaaaaaaaaacaaccattaccccattacaaataggaaacaaagtaacatactagtgatcacccaggaggaacaaaaatccctgacattatgaacaagagaccattgtgcaaccaatttggacgacacaaaggcttatactagcgactaacacacaaaacaaacactagagacaaaaatgaaccgacgcataacagcaatatacaactataaacacgcagtagaacatataaatacccatatagggccagaaagaataaagtgtgcgaccatgacacccgaaacaaccaaggtaccccaagagtatcgatggggcacacccttagcgactacacagttggtgttaccacaaaaaaaggaccatgtcaacaaaaacaggcgggacaccatataaaaaaggaggaacacacaacaacaagtggccagaaataaccaccgacaagccaagccaggataaaaggtgcaacaaaactaaagaagagcacaccacaaaaaaagtaaaaacagcacccaaggaaaaagaaccaacagacaacacacgcacagagactataacgaaggcaccacaaacagcagtaacagatgcacacgaccgcacaaaaaaaaa

SEQ ID NO: 496614 - DNA, 753 bp, Homo sapiens
tggcaggaaaacaggaaactccagtcccagagcagctgggcatgaatgacctgtccccagtgatgttgggcacttctctgccatgagggtcctgagccttggggtgctgcactcttctggtttgttgaatggactggacctgtgccactggtgcacacatgccatgcaactgcttaagcaccatgtggcctggcgtgagttgccctgctctgtgtgcactggggatcccatgctgtcaagcagctctctgacattccatttttgcctattccattcaactgcagcagcacagggttcccagattgcagtgtgcttgaacccatcattctgcccctgccccaactgtgaaccccatgccaaaccgcttgtggtgggcagagcagatggccattgtgtgtgcagagtgtggctggtgccccgtccaaaccacaggtgggtcccatcttgccgattacacattcaggcaagcaccctcccaaaacacacacatgacccttggctcttcaaagaaacaataacccgcgggaactgggtgacagtggtcacgtcccaatcaaaacactgccggccaaagcccgggatgtacccccaacggcaggacaacaccacggaacacagattatctaatcattgtgaactgccactggcaactgtgctcccgcaaggacaggcacaagacagggatcccagtggaccaagagtgacaatgtgaaccccgggaaaagccggcgcacaggcaggaataccacacca

SEQ ID NO: 496615 - DNA, 239 bp, Homo sapiens
tcatcacgaataatcgcaccaatggtggtgcccggcggcaggccgatatcgcggatcgccttgccgatcactttgctcgactttgaatcaccatgggcaatcgcctcgatggcttccgccgcgccccggcgcagggagtgcacgctgacgatatcgccacggcgcacgtgggccagcaaggtgccgatggtggccaactgcgggctgatggcgatgtcgatgtcgccgccctggctcag

SEQ ID NO: 496616 - DNA, 233 bp, Homo sapiens
ctccctccctccccacatgagtcttcctgcttttgtttcaagctgtcctgcctttccagaccaaaccaatgtacttcttacgtatattgattgatgtctcattcttgtctccctaaatcgtataaaaccaagctgtgccccaactaccctgggcaagtgtcatcaggatttcatgaaactgtgtcacgggcgcattccccaaccttgaaaaaataaacttttttaattaactg

SEQ ID NO: 496617 - DNA, 593 bp, Homo sapiens
tgctcctaggcttcaaacccatacagcatggcactatatggaatactgtaggcaattttaacacaatgaatcctgacccttgggaatgggatctggagccagtgggaagcattctccgaatatgataatgtggttatcttctgacgagtgctggcattatcacttgttgctaaaaaaacaccaggcttgttctgaggttcacccgactccactgcatgtattacgtgcatgtgtaccttggaatggaaaatacatgactaagccctgagacaactctgcactgtatcctgctattcttccaactgcaggacctcatggagcgagagatccaaacctttctgaagtactttaccttctacctttttcatgctactcaggattgaatcaattggaagccaacaaagccattctgtgttactgtgcctcctgactgtcagcacgctgcactgtgcatttagataattctgccagaaggcatttttataaaaacagctttcaaaatctattcttgaaaagacatttgtatactcattatgccattctatcatttatccatagggagttctgtaaataaaacactgaggtctaatact

SEQ ID NO: 496618 - DNA, 354 bp, Homo sapiens
  misc_feature (346)..(346): n is a, c, g, or t
cacctgcacagtgcctaagaccttgccatcaatttcaaaaaaaaaaaaaaaaaaaaaaaaaaaaatttgtgggcggctggcccgaaaagttttaaacccttgtttgggcgcgggccccaagtttggttttagttagacactttggccattacgtggtaccaaagggagactccgggcgcatagacttaggtgttgtgttctctcaacaatattaaaaaagcggccggcgcgacagcccgacggtttttgacacaattcaaaatggaggttccggaggccatagcggttctctttcaacggggttcccagggagtccgattattaaaattaccgcccgccccctggnagaactgc

SEQ ID NO: 496619 - DNA, 434 bp, Homo sapiens
aacggcacctttacctgaccagataatttcgcccgtctgcaccagcatcagctgcatttgtagggtcggagcgttaacgttgccagaggcgctggagtacagcacgtaatgagcgccgacattgcgggcaatcctatggctttactacgggtgcctaaactgtcctgcggcgacaaacctaactgttcgtcgccatcgacagttgctgggcggaaaccagggtaaatttcccgttattagccagcgcatttcgcagcgtttcggtcgcttctgcggcattcagcgaaccgttagtacggttgttaacgctatcaaccagcaggacgctacccgcagtcaccccgtcagccccaagcatcttactgaccatcggctgcattgcgccattccagtcataatggcgaatatgcggcgcaggcggtgcagtttgatct

SEQ ID NO: 496620 - DNA, 179 bp, Homo sapiens
cctgcagaggcgttagtgtggtgcttcgcccaaagtgtcagacacagtggtggagcctacaacgccaccctctcagtccaccagctcgtagaaaacacagacgagacctactgcattgataacgaagctctctactgacattttgcttcacgaacccttaaacgcctctgcagtggtac

SEQ ID NO: 496621 - DNA, 123 bp, Homo sapiens
aagtgattttcctttgttgcgtcaacgagcctagctcggagactcaagctgccccctgtgataatgtgccttctcgtatttctggtgtgattcaggactttagagggtcagtaagagaccgag

SEQ ID NO: 496622 - DNA, 235 bp, Homo sapiens
  misc_feature (135)..(135): n is a, c, g, or t
  misc_feature (184)..(184): n is a, c, g, or t
agctccgtctcaaataaataaataaataaactaataactaaatgttgtaacacaaaagaggataaatgcttaaggtgatggatatcctgtttaccctgatgtgattattacaaattgcatgtctgtaccaaaatntctcatgtacccgataaatatatatacctactatataccgacaaagttnaaaatagaaactggaagacaaaaaataaattaaaatcaaataaagcttctc

SEQ ID NO: 496623 - DNA, 759 bp, Homo sapiens
taaaccagtttccaaaagttcttaaagggcaagagtgaattccttgtggatttaactgggccccagcttttaggtcctttaagaacactaacaggactacatagaggctttttcagcattactgtgtcgtctccgtgccagatgtggcaagatccccattagcaaagggaaattacttttgaaagccattagacttacaggtgatgcaagcatctaagaagagaggttaactcacactatagaggcataaggtggtactcagtttccattttctctaatgtgtttaacacgtggtgttttatcccagtgttgtgcaagtaatgggggtgtagcttgagaatggttaaagggtggttgggggagggacttcgttgtaagggtttggctgtaaaaaatgttcccaactccgctgaaatgttgctgaaaagcttggtgctggtaacagtctcaacaacccggggctgctcatttctgtgcctactttactctcccactgaagcaggttagcgttgaaggtggtttggaaaagcctgcatgcctgtcaattctttggtttccttctccctttcccccttccccctactccttccccttatctcccctcttcgtccgctcaacctctttggtccagtatgttgtaactttgaagtaaattgtgtactacgtggatttctgcttggagccccagatacagaatcctggtatggtcttaacttgaaacacacgctggaattaccttaaccttatttaaacaaccct

SEQ ID NO: 496624 - DNA, 945 bp, Homo sapiens
catcgcgtcgctccgcgccccgtctggtgcgtgaggagcgtttctgccccgccgcgccgtctgacaccgtgaggagaccctccgcttggcagttgcgcgtctgacaccctgacgtgccctctcctgccggtggcccccctgtctcctgggcctgttggcgggtctggctcctggcccgggctccctgcccccttcgcggcgaaattgtactgggtgaccgtctagcacgcgtgcacgagcgcactcagctggcgtttaatctggaggtgacgacactctgctgggcccggaggcgccacctagcctggtggacagttggctcgaggcgcgcgtctcgtccacgcgatcaccctatgcccagtgtttgcgagatagtcgtggcggcacacacggtcgattgcgacgcggggtgctgcgtagggactctgcggggggtcggcgtgggtataaccgtggtcgccggggtcgggaggcgaatggtgctgtcggcctcggtggacggtggtctggtcgtggatgacgccagaatagcactatgcggattaccttggtgagtactgtcctggcggtatccccaagcgtcttctcactcgacttgcgtccctgtgtgcgagactcgagactggttcccccacaagaccttggggtactctctagtcgcaccagtgagggtgccgatcaagttccagtacgattacacctggcaatttaaaaggccaggttggaccgggtacaggtgctcacagggggggatcgagcattgtctttgaaagcggaggaaggtgcttcagtcacccgaagattattatccaaccttccttatagtgtggcaccaaagcacagggtatacccaggctgtgagcccgcagtcagggaccccctacctaatataattccgaaaccttggggactgtgaccatgtgatcttcctccagatgaccagga

SEQ ID NO: 496625 - DNA, 463 bp, Homo sapiens
  misc_feature (257)..(257): n is a, c, g, or t
gtatactggcattctaagttctgtgggaatctgtacttttataaaatgaagggaaagtgaaataaccctgtttgcttcatgggtcaagggatgggctgggctagagttttaggtttgggagggttgttatcctaaagctcttacctagccagataaattgagggaagatcaatttggctctggaaagggaaaagtctttccctttgagactgtgacctttccctgcttcctatttctctgccaggtgcttacatgtngcagaagctaattgaagagacagataggtttgtagtgttcacagaagaggaatcaggcatgagtgaccagttgtgtggcattgctgcctgccagacggatgacatatacaaccgaaactgccttattgaattggtcaactgtcaggtaccttctctttacaagttacctcaacatcaggctagatcatgactcatacttgttcccc

SEQ ID NO: 496626 - DNA, 188 bp, Homo sapiens
gctggtttggtaatccgagatcattaaaaatggctgaaccctaacaatatgtacaaaaatataacatgtaaataaaagaaatacaaacaaatttcctttttaaagtacttttaaaaaaaaaagcagggccttggaagttttggattcttattgcctcccctgatgcaaattctcatggtttgggttgg

SEQ ID NO: 496627 - DNA, 151 bp, Homo sapiens
gtctacgccggctaagggattatcgcacccgatagcacaagcgcacgacgacgatgatcgtccagcgccgtcacaagcgttaaggagtaggcaatggcacgttctgttaaaaaaggtccgttctgcgacgcccatttgctgaagacagttg

SEQ ID NO: 496628 - DNA, 698 bp, Homo sapiens
ctcgaggatcccggtgtaccctttgtctttctaaccctgtcctgtaattcttaacccagtcttttagttgttttttttcttttgagacaggttctcactctgtcacctaggctggagtgtaggggtgcaatcttggctcactgcagcctcaacttcctgggctcaaggaatcctaccaccttagcatcctgagtagctgggattacaggcacacactaccaagcctgcctaatttttgttttattttttgtagagatagggatctcattatgctgcccaggctggtctcaaactcctgacctcaagtgatctgcctctcttggccccacaaagtactgggattacaggcatgagccaccacccacagccagttaagtgatttttgacaaaggtgcctagaacaatcagtgggagaagagacagttttttcaacaaatagttgtggcaatactgcctatgtaagagactgaggttggacctttactttataccatgtaaagaaaattaacttgaaatggactaaagacctaaacttaagagctataagtataaaacaggggcaaatatttatgccactagatgtggaaacattagaaccctggtgcactgctggtcagaatgtaaaatggcataactgctgtggacaataccttggcaattcctcaaagttaatggtgaatatcacattatgtagcatt

SEQ ID NO: 496629 - DNA, 279 bp, Homo sapiens
attactcaccttcttttttttattataaaaggtacacttctgatttatatttacacaacaaagaacaaagcatctacacacattaaaaaattaattcaatattcctacatctattttaactcattttaacttactacatacagaagccagaatgcagagttaagaatggcacataaggtggggagaagaaggggcaccacgaagaaacaccacttagacaattacttgtctgtagtgggtaaaagcaacaggaatccccctagaaatattgttggctgg

SEQ ID NO: 496630 - DNA, 115 bp, Homo sapiens
aagggtgaggatggtgcgtttcagcagccagggcttctcagagaacgggccaagagtttctggacaaataatatgtgatctttcagaaatatgttcttattcactcctacattgg

SEQ ID NO: 496631 - DNA, 338 bp, Homo sapiens
cccctttgcccggcccccccccgtttgggaggtgtgccccccagctcatttagaacgggccaggatcacaatggcggctttttggaataaaaagtggggaaaggtggggaaaaattttaaaaatcggatggttcccgtgtttttttaaaaggaggtaaccatgggagccttttcttttttttttgttttaaaaaaagtttttttcccttggggtcctgttgatttgtgcccttaccccccaccctttggctttttgaaacatttgttgtgtccccccaaagtttaatggtttaagggccgggccaaattttttttttttaccaaatgttttaaggcca

SEQ ID NO: 496632 - DNA, 348 bp, Homo sapiens
accggggttccttctggtaggatacatatcaactcaaatagaatagtctctggagacaagaacacgtcttcttctattcatggtagatcaatattttcctggaaacaaaaggcattctcactccaattaaactacgatgaatggactgtctcatctatgatgcacatgtgactccacaacaaatgtctttgagtgcagcagtctagcaatgtgggcaggaagatctaaaaaatctcatgtccaacatggcatgataacaatccaccaaaaccaaacaaagcttctttgggttcattcataggctgcctggtaagatatttgcttccctgtgctgttagaggcttagat

SEQ ID NO: 496633 - DNA, 108 bp, Homo sapiens
acgcctcaacctcccaaagtgctgggattatagacatgagccactgtacctggtgtttattaaattcttgactcagtttatgcccttacccccttctgtcgtcttctc

SEQ ID NO: 496634 - DNA, 302 bp, Homo sapiens
tagaggaccctgctacgtggtagtatggtctagtgtatacagccgggccggctcccctcctggcaataccaacgcattcatttcttcctggctctgtgagtggttgctgcctcctatccgtcaatatccaatgccctgggacagcgggggaagtgggattccagccatttgatttattctttcaccttatttgtcctctattactcgtgggtacaacaaaagagaggattatactatcatacgactgtggtttctaacacagaaactcaggctgggcacagtggcatacgcccaggtatgca

SEQ ID NO: 496635 - DNA, 228 bp, Homo sapiens
gcgtatttagtcatgtttctgttgaatgcaaccaatgtacaatatttgacagctttcacctggctttctggagtaacagtgaatttattggtgttcttgaatcattaaatcgctagagatttctagtgaatttggatgctttctgacaatttcctgtcttcttagtctccccttgccattgtagagtttccagcaccctatgagcccaatcatttttcaggaccttga

SEQ ID NO: 496636 - DNA, 158 bp, Homo sapiens
actcgagaggagaccccggcgcccagagactaggagtgccaggcttctctgaaaccagcgctagagcatatttccatagccaaggaggggggactccctgcagctatctgtgggcttacgcaagtagtccagacatacacggcttggggggacaagct

SEQ ID NO: 496637 - DNA, 204 bp, Homo sapiens
gctgcagcagcagcatcatacacaccacacacccaccagaccaacatcatcacatggccaccacatcatcccatcatcacaccagcagtgtcagcagcagcacagggcagtgtccaacacaggcagcacacagtcaattggcaccaacaacaggctgcatatttcggcgcacagtgctctccaccagcacagccaggtgcacca

SEQ ID NO: 496638 - DNA, 158 bp, Homo sapiens
  misc_feature (108)..(108): n is a, c, g, or t
gtcccccacccaagagcattgggtcaccctgcaggaaggtggctgccaccagcaatgagacgaggggctctgcgaccctcagagctgccagccagccagccctgggtngcaagagtgactcctcctggggtctcctccctcctatcgccctccgtctt

SEQ ID NO: 496639 - DNA, 473 bp, Homo sapiens
gtcaactgaagggtgagcacggtggagaagagttttactgagtaacaaaacagctctcagcagcgagaaaaagctgaagacggtagctcctaacgcagcctggtagtcgacagctgtggccgagtccaggggtttttatacgctcagaatgaaggacgtgcatgctgattggtccatgggtgggctctgaaagaagaaccatttgattggctgaaaggcatcaggaagttctcacttccggttgtggattctacctggaactggcagcccggttttcaggcttttcaggctttggcttgaaagttggatttcaccagggacccaccctgatctgcctaggaatttgtctgcctcctgccactatcactattataaaacatcccttcctccaattacatatgcagggaaccaccgattactttgtcaatattatgtattttctagaattgtgataaagctaattatacagtaaa

SEQ ID NO: 496640 - DNA, 868 bp, Homo sapiens
tggcttccgtgtttccgttttcagtttttttgccaaaaggtgtcttggtaagcgatattcctactgggtaaggctgtagcatgaaggatctctatggagtagggcactggagtctttgtttattttggctcaattcacgtccttgccgttgtatgttgacctgcgccagacatctggagaccacttaaccagggacactggttggtgaactgcgacattgggccctgccctcaaggaagtctgccagttctggttgggtgatgagacgtgagcatgggcccccatcacacgtcccttcaccactgggtgcaaagtccttctgtctgggcggacatgtacatataacatgcacgagaacaaaggagtgtgactgatgccttgaattgtgcatggtctgtggcaatgcgcaggagggggtctacgggataacctttagcagatacgtgacttattgagccttgggtcctcaacgaggctctagaaatatgcaagaacagacggagggtagggaaggcgcttccagtcagaaggaatagaggcatgaatagggcactagtgtagatgaaatgaagttctctgtgtatacatgagaatgtggacagacatcgggggtcaagggtaaggttggggccagttgtagtgaaccccctcaagtgctgtgccagaaaatgttcctcttcacttgtcagtgagaataggaactcctgcctgtgatcctgtcgtatcccatgcgaaggaggggtctcttgagagtcatttgtgggagagatgaggtggagcccttcatataagttgacgcatccctaactcgaaaaatcgtgaaattctttgagtgtggacaagacgcacaaaggtcatgctcatagta

SEQ ID NO: 496641 - DNA, 375 bp, Homo sapiens
ggagcagacgacacagaccgtggcgtctctttaaccataggagaccgaagtggtagagacaagtacctccacaagcacgacttggaccacatctgacgagcacaccaggtggtagaaagacggctacaagttctttgccaagcggcagcatagatgacactataactacagctacccaaatactagtggcgcgtttgacaatactggcgccatgatagagtgtggacgagaccctcatgtgctctttccagatcctcaagcccgacgacaagaacaaggggaagtacgggcagttcagtgacctgaaccctggaggccgacccatcaccccaccccgcatgttcgctgaggatactctagagtcccgctgctagc

SEQ ID NO: 496642 - DNA, 329 bp, Homo sapiens
  misc_feature (74)..(74): n is a, c, g, or t
cagtctggtcactctgggcgcctgggatggtcactttatgagaagcagctgggagatgtacaagtatgggcatntcacggacagtttcatgactgaggccagtgtctgcctgaaaaatatggaacacgtgatctagaggctactcatggttataaattaaatgccaccaatgaacttaatctacctttagaataccacgttactatttgtgagacataagctagcagtttgttgagccatgattttgattctttgtcaggggtgtccataatggcagaatacatatttagaagtctggcaagctatcaggataagctgtggcgggcggt

SEQ ID NO: 496643 - DNA, 914 bp, Homo sapiens
  misc_feature (70)..(70): n is a, c, g, or t
gcccgtcgtgttgttttgtttttagagcgaagggggggtgtgcttgcgttcgtcgtgtgtttggtatgcnaccggcggccgctgtggggtgtgggacgcgccgaggacgtgggtgttttgtcgcgccgagcaggggtgggtaggggggacacttttgttgttttggtggggcgccgtttgatttgggtcccccgccgcttttcgggtggttcgcgcggactagtgatcgccggcggagaagattgtgtggcgccgccgccctgagttttgtgttgaaaaagactggcttgtccgcgcccccgtggggggtggagcgcccccctctgtgggggaggaggccttcgccttctgcctccgtgtgattttctcccccccgcggggttgcaagagtatgtgaggagcgctttttttcctgctgaggatgagagagataaaaatcgtggtgttttccccaacccccctcccttgcaagatggaggtttttttgttgtgggtggttattaatgtaaaatggagggggtatggggttgttccccgacaaaatatttttgttgggccccatcacttttttgaaccaccgaaacaatattcgcactttttcgctttcctctccgaaatatatctatttgagacgacacccccccccccccccgcatgttaaaagtatgatgggcgccagccccactttttaatattcctcttgctaaataccccctcaagaaggatgaatattcatacagactactaccacagcaggcggcggcagctaattaataggagaaacattttatttcccccccaaaaaagggacaatttttttttttttttttttaaagacgccccccttgggggtttttttttttcccccgcttttttttttggaaaaaaaagttttttcctttttaaaggtaata

SEQ ID NO: 496644 - DNA, 370 bp, Homo sapiens
tacagcctaggccccaaaccaagtccggccttactaccagagaaccttgaggcaaaccatttactcgaacagagaacgaaaagtttcaactggaagactgaacgatgtcgtggccggtcctgcatccttaatcacatggtttcttcaagacaaaactcctttgggagtccgatgccacaccaggcgagaagcgcaatgcgtggtcaatttcctagggtccacagagggacactactgtggccccagggaagtgagtatcgcttgtgagttgtcttgcgccagcagtctagcaattatggccgatggcgggtccaacaacgtggtgtgcttatcacacagtggatcctctcatgccggtgggtcctctctg

SEQ ID NO: 496645 - DNA, 220 bp, Homo sapiens
  misc_feature (220)..(220): n is a, c, g, or t
actggtctgtacgcctcgtctggcactggtcgtatgctccctcgcgtgcggcggttgtggccctctctgttctgtctggtgtgtgtttgtgtctgtggtgttcgttgtgtcgtatcgtcttgtctgtttgttctgttcggtggtatcgttttttgtcgctttgatggttttcgatgtgtgtgctttgtgtgtgtcgggtgttggtgatctttggtgtttn

SEQ ID NO: 496646 - DNA, 738 bp, Homo sapiens
  misc_feature (34)..(34): n is a, c, g, or t
  misc_feature (157)..(157): n is a, c, g, or t
  misc_feature (177)..(177): n is a, c, g, or t
  misc_feature (186)..(187): n is a, c, g, or t
  misc_feature (205)..(205): n is a, c, g, or t
  misc_feature (208)..(208): n is a, c, g, or t
  misc_feature (263)..(263): n is a, c, g, or t
  misc_feature (276)..(277): n is a, c, g, or t
  misc_feature (292)..(292): n is a, c, g, or t
  misc_feature (299)..(299): n is a, c, g, or t
  misc_feature (345)..(345): n is a, c, g, or t
  misc_feature (356)..(356): n is a, c, g, or t
  misc_feature (414)..(414): n is a, c, g, or t
  misc_feature (431)..(431): n is a, c, g, or t
  misc_feature (442)..(442): n is a, c, g, or t
  misc_feature (487)..(487): n is a, c, g, or t
  misc_feature (498)..(498): n is a, c, g, or t
  misc_feature (571)..(571): n is a, c, g, or t
  misc_feature (588)..(588): n is a, c, g, or t
  misc_feature (603)..(603): n is a, c, g, or t
  misc_feature (629)..(629): n is a, c, g, or t
  misc_feature (639)..(639): n is a, c, g, or t
  misc_feature (671)..(671): n is a, c, g, or t
  misc_feature (737)..(737): n is a, c, g, or t
aaaatgaggctttatgtatttcaggctggaaggnaggattgccttattctccatgaagaatctcaggcagggtaaaagtaacttaccactaagtacctctgtgccagaagaaaagctcaatttattcaatccttagaaaagttactatcgtcccctngtcaaaaactaaggtgtatngataaggtnnagagaaaaccacatagtnctnattctaattcgtagtgaaaaggctgcaggcatatggtgctcctacgatgggcctnaccctttcctaannacatctcatttccanatccttngccttctctttcccccaacatttccagccagcatagaacccaattnctgggaaattnagaggagaaacagtattatgaacacagactcctttcaaattggaacaggagcaaaacnaaataaataagagaatngtgtagggaantgagaggtaaaaggaaggtcagggagcaatcccttgcctcaagtntggtgcacctnatggaacatcagtacacgggggatggctgtttctggaccaaacttggtggctgcccgaagctcaaaggcagcnacattctgtttgaaaanctcatcaaaaaacanggtggccagcagggagttcagcaganaacgaaattnaaaggaaatcgaaaaagtccacagtgcaggtncgaggataggcagggataccagggctgaatcgccaaaaagtctctaagtggttgaaagagcttgcna

SEQ ID NO: 496647 - DNA, 437 bp, Homo sapiens
agctctccatatggttagtctgaggcgaagagattacacaatcggccgacgccggtagggcggacagattcaaaaggcagtgctagatctcacaccggttatatcgcctctctaagatctcagctgcagctcgccacggggatctcgccgggtacactataaagctggctcagcattacggggagagttcccaccatttctttccctttaacctgtaaaattctttctgaagtaccaccccgcgcttctactgggggctcaatgctcacatgtattaccttagaaagaccctggccacagacgggagcctgtcccaatatctcctcttggggtctgataattcaatgcgagcaacagccaagagaataaattagggaccagtctccttggtctgtttaggacaacctttcacatcctactcttttacttcccatgtt

SEQ ID NO: 496648 - DNA, 504 bp, Homo sapiens
ttatcataggaggtggagcactttgcaaatatgaaaggctaagagagactacttaagcccaagtctttgtttgtggctgatgatggacagatgcaccaggggagaaccagctggtttcagcaacagcctcatctgcagctgggctgcagccactttgagggttattagttgcctccatatccatttagaaaatgtaatggattggctctcacgtttagcttgcctttaactctctttgctacttttctaggagaaattattttctctactcaccaaaagcaaatattgacctggtagtggacaaataaatcaatccagcaagctaatttttgtttcaacccttcattgaaaatagtaacttcagttcttctacctactttgcccttcaatgggtggcagctagtggagaaagcccagctttaaggtctgacaaacttaatctttctgagcctcagcttttcttttttttttttttttttttttgggaaacagattttggctctc

SEQ ID NO: 496649 - DNA, 410 bp, Homo sapiens
tggcagcccagtgatcacatgcttagacatacgataataaagaaagtgccaatgtatcatcgtgtacgaactgacagcgatagaccagtgatgactggccacgccataaagattactgaatgctgtaccaatcgtttagatttaattctgtaagcaatgggacttttacagttttgatttgtgttttgggcatagttgttattggagataatattatagatgtataaagagatggaagaccagtaaaactgaaatatctgttgttggaatagagatcataatgagtgcgaaaggaattgcactgggtgggagaggacgatcataggagggtgtcagtattcaagaggtagtgaatattgcgtagccttattaatctgttgctttgctttatgggatcccaagccatatcc

SEQ ID NO: 496650 - DNA, 406 bp, Homo sapiens
cggtcgtcatgcgccggccaacagtctcatccctccttccaagatctcagtggctccttccaacatctcagtcgctccttccaacatctcatcgctccttccagcatctcatagcgccttccacatctcatagctccttccaacatctcatctccccttccaacatctcatcgctccttccaacatctcatacctccttccaacatctcattactccttccaacatctcatagctccttccaacatctcatatctccttccaacatctcatgccaccttccaacatctcatgccccttccaacatctcatagccccctccaacatctcatagccaccatcaccctccttaacctctacttctacctacgccatgagatgtgggaaggggtatgagatgttggaagg

SEQ ID NO: 496651 - DNA, 359 bp, Homo sapiens
gggacttccaaggctttgcccttggttgaacccacagcgaaacagccgcctgacaggggatttcactttggacccgtccccagggtccccagtttttttttggcaaactttgcccaattgggccatagtcttcttactggcagctgcgggagacataccagggagacaaggtgggccccagccaaagcaccaggctcagccgtgattcatacatgagttcacctctgcgccgtctctcaccaggcaggcacctcccacctgcatggccatatcgtggttaggcacgtggcttttgcagtgccatagacattggtcttaacccagctctgcgcttgccagcagacaacctttgataaact

SEQ ID NO: 496652 - DNA, 267 bp, Homo sapiens
tctagaggattcggcagctatccggttcaatggctcacgtagaacctgggcctccatagagctgagtggtcaccctaacacatatcatctttaccaacgcataagagtgtgagctagtgagcaagatgctcttgggtcatctgacatagactagactatcagagtctgctacttatagcagtgtgtgactcttggggaaatcatctaagcagtcgttagtccatgtgtgggtgtcactctataaaaatgacggataatagtcaagtt

SEQ ID NO: 496653 - DNA, 182 bp, Homo sapiens
cgcgcttcgtgtgcaaaccatggatgatacaagcacagcttgctgcttttttactagcttgtgtagtccgagtccattgtacacatcacaattctaaaccaaactaccaataaagaaaacagactccaccaataagcaagctctgttaggcttccatgttagtgtatcttctcccccactag

SEQ ID NO: 496654 - DNA, 950 bp, Homo sapiens
aacggtaagtgagccgaacttggttcatggcaggcgccgggcgcgctgctggtgatgggtgtgagcggctcggggaaatccacgcgtggtccccctgcttgtcatctgatctgggatggaaattctatgatgttgagtgattattaaccgggggaacatcgaagcacgatgtcaacatggcgtaccgcttcagtgaccaggacctggattccagtggctctgtaacttgctatgacattttactaatcagatgtagcctcgggacagccgtgtggttctagcctgttcacgcctctgatagcaagatcgtacatgagacatattaactgcaaggaaaaagatggtgtagctctgaagtgtgaggagtccggtgaaaggaacgcaaaggcagggtggacaatgcgatctcgtggtggtccatctgaagcgggtcgtttgaggtcatctctggacgcttactcaactggagagggacattttatgcccctgaagttattgcagtcccagttttgagactctggaagccccagcagctccaaaaaaactttatccacaactaagtgtggacacatgtttccgagataattgctacaattatggaaacctaagatgatgtgacatgattggtatcaggggtccgaaccgaaactatgcataaagtattgtggccatccccaaacctcgttccagtcggctgcccatactagaattttaccggttctaatggccacccccatgtgtcagacgactgtagggtgtcctgtggaatatgccggtcacggacacaggggggttaagctcgtgatgatgacgcttccactatgtgaccgtttatcccgtcactcttggtaaactgccccgttgcaaattgtgcaaaaagaatctgcgcgaacaatgcgccagaacacacgcgcttcaacgcacgtatccacagcgctgacatctatgaa

SEQ ID NO: 496655 - DNA, 542 bp, Homo sapiens
gccgggcgcgtggctcacgcctgtaatcccagctctcagggaggctaagaggcgggaggatagcttgagcccaggagttcgagacctgcctgggcaatatagcgagagcccgttctccagaaacaggaaacaaaaaaacaaaccaaaaacccaaaaaaaaaaaaaaaagaaaaaaaaaaaacattttgggtcgggcgccccggggaccctagggagaaaaggttttttaaacaccctctggtgttggggggcgggggcggccccaattaatggtactgtggacacttggcgcaaaaaggcggtggacccaaagagggaactccgtctcggccaaaggcgaaagtgccgtcgggggtttctccccaccaaaatatagaaacaccgcccgggggcgagcacacgcagggctcgtttggggaacacacctccacagagggggggtcccaggaaggagccacaccggggggctctttctacacagaggggggtgtccaaagggggagccgcaaatataaaaattagcgccgcggcgaggggagcgc

SEQ ID NO: 496656 - DNA, 717 bp, Homo sapiens
agagagttcataagcaccaacagcaccactgaagtagtcttagttgtataagaagaggactaccaaccatctggttcctggtcagaggattataatctcacggatatcctcagttgtgagagaagcaatgatctgtgactgtccaaaaatgaaccatgacattctatgtgatgaagaataatataaaccctttgcccaagtggatacagaggaagtatactattactcctgggaatataattttgtgtctccttttcctttaggactcacataacgtgcgcatagcaaagatggtcaccaacaccagatagtctcagactgtgtctctttcctttcgtggaaataatatgctacacacgatacagacttgaatacaatgtgaacaacattttctgtgtagaacaaggatggtacactcctcccaaatgtatgtgcactatttctgcaggagaatgcgggccccctccacctatagacagaggagacattacttgatttctgtggtcattatatacaccatgaccatcagaagagtgccactgccagaacttgtatcatctcgagaggtacaactcttatacacgtggaaactgaccatggtgacaaccaccaaatgcttataaacatgtggtacatctcaagagatgaatggcaaatttacatttattaaagtgttcccacagcagatgtattgatcaggggacatatatgatgagg

SEQ ID NO: 496657 - DNA, 703 bp, Homo sapiens
tgaggagcaccttgggggagtggctgaaggatcttcgaaaccaaaagggcaaaaggcccctaatccgactaggggaatgcaatcgctttccacacattttaaaacaatttaaattcgtttataacgcctatgtaatgcgggcacacgttgggggtttataggaacctttgagtccctcaaacacgacttagttaagtagcaaggttcggaatctggtttaatcccgaagatctgcacagttgttcacgaggtaagtccaccatctgcctgggcgtagtaaaagctttatttatagcaaatacatgtttcaggtgtcatgagtgttagagaccaaaatggcacaatatggattttccactcaccgctcagatggatcgcattaaaaggtgtaaaatcttgatcgacactgagttatcccatgtgaaagtagacttcgtgatctgacgctacgcacaacacttaattcagagccaatgggtcacgcatcagctgtgtaaccccgtttggtcgcagagaaggtttagccagcgcgacgacatttttgtgtgtcgccatttgagcatgtctgtttacgctacagcgatctatcggtacgtatggtaatactccctgggtcgctttgatagttaacagaacagtgctgtggatgacaaaatggattaaagttcgctcgctgtcgtataagcggtcaaatgaataaccc

SEQ ID NO: 496658 - DNA, 188 bp, Homo sapiens
gctcacggtaaaacaaggtatctgtgtctcctcatgtcttacttctggtcatcgtcctctgtgccacttacctacaatctattcctttgttgttaccaaactgctctgtttgttatagccctgtaacccacttgtatttgctggcacaagacccagcagcacgcaactttttaaaacaagccttttca

SEQ ID NO: 496659 - DNA, 561 bp, Homo sapiens
cacacgtgactatgccagcctacgtggctgtgctcgggctgaagaggctgatggaagatgagttgtggaagtcgcccatgttgtgaatgctgaagacgttaagctatgtgttgtcaagtacctgcagatatgctgctctccagtatcttctagcgttcctcagcgaaagagcgtagagagaccgaggcacatgtggttagcccagggatggcggcagggcgctgatcccgacatggtcctggaagggcaccggacgtggggcaggacaaaggcagccaggcccttgcgaagctcacatcacctcgagaccggagatgagcttccctggacgagcggatctatgaggtggtccggcccctcgtctccctgttgcacctcaattgctcagggctgcagaagttcgaggagctcatggccctaagaaatctggtgggactcagtgagaggctccggcagaaggatcctgacggacagaaggttgtgcccatgatagaagggtacatgtttgaggagcattgagatgatccgcgggcagcacggagtgatgtgtacttggcatga

SEQ ID NO: 496660 - DNA, 177 bp, Homo sapiens
actcttgccattgacgactccatacactgcctctacttccttcaaacgtcatctactaggtaagcctttcttgggcactgtatcttaaacagaagccacgtcagccgttcacgcacacacgcacactcacagatattctacatccctttcttcctttttttgccttagcctttccac

SEQ ID NO: 496661 - DNA, 135 bp, Homo sapiens
atggcagacccaggctgaggtgcagatcacgaggttaggattaggagttcaagaccagcctggccaacatggtgaaagcccgtctctactaacaatacaggcggggcacggtggctcacacctgtaatcccagca

SEQ ID NO: 496662 - DNA, 300 bp, Homo sapiens
ttgcgctccattgtacaagccctttacccagtttccacgagttgggatgcggggtatcgaaagaatgtttggcccacatggttgtttcgggtgcttcccagtttgtcagcaggttccctctccggatgagatgggaacaagaagtattggacaaggttcttgaaggcgcacattagcgcggcaattgttgtattacatgcacagttattcttacgaggtgaagcgctccgggtcactctctcggtgtctcgctctctctctatctctgtgtctctctctctctctctctctctgtctctc

SEQ ID NO: 496663 - DNA, 480 bp, Homo sapiens
cgcagtggctcacgcctgtaatcccaacaccttaggagtccgaggtgggtggatcacgaggtcaggagatccagcccatcctggccaacatggtgaaaccccatctctactaaaaatacaaaaattagccgggcgtggtgacacgtgcctgtagtcccagctactcgggaggctgaggcaggagaatcacttgaacctgggaggcggaggttgcagtgagctaagatcacgccactgcactccagcctgcggacagaccaagacttcatcccccgcaaaaaaaaaaaagatgggaggtgatttacagtgaaagacacaattaaattacaacggttcaatgggaaattagaaaattaaacaccattaaaaggagagaagagaggtaattggttagcttcaagagtcaagtggctatatgggtcaaagggttaaatttatctctaaaaattggcgggattcaaaggtggtacttacttgtgc

SEQ ID NO: 496664 - DNA, 191 bp, Homo sapiens
taagtattgatgttgcctctgcaggcttgtggacatacttctggtgagcactgtgcggaaactatcggatgagatcagtaagctgcatgcctcgaaaggcattgcctgtctcttcacttaagtgcatgtccatcgaccaaagccctgtactgatcaatactcatctacagaccagggagtaccgagctcga

SEQ ID NO: 496665 - DNA, 199 bp, Homo sapiens
tcatccgtggatgtatgaataaaatgcccactttttgtattatttgtttttgttggctcccccacatgggggttcgtgctctctgattgggtgaaagtcaagttgttggccactgatgagcattgtgattctacaagtagaaacagtaggtttgttgctaccgggttggcacgcagcaggtaccgcttttggtcgacac

SEQ ID NO: 496666 - DNA, 206 bp, Homo sapiens
aatgccttagacttatcttccacaaataggactacttcgtttctattgcatatactactgaacatattttatacaacctcacagtaactcaacatcttataaaactctgacaccacaccactgacacacgttgtcacatgcttgaactgacactacctaacaatcatacccacacagactactacgactaccctacaatgacccat

SEQ ID NO: 496667 - DNA, 116 bp, Homo sapiens
ctgaccgagaatcctgctgctgtggaaaccagttcctacaggtcatcgagcaggacagagagggacccttttatggactccctggtgggcactgctgctgcaggaattctcgaggg

SEQ ID NO: 496668 - DNA, 1273 bp, Homo sapiens
  misc_feature (666)..(666): n is a, c, g, or t
  misc_feature (1273)..(1273): n is a, c, g, or t
tccaggtgaaaaagccagttgacttaatggctcggggggcagggggcccaggagctcttggggggggggggtccggtttcctctctttcaccatctcaacagggctttctgtggcgtgcccaggagatgtggcggcgtggccctgtgggagatgtgggttgccatgtgcgccagggctggggggggatacctgtgggtctcttgggcgagatctcagtggtgtctcgtagaagtggcgtggcgagagcgcggtgggcggagaagacattctcgtggaggagaagtgggtggctcgcgcacacacatatgagagagggggtggaaaggggtattcccgcgtgtgaggcccgggagaatcctcgcgagtgtataaaatgagacccacacacagacgggaaacaccctttttgggcgcgtgtgcggagctgttgcgcggggggctctcccaagagcgccccacaaaaaagagatctctgatgagcgagagaggaaaatatcacaaggatcgcgcgggtgagataaagacgcgaggacagaggggaaaaatgggggggggggagccctctttcaaaagagttactatagtagggggggggcctcctcacgaagagaagggacgtcgaagacgaagagacggctcgagtgaggctaataataatctctccncctactcctgttggagagactccaagagagaaaacatccgtgtggaggacgacgacaagaggatttctccccgaagacgaaagaagaaaacacaatcctccacaaatattggggcggaaaaaaattttgtgcgcccaccaaatagaacagtttgtgtggggacgagggaggaggagagcaccttcccccctattatgccggaaacaaggaggcgaggggggggcggcgcagccccacacaaaagaggcggacaccgacgcacaaaaaagacggaacaacaggtggttggaaaacctaccgggcgggagaaaataaacaccaagtgggcgcccacccccggaggagggacctaataggtgggagaagcaacgttggtggtgagtaaagcggccgccttctttgttgggaaaacgcaagaaagaggaggctctctagtagagaaaacggcggaaagaaactccccgatctgtgtggtgagcaaccccccgaggggtgagccgccgggggaggagggagagaaatacccggagaggagacggagggcccaaatactaccggccgccccaatagggaagacagcatcgcaaagtctaggaaagaatatagn

SEQ ID NO: 496669 - DNA, 470 bp, Homo sapiens
cattccaaccttgaatcgttacagcgatagcatatcctatccaaccatactaacgtggacacccacaccgcccctcagaacttcaaaagggcaagatcttttttccttcacttattgctgaaacccagggcaccaattcccattaagagaaggatctctgtgctgtaaactaaacaaattgtgcattttttctggggccattgtttttggtttattttgttattttgttttgttttttgtttttgtttttttggtttcattttgttttgggttggtccaattttaaaaggaaatactacaataaaaatgttaaccagaaggtaaccctgagtgtgattgtgagagagacacgcctttttactagttcatttgcatttaaatcagtgatcctgttctgtggcattcatgaaaaacaagttgaagaatttgtttatctggaattgtttctaaatataagtcatttgtagcaa

SEQ ID NO: 496670 - DNA, 165 bp, Homo sapiens
ggaatgaaggtcgatgtggaacaagtggtcacatgtcacctatgcacaaggaccataagacaatttgtgagacttaggcccagggtgacaaaggcagggggtattaccctggagcaagggcagcggtcttcatcatttttaagcgaccgatcctccgcaggagga

SEQ ID NO: 496671 - DNA, 232 bp, Homo sapiens
  misc_feature (178)..(179): n is a, c, g, or t
  misc_feature (210)..(210): n is a, c, g, or t
cgggatgatttcttgaaatccgcgactgcgactcgacacgtcggacactgtccgacgaagcgacgtaacggcattgacatagttagcagtgtttcgtgatgcaacaggccagtcacccgaactctttcccagctcctagcactgtacctatacctacgaggatacctaacccactccnntaggcaccccatacaaaccaggatgcgcagntacccatgaccgcagatacctt

SEQ ID NO: 496672 - DNA, 113 bp, Homo sapiens
ccacagctgccgcggtggcccctaacctgaggggcctggagtcgtggccctgcatgtctgggtagggcttggcaatggttgccttaaccctggctcctggcccgagcctgggg

SEQ ID NO: 496673 - DNA, 386 bp, Homo sapiens
agaacggaatggaatggaaaggaatggaacagagaggagtggagtggtgtgtattggagttgagtggagtggataggagtgcactggaatggaatggaatagaatggaattgaatgcaatggaatggaaaggagtcgagtggaatggagtggagtggcatggagtggagggaagtagagtgtagtggagcgtggtggaatggaatggaattgagtggagtgtaatggaatggaatggtgaaatgaaatgtgtgctaagattgtgccactgcggccgggggcggatgcacgcctgtaatcccagcactttgggaggccgaggcgggcagatcacgaggtcaggagatcaagaccatcgcagctaaaacagtgaaccccgtctctact

SEQ ID NO: 496674 - DNA, 232 bp, Homo sapiens
  misc_feature (92)..(92): n is a, c, g, or t
taacagagatacctatgaaatgtagttattacgatcagcacggtacaaatgaaacacagcagttgattatctgtacagtagctgaactagcntatcagtcttcttccagtcatcagcatagtagtaagaaaacacttggtaaggcagatggagacatatttatagtctatagtctgtctgggaaggctgactgccagacagggcagttggtcatctttacctagctgacaca

SEQ ID NO: 496675 - DNA, 186 bp, Homo sapiens
ccggaaaaaacccccgggggggggcaaaaaaaaaggggggtttttttttttcccggccctttaaaaggggtggcccccagggccccggggccccccgaaatttttttttttttaaatttttttttttttaaaaaaaaaacctggggggggttttaaaaaaaaaaaaacccttttttttttcgggga

SEQ ID NO: 496676 - DNA, 304 bp, Homo sapiens
gttaaaaacccctggcagctaaccggtttgactatagcaagaacactatccgcaagtgctaggataataggtatagaaccactgcgccaagccagatatagtatatatctatttaatctagctagtattacctaacatatatataagaatctaccgctatataagaggtacacaaacctatagtgatatgtatatatactatacctcatagaataagaccataattttcactaataaaagtagtaccctcatgtagcaacagctactataaaataacatatctagtacaatactctagataata

SEQ ID NO: 496677 - DNA, 280 bp, Homo sapiens
gcagaccaatgcattcaggattcagtactcttataagtcttgactacctgagtgacagggaagatctgtgatgtgcagcaatttaaaattttgcctaggtaccaacttgaatctcacaagcttggattcccaggatggggtcccttaagtttaaatctccctttaaaaggcttattttaaaaaccactagtcctgggaggacagtacagatttttaaaataagggaggtttttaaaaccaaagtagtgaatttgacttaatagtctaacttgtgaatgaa

SEQ ID NO: 496678 - DNA, 1599 bp, Homo sapiens
  misc_feature (60)..(60): n is a, c, g, or t
  misc_feature (62)..(62): n is a, c, g, or t
  misc_feature (70)..(74): n is a, c, g, or t
  misc_feature (76)..(77): n is a, c, g, or t
ccacgcgtcgcccacgcgtccgtggtaataaaatttgtggatgcgcttcaggagcgtggntntctgccannnnncnnattttttgacaaggttttcacaagtgttaaactgatgtccattttgaggaaaaagggggtgaaagccacaggaactgttcgtgagtacaggactgagcgatgtcccctaaaagaccccaaagaactgaaaaaaatgaagaggggttcatttgattacaaagtcgatgagagtgaggagatcatcgtgtgccgctggcacgatagcagcgtggtcaacatttgctccaatgctgtgggcatagagccagtgaggctgaccagtcgtcactctggagcagctaaaacgcggactcaggtccaccagccatcactggtgaagctgtatcaggagaaggtgggtggcgttggtaggatggatcagaatattgccaagtacaaggtgaagatccgaggcatgaagtggtactcaagctttattggctatgtcattgatgctgccctcaacaatgcatggcagctgcatagaatctgctgccaagatgcccaggtggacctccttgccttccggagatacattgcctgtgtgtatctggagagcaatgctgacacaacatctcaagggaggcgaagcaggcggttggagactgagagccgcttcgatatgattgggcactggattatccatcaggacaagaggacccggtgtgccctctgccactcacagaccaacacccggtgtgagaagtgccagaagggtgtccatgccaaatgcttcagggagtaccacatccggtgacatcatgagacatgcttctttggtttataatgagatgtttacagttaaatacagatggcagttgagcacttctgttttgtgttggaaaaaagacctgaatttctaatgacttgattttctattttctccctacccacaatacagttatcttttttattgtgttgtgttatgcctacatgtgatataaattaatatttatattcatttatatttatatttttgaacttatttatttaaagttatggatcactttttattcaaataaaagttgtgctttggggtatatttgaatcctagcaagaataatcaaaggaaaacttgcaagaacagtaagaagactttaccattgcatgccatggtttataatctaagataggcaatagtgtataaatatcatgtaaatgtgatggatttcttaatcatatttatttcatattaatccaagtttatcaaacttttgagggataatctgccttgtatttagtcagagggctagaggtgcagatttcatattttcttaatgaaaatattttcctaatacacatatatcaatgtgagattcatttttgtaaaaaaaattatttttttaattttgtgggtacatagtaggagtgtatttttatgggttacatgagatattctgatacaaacatgcaatgtataaaaatcacatcagggtaaatggggtatccatcttgtcaaacacttgtcctttgtgtttcaaacaatccaattatactgttagttattttaaaatgtgcaattaaattatttttaactatattc

SEQ ID NO: 496679 - DNA, 136 bp, Homo sapiens
ggctcggtacctgatatgttatttccaatgcctcgcaaatgtatataatatctaagaggaaaggttttgtcatcccagctgttgtccagctttggtgagggctatatgtaggagtagacgtgatgccacaatctac

SEQ ID NO: 496680 - DNA, 167 bp, Homo sapiens
ttggggcagtttaatggcattattgtttaggaggtgaaaataccaggacagagtgtttaatgaggcctgactccggtgacgtggggaagctagccgcaagggccttattgctcaatgtccatccgctgtttccggtttcccggtgcccacagcctgctctgctgcag

SEQ ID NO: 496681 - DNA, 320 bp, Homo sapiens
  misc_feature (82)..(82): n is a, c, g, or t
tggttgtacatcccacttgcccccacacggagactgactttaaaacccttcatccaatggtggtaacccccgggttttcccntgccccacctcacccacccaaaaaagcacagaccccgccaggggcaggggccccccgcacacccttgttccgggcctgtttgggactggccttcccggctcaaccagttaggctcaaaagggacccaaaaagggatggaaaaaaagaacaaaaagaaactgttcctcccacccccttccctgatgccaggggcaccagactgattttgaggcacaaataaaaaaggcttcataccgga

SEQ ID NO: 496682 - DNA, 469 bp, Homo sapiens
atcacagtggagtaacttagccaattctaacttcttggccaccaggagcaatctcatctaagagtcttacggatacacataagccagaatggttctcagcatttaccctaaggaaaggtgcaaacacccatggataaatgccacacaaaatgatcttatcaaatacagagatggcctgtccttgggttaggtgggatgtaggtggaagtgggtcactatgccatcatagcggccgtatttataaagatcaattgacaccaggaccgggtgattgggttctgagaaagggagcctggaggaatcgtggggagagattttcagggagagccagagaaatcttcctcaaatgacagggtccattataggcctaaggaaaactcaactggccatattttgttaactctagcaaagcttatgataggtttcaataaattagcacctgaatgaagacttctgtctccatgaaggc

SEQ ID NO: 496683 - DNA, 248 bp, Homo sapiens
  misc_feature (20)..(20): n is a, c, g, or t
  misc_feature (163)..(163): n is a, c, g, or t
  misc_feature (221)..(222): n is a, c, g, or t
tctctgtgttttcttgaatntctttgagttttctcaaagcagctattttgaattctctttctgaaagaaggtcacatatctctttcttcaggcttggcctctggtgccttattgagttcatttagtgaggtcatgtttttcaggatggtgttgatgcttgtgnaaatccacctgtatctgatctgggtgttggaaatgttagatatttactagtctttttnngtctgggcttgtttgtatgcatcctc

SEQ ID NO: 496684 - DNA, 145 bp, Homo sapiens
agaaaggcagcaacaagacgggctcgggagactcttcttccctacttaccgacaacataactaggttcttcgtatgtagctctgagccccataagcttttactatgtcattggccttgcagcacacccccagcacacagtcactc

SEQ ID NO: 496685 - DNA, 140 bp, Homo sapiens
gattttttttgtggcatgaaagttaaatgtctatattatggtagaaatactcctgaaggatattgtacttctttagtgctcccagaggaatttttaataaaagcaccttccttaacaataaattctttcacggacttata

SEQ ID NO: 496686 - DNA, 1427 bp, Homo sapiens
  misc_feature (165)..(165): n is a, c, g, or t
gatcgtgtcgtgggatggccgctgggccgacatctttctaagtctgcttcgagcacccttcagttccatggccaagagcccatctcgatgggcgtatatctctccttccagatggctctgcacgctggggcgcgtgtgcctgcggaatggctctccagtctgaangtgcaatcaattgcgcactgaaactgcgtccaacagtcgtatgagacatcgtttgcctggactactgaagtgctcaccggggagaggcgctagacgaccgactgggtcccctaacagcgatctgccagtgaacgagtgtcttccctctttctctctggagccgccggccatgcaagaccgaggtacgaagactgtgtgcagtcgccaatgtcccccgtgcaagaaaacacccttcgtttcagccagagcgtccccaacgggcaaacgaccgcggaggagtcaacgaagagaaatcttttatgtggcaggaaaggagtgccgttcaccaatacacttatttggagaggagggcccctcctgtgaagaagttgacaagagcccaatttaccttctaatgtgttgcaccctggcgttgttggcttttgtcgggaattggcttcctcaacatccgttgtgcactctttcggcaacgttcgtcttcacgtctttccattgtcggagcacgcgggcggcaacgatacggggtttaagacaacccctaaggaaggaactgccgagacgaagaggccaattatatgggaagccacccattcacgaaacttcgggatatccgagcaaaaaggagaacagggtggttaaaaccatcagagactaaatcttcgccattgacgtcccgttggcgttacacacagcaaggctggaaccgacacttctggttggcggatttagagaagggctgccccaagaatggttaaaccgacgccacagatggggtgtcatcatcttggttgatttgctcaccacacgtgggagcgtgtcccgatttgcgcagatctgcgcgaaaaattgcccaattggtcgtgtggggtcccccaatttcctccggtcccctttgggtcaaaaccatttggtgttctccaccatttggtgacaagaacgggacccgccctttacatttggggaaacaaactaaacaagagcactctggttgggggacttaggtagggacgtaggggagcatgttctcatattttcaccgcacaccaacagtacggaggtggacagtcgctaaaatcgcttacacagttttcctctatattacgacaccagagcatattcacgcgcctccccagcccttaaagggaacgctggctcgccacccacacgtttttcacctgtttacccaaacagtttttgccccactaccacgtttttggtcgagtacacagagagtggcccacaatacgctggctttccaccct

SEQ ID NO: 496687 - DNA, 128 bp, Homo sapiens
accccgtgtcttcagaagcttatcttgtctcgactcttgttttcgaccctcatctttggacatgtatgctaagatgatgtgcggcatattcatgcccccggtttcacgaagggaaattaaccagatca

SEQ ID NO: 496688 - DNA, 145 bp, Homo sapiens
  misc_feature (36)..(36): n is a, c, g, or t
atttttcaagtgctgaaacaaaatagttgtcaatanttgagagtagttgttggttgggttggtttgggttttgcgaaaattttcacttcattcctgaaggatagttttgctgaatataaaatttaatattgacagataaaagaaa

SEQ ID NO: 496689 - DNA, 399 bp, Homo sapiens
aactggtatataatgggagaatctctcgatagaagtggacttgcatatattggggcagggtgatacagtctatgcggttttgggcggggtaacaagaggggatgagttgtgtgaatagcccaagactcccatgagggagatgccatgagccggccaaggccttcccctggcactggcacacagggcctctgcggagcacactggctcacccagtcctgcccgccaccgttatcggtgtcattcacctttcgtgtcttttcccgtttatcctctgttgattttttcttgtgctttatgggttaggcttgtctctcttgcatggtttggagctgatcgcttctcccccaccccctagggtaccagcaggcagagccttgccctctgctcaggctgggcgtg

SEQ ID NO: 496690 - DNA, 390 bp, Homo sapiens
  misc_feature (368)..(368): n is a, c, g, or t
  misc_feature (375)..(375): n is a, c, g, or t
atgaaatgttcaattatattaaaacaaacaggcatgagctactgcgcttggccaatatattttgaaagagttagatatgaagtaaaaccttgctaatccttaagcctaataattcttgaccaagggtaaccctgggtttatccctagatttgtttagaatgctttgtaatttactttgcattcttaatttgaaattagacccaattctggcctctttggaccatctgagaattaaaagtctaagtactgcttcctagggagttcatgctagctggggaaagctttatgtgttacctgatagaatcaaagctaagctcttagcttgcattcccagcattactgatcagttctcctaggtataaaatttnaaagganctatagctttaacca

SEQ ID NO: 496691 - DNA, 200 bp, Homo sapiens
  misc_feature (39)..(40): n is a, c, g, or t
  misc_feature (92)..(92): n is a, c, g, or t
  misc_feature (138)..(138): n is a, c, g, or t
  misc_feature (188)..(188): n is a, c, g, or t
cgggcatggtgccagcctgaagagcacagccaacatggnngtggggcggggggtggctcaacgagtcccttctgctgggcctctaccttcangctccaacctgccctcgctggaactgctcatctgtcgatgcctctnccacctccctatgccctgctacttaaactgcgtggcgaccccttctgggnccccgacatccg

SEQ ID NO: 496692 - DNA, 808 bp, Homo sapiens
  misc_feature (4)..(4): n is a, c, g, or t
  misc_feature (105)..(105): n is a, c, g, or t
  misc_feature (135)..(136): n is a, c, g, or t
  misc_feature (138)..(138): n is a, c, g, or t
  misc_feature (184)..(184): n is a, c, g, or t
  misc_feature (190)..(191): n is a, c, g, or t
  misc_feature (193)..(193): n is a, c, g, or t
  misc_feature (226)..(226): n is a, c, g, or t
  misc_feature (231)..(231): n is a, c, g, or t
  misc_feature (234)..(235): n is a, c, g, or t
  misc_feature (243)..(244): n is a, c, g, or t
  misc_feature (255)..(255): n is a, c, g, or t
  misc_feature (268)..(268): n is a, c, g, or t
  misc_feature (273)..(273): n is a, c, g, or t
  misc_feature (276)..(276): n is a, c, g, or t
  misc_feature (453)..(453): n is a, c, g, or t
  misc_feature (460)..(460): n is a, c, g, or t
  misc_feature (481)..(481): n is a, c, g, or t
  misc_feature (542)..(542): n is a, c, g, or t
  misc_feature (546)..(546): n is a, c, g, or t
  misc_feature (800)..(800): n is a, c, g, or t
gtgncgagcttccagcttggccccagttggttcgtagttcggctctggggtcttttgtgtccgggtctggcttggctttgtgtccgcgagtttttgttccctccncagcgctcttcccgggcaggagcgtgaggnngnaggcggcacgcggtccccggccaggagcaagcgcgccggcgtgagnggcggnngnaaaggctgtggggaggggcttcgcagatccccnagatnccnnagttcctnnaagacccctcngtccttacaaaanacaanttnaagatttattttgtctccaacaattttacgcttcctgccggtgaacaacccaaagacgtttacttccaactctaccttcaacacctcactgctctcaaccggccgccgctccccgcctgcaccaacagcaaggtgcccccggacttctccatttacgaagagcgcgagcccaccccngtcctcngctctggggccgccgccgcgngccggagccgagcagccgtcggcagggtaaggacgcggggccggggctacaaaggcgggcntttngcggttgccgcgcgcgctcgccgccgtttgcagcccctccctcccgggcgccccctcgggcctcccaggtgcggggctgtccctgcgccccctcgcgtcgccccttccccgcggggctgcaggcgccggagcggagaggccagaagttggggccgcggggttcgcgttctttgacgtgtgggtctgggaggtgtggagttgcgttggcggcggttgttttgcacgcagtcgacgccgcttccctggaccaccanggcgcctg

SEQ ID NO: 496693 - DNA, 524 bp, Homo sapiens
  misc_feature (117)..(117): n is a, c, g, or t
  misc_feature (152)..(152): n is a, c, g, or t
  misc_feature (156)..(157): n is a, c, g, or t
  misc_feature (165)..(165): n is a, c, g, or t
  misc_feature (169)..(169): n is a, c, g, or t
  misc_feature (293)..(293): n is a, c, g, or t
  misc_feature (302)..(302): n is a, c, g, or t
  misc_feature (323)..(323): n is a, c, g, or t
  misc_feature (339)..(339): n is a, c, g, or t
  misc_feature (353)..(353): n is a, c, g, or t
  misc_feature (371)..(371): n is a, c, g, or t
  misc_feature (373)..(373): n is a, c, g, or t
  misc_feature (381)..(383): n is a, c, g, or t
  misc_feature (386)..(388): n is a, c, g, or t
  misc_feature (390)..(390): n is a, c, g, or t
  misc_feature (392)..(395): n is a, c, g, or t
  misc_feature (424)..(424): n is a, c, g, or t
  misc_feature (429)..(429): n is a, c, g, or t
  misc_feature (434)..(434): n is a, c, g, or t
  misc_feature (441)..(441): n is a, c, g, or t
  misc_feature (446)..(446): n is a, c, g, or t
  misc_feature (491)..(491): n is a, c, g, or t
atgccaaatttttattaacaccattttatttcttttgcagctttaatttttaacattataacatttactggctcctctgggtgactaaatatcttcacatgcccactagctaaaaanaatttctaagtagaactcaactgaaactgaaagcnactnnacataaanaaanggcatacttatgtttatttgctctcctatgatgaatcctgtttacaaatagcataactgcaaagatttatatgtaatttctaaatccttcaggttgctctaccattcatcttcttatgtctggnaagaaaaanactcttagtgaacactttgcngcatctcttaaatganattagtctccagtntatttcctatagaataangnaagaattnnnaannnanannnnccttcaatttctaaagtttccacattcanaaaantattnctcctgnaggantttgcaggagattcctattgcctatagtctttcccaacatttgcnacatgtacacagatttttcgtatttttattata

SEQ ID NO: 496694 - DNA, 154 bp, Homo sapiens
ggtcggagtttactccgtgcgtgtctttcgtctggtccgtgttcaacagcctcttcattaacacctgctgcctgtggcttcatagcattcgcctactccgtgaatgtctagtggacagcgaagcatggttgtgcgaccgtgacctgtgggccct

SEQ ID NO: 496695 - DNA, 174 bp, Homo sapiens
tagacgaacagattctcagagccagaatcacgcaggtcgaagcctccaatgacgatgaagcattggcgctcgtacgggatgagctgatatcgatccataacgagcaggctgaaagtttggagaagacaaggggtgagcttgtcaacgtatctgcaaagcttcaggatacgcagg

SEQ ID NO: 496696 - DNA, 698 bp, Homo sapiens
  misc_feature (12)..(12): n is a, c, g, or t
  misc_feature (26)..(26): n is a, c, g, or t
  misc_feature (58)..(58): n is a, c, g, or t
  misc_feature (417)..(417): n is a, c, g, or t
tggatgcccttnctaaagactcagtnacagtgccagctaggtggcaatacttgcaagncctgtggcaaagttctccacaaggctggtatatgctctgaatcagtgtccagcatgtggtgttgtttctcccatagccaggattcacaagtccaggaatcaagggatggaaatgagagcgacactactcactattactcctagtgatccactagcaaactttttgcttctcgtttctatgtctttatgctatgctggcctagaggtcttagttccaaagggaggaatgtttctaccaggagacaccacaatgattccattgaactggaagttaaaattgccaactagccattttggtttcctcatgtctctgaatcaacaagcaaataagggagtttctgtgctggccgaggtgattgntcctgactaccaagggggaaactggactgctcctccacaatggaggcctcatccaatcagttgaagaccttgggagtaaataggctggagtcccctgaggaagagagaattttgcccccagactgtcttcaagcttgatctgcaatataaactcttccctgagtctccagagtaccagcctatcccgcagattttggatgccacagattttggacttggtagcctctacaatcatgtgagccaattccttaaaaataaaagtcttcctttgtcttttaaaa

SEQ ID NO: 496697 - DNA, 298 bp, Homo sapiens
aatctcagtaacgtatgtacatagtcccccaaaaaaaaaaagcagcattggctgggaacacatcagtataagcaaacaaaacatcaaagggcctgaattctaaaataccttgggattatataaaattacatggtaaagttacaaatgtggctcattctggagaaatgttggaatgtttaaataatgtggccttaatacatattatttcacgacattaaaaaaaacaagggtgaatacaaggtatcatcatttcaagggtaaagagataaagcaagtacatatacgtgtagaaatggaa

SEQ ID NO: 496698 - DNA, 364 bp, Homo sapiens
  misc_feature (30)..(30): n is a, c, g, or t
  misc_feature (119)..(119): n is a, c, g, or t
  misc_feature (137)..(137): n is a, c, g, or t
  misc_feature (300)..(300): n is a, c, g, or t
  misc_feature (329)..(329): n is a, c, g, or t
  misc_feature (343)..(343): n is a, c, g, or t
  misc_feature (354)..(354): n is a, c, g, or t
aaagcagccttcaggctactctctcttggntccttgctctggggaagaacactcaagcagctttagaaaaagtccacgtggcaaggaattgtggtcttttgccaacagccatgtgagtnatccatcttaagagtggntcctccagccccagtaaagtgttcaaatgacagcagccctggctaacatattgactgcaacttcatcagggaacttgagccagaaaaactcagctaacctgctcctaaacttctgacccacagaaatggtgagataatgaatgcttgttttaagctgctaagntctggaataatttgttattcagcagtagnataactaatacaangccacccaagnatcatttccc

SEQ ID NO: 496699 - DNA, 788 bp, Homo sapiens
  misc_feature (126)..(126): n is a, c, g, or t
ggaagggaaactgcgaggcgaaggtgaccgtcgaccgtgcatttcagatctgctcgtgtagacctggtgcatcaccaccatgttggtgcaaggttggtgtgtctccgtacattaccttctagggtntgccacccagtttcaccaaggcctcccctgttgtgaagaattccatcacgaagaatcaatggctgtgaacacctagcaggaatatgccacaaaacaagaattgggatccggcgtggagagaactgtgcaagaactcaaagaggcagcatgggaaccatcgatggcaaacaacatatttaaacaattgatcagatgggaagcatggtttgtggctggaggggctgcttgtggtcttggaagcattgtgctactatggttgggactgtctaatgagatgtggagctattgaaaaggctgtaattgtggcctcagtatgtcaaggatagaattcattccactatatgtacttagcagggagtatggtttaacagcttgtgtctgcatagcaaatcagagaacgcctgtcctcatgaactttcattgatgagaaggctcttggggtgacaaattggttgtgacctttgcagccatggttgagctggaatgctgtacgatcaatacaatatgacaggagccaggccaaagcatttgcttggtgcacttcctggttgagggtgcaggtggtctccgaccaaattaggggctctctccacagacgcttggcacagtggttgggagccccaattgcgttggcccgaaatttaaatggcccgatgcggcca

SEQ ID NO: 496700 - DNA, 363 bp, Homo sapiens
ggattcattgtctacccccaacgcccatacctatcaagctggcactccttataccccattctctgtttcatctcatcccctgttaatgaggcttttgcccttatggacttaccaattctgagatattgcctatagacagaatcacacactatttgacttttttttttcactgcaacctctgccttccacggtcaagagattctcctgactcagcttgcaagtagctgggattaccggcatgtggtaccacgcctggctaagagtctggtcttcttagtagggacatgttggccatgctggtggagctcctggcctcaggtgatccacacgcctcagtgtcccacagtgctgatattacggcct

SEQ ID NO: 496701 - DNA, 219 bp, Homo sapiens
acgctagtataactgagcttatgttatgagatgattttacaaagtcctagataaccacaggactggtggcacatgcagggaatcaaccctgtgctcagacgagttagaactcaaaaccccaccctcaagctccagggaaaggagaggggctgaaggtagcactgataaccaatggccaatgacttaatcaatcatgcttacctaaggaagcctccataa

SEQ ID NO: 496702 - DNA, 116 bp, Homo sapiens
gcaggaataggaatcatctgtgtaccacactcgtgctgacatcgtgattagatgaggcacagtagtctatctttgtgcacgttttcttatctgggttaagagcaaatccttcatgg

SEQ ID NO: 496703 - DNA, 299 bp, Homo sapiens
accctctcgcgattcggccgatgggagcttgaggtccccgggcactcctgatggacgtcaactattcctgcaggtcagcgccaactattcttgcaggtggtcaccaggttcatcgttctctcgggtagttgtcgttcacgcgatgtagttgtcgtcggttcagtgtgtagttgtcgctggtccggctcgtagttgtcgtcacggcgcggcgtccacggcaggtggcctggcgcgttgctcggcctcgtcggcgcgcttggggcgccctgagaattccaggatgacggaatagtggacga

SEQ ID NO: 496704 - DNA, 386 bp, Homo sapiens
tacgggtccacgatgtcgttgacggcgctgggaaacttcgtagcccacgcacgtattgctcgcggttgtactggttgactgcccggctcgccgataaacacatcgcgcttgatcttgccgttggggttgtcccaccgcgtgctggacgccggcagggcttgggcttcgggcacgcctttatctttctggtactgggcgaacagggtcaggctgtgtttcgtcgttggggcgccaggtgaggctgggggcgatgaactggcgcttgttatcgacgtagttgatatcgtcttgcgcatcattcgccaggccggtcaggcggtagagaaactggccctcctcgtccagcggggccggccaggtcgatggccgggctctggtgttcggaa

SEQ ID NO: 496705 - DNA, 415 bp, Homo sapiens
atgggccaaaaaaaaaaaaaaaaaaaagggccaatgctgtgggtagcccctttcataaaggggttaagctcattccccagggaagagctttcatggcctaatcccctccaaagacccccccttttaatactattgcattgcagattaagtttcaacatgaattttggagggatacaaatattccccccctagaatatagtaaaataggataggatatattttttgggtctgtctgcttttgcccagggtaatgtttttgaggttcatttatggtgttgcatgtattagtaggttgtatttattggtgcatagttattcccttgtatgtatgtaccccccttttctttttcctgctgatggatattgcattgtttccagttttggggtattatgaataaaacccctctccccctta

SEQ ID NO: 496706 - DNA, 1165 bp, Homo sapiens
gctagaacacaggtgatctgacggagagttgagtcaacggcgcgtggaaggagtcctccagaccactatggtgcactcaagaggtagtcctctgtgctcccaggaatggtcgctgctttggtgtgcctggtgtgacccatctacttccgctgggaacagtcatgagagaaggtagggactcgtgcaacaactgcgtgctgaggaatgatcagagcagcaggagacagaggccttgggacaattacctggcaatatgcggagctgaacatcttcacttcctgaggggatctggcgcttctgggaaagtcaaagcctctcagggttggcgtggctggtacgagtatcgtccatcgataggcttacatactggtgacaagggggaaccgaggaggccgcccagaggggaatcccatggcgttccagcacgaaacatcgcgtccatacccttcatatgtgtcgacaggcagtcatgcttttccttcgctggcggcatcaggatctaattactctgtgcctggtacgagggacgggggactgccatcttcttcaggctcgcatggatcgtctgagacgaacagtacctagtactcacatctcccactggtggaactagacattggtaaatgctgtagctgcaaatggggtcactccatttggtacccctgtgtaccagggtaccctcactttagcaagtgccagggaggcttactatgccactgcaaggaggtgtgagtcaggggacgaaggaagtgcgtaaaaaggcaatgaggaggttgcaagtttgcacaaggaaatagggggaatgattgtggaagggccactggttgcaacgttatgcccaccacccttatgcgtgtactctgggggaacgcgacggtttgtttcccagccctaccggggggtaaataatggacaaaacttgtttgacaacgaaatgcccctaatcaaggaattctatggactcggccccctagtggtccctggtgcggcactgcggtcaaccccttgcacagactcgttcagtaaggtgcgactccctgttaaggcgctgtggggtgtgaaccctgtggccctatttgggcaagggatctccttgcaaaacctgtgcctgttatatggcccaggcaaaaccgggtgtacctcggtctcgccatgtaatgtgtgt

SEQ ID NO: 496707 - DNA, 950 bp, Homo sapiens
  misc_feature (383)..(383): n is a, c, g, or t
  misc_feature (398)..(398): n is a, c, g, or t
cttcatagacccaacccagagagttaagaccaggtctctctctctctctctctctctctctctctctctctctctctgtgtgtgtgtgtgtgtgtgtgtgtatagctatgctactgtgtactactacactatcataacaaaccaccaccacaccactctcactatgcgtagagatgcactatcacgcgcgagcagacagatgtcgtcgtcactataggaaacgtagcagctcccagcactcagcagggtccagcaggagaggcacaaagaaacgcacagcagctcttgtcatcatcagcaagagaggaaacatctctcgtgcatcacccctctttaaacaggccttctatagaaagcagcaaaacagaatgcacgccactacnacataatatacagcnagcggcctcttgtaggagctcatgataaataatggtaaatgtctgcgataatctaatctataataatagtagatctcttttatgtagtatggcacagcaaacatcatataatatactatacttaattagaacgagaatgcaccaccagcccgagacaggtctgccagtactcactctctccaatagttagaatactgctgcgaatgattgttggtaatgtatcggctgtatttataataagtacgccagacagtatgtagcaccagtagaccaatcattagggcagctggaatattttagcttgtatgagagtgttgattcctaataggtgataaagccatgctgttgtccgcatgtatactataagctgtcaaatcattctgacagatacttaagataatgacaagaataaaataaagtcggcagacccccgtgaagaaataagaacaccccaatcttcgttggtgtccataatagaaaacactatggtaacgaggaaggacgattattcccaataaagggggggaaaaataactagaacacggataatgg

SEQ ID NO: 496708 - DNA, 92 bp, Homo sapiens
agctcccagacatctgtgtacttctacttctggcatcactccgaatcaggatcagccccagcattttggtgatgggactcgactctccatcc

SEQ ID NO: 496709 - DNA, 406 bp, Homo sapiens
taatctgtactcattgcgagatggtgggaaaagcgtagtacctggactggatagcaccgtccctcatggcacagtctctaatggcctcccttggctaggggagggagttccccaaactcttgagcttcctaggtgagaacagagctaccctgcttctgttcaccctccgtgggcttcacccactgtctaaccagtcccagtgagatgaaccaggtacctcagttggaagtgcagaaatcacccgccttctgcattggtctcactgggatctgaggactggagctgttcctattacgccatcttgtcagggaatcagattatttgttttttacttgttgatttgttcaaggccctgttagattcttgatattagctccctaccttaccatatacaaaaattaactca

SEQ ID NO: 496710 - DNA, 3516 bp, Homo sapiens
atggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaaactttgggatttgaatcaaaaaaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcctttggctagttgttcagctgatggaaccttaaagctttgggatgcgacatcagcaaacgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataa

SEQ ID NO: 496711 - DNA, 162 bp, Homo sapiens
cacatatgcagatactcaggagtgtacatgccagggataggattgccagagcaagatgaaatacagcacaggaggtatagaaatacctcctctgtttcttgcccttccctgagatatataggaatgttctccgattccatcagcccctctctgggcacctgg

SEQ ID NO: 496712 - DNA, 365 bp, Homo sapiens
ttttttttttttcttggagaagggagtctcatcggtcacccaggcgggagtgcaggggggcgatctcactacaacctcggcctccggggttaaagcagttctggtctcagcctccctagtagctaggactacgggcgcagaccaccacgccgggctgattttggtatttttagtggagacaggatttcaccatatgggtcaggcgggtctcgatctccggccctcaagtgatccacccacttgggcctcccgaagtgtgggggtcacaggtatgagccgccgggccagaggtaccattatatctggaattttttttttgggacatcctggagtgggcaataggtgggcgggtacctttaaggggg

SEQ ID NO: 496713 - DNA, 638 bp, Homo sapiens
ccaatggggcggggtaatcagtcttgtttcaggggcttcaacagagggaagctgttcataggacttgagtccaggttcctcgccgtagtagataggttccccatgatgaatgtcagctcggtcacgcgtgttgcaaacgaggtagtagtgtccatggctctctaagactttttcaaagtcatggaagtagcgatgtatcatgttctctatgatcaaggcaagtttggcatcaatgtcgtcagctggacatacgttcagaagtaggatcatttcacccgaatgtgctggaccgtctatatacatatcaatcagggctctctcttatatgtctgtcccatagaggttgtgtttgctgccaatgtagttgagaatggctctggtctgcaccagcttcgtcccatcgatctcacacattggcacctgctggaacatcgaatatcgttcatttcttaacttgtccaaatcttatgcagattttataaatttctcatctcactctactccatctgcagccaggagccagtgggtggagtccattgtgccccgtgcatcgaagtagtgtagcttgggtttgtctgccatgatagcagtctcctgtaggtttctttaagctgtgttgaacgctgtcgccctcgtgc

SEQ ID NO: 496714 - DNA, 586 bp, Homo sapiens
tactgtatctctaacattaacgttcagtcgatgtagctaacaatagtcataagatcatttaaaacttaaaaaaaaaaaatcaaccagacacagtggctcacgcctgtaatcccagcacttggggaggccaaggcaggtggatcacatgaggtcaggagttcgagaccagccgggccaacatggtgaaaccccgtctctaccaaaaatataaagaattagctgggtatggtggcatgcacctataatcccagctacttgggaggctaaggcaggacaatcgcttgaacccagggggctgaggttgcactgagccaaaatcatgtcactgcactccagcctgggtgacagagtgagattccatctcaaaaaaaaaaaaaaattgggtcatgacccagcaatttcccccttaggtatgtcctcaaggcaaatgcacagatacatgctcaccaggtagtaaagggataataaataatagtagcacagtcccaaatagtcctttaatggatggtacggtgggatggtactcagtttgggaactgaaaaccttggagatgtccatcaacaatacaaacaataaacaggtggg

SEQ ID NO: 496715 - DNA, 113 bp, Homo sapiens
taatcttcatcaagtgactgatccaccgctatcgcggcaagctagctcccacatttggttttgtgtttggcttgggctcgggttagatgccgatatagccaaggaacgcgggt

SEQ ID NO: 496716 - DNA, 360 bp, Homo sapiens
gctcgacgggtctctctgtaccagaagtagtccactggggagcttcgagcgcactctgacacataacctgaacaaaaccacacatgaacatccaaataactcagccataccaagtgtattaaacggcaatgcaataaacaagggaaagactgctcagaggtcaaagtcagagtgacataatcatcagcatagcatcatagcatgtgtgggttttgtaagagtggacatgcttttttccgtacctgttttgttttcgttgagaggacattgactccatggcaggggactctgaaaagagttgaagaagtaccacatcacccaggccatgatggtgttgtagtacatggccaccaacaaggg

SEQ ID NO: 496717 - DNA, 198 bp, Homo sapiens
  misc_feature (138)..(138): n is a, c, g, or t
  misc_feature (192)..(192): n is a, c, g, or t
tagtaacactcaagattaaaaacaaaaatcattttgtaatttgtttagaagacaaagttgaacttttatatatgtttacagtcttttttctttttcatacagttattgccaccttaatgaatgtggtggggaaatttngttaattgtattttattgtgtagtagcagtgtaggaattatgttagtaccccgntcacaa

SEQ ID NO: 496718 - DNA, 164 bp, Homo sapiens
attcattaaagagctattctttgaccccccccccccactttttaaaacatatcacagcagtccagtaaaggggtttttataaaaccctctcctggtgccaaaaggtttccacacagcgcaccaggggttaagggggcgggaaaagcattggataggaagtaaga

SEQ ID NO: 496719 - DNA, 406 bp, Homo sapiens
ccacagcaaagcttatacgtgtatcaataagtacttcaaaaaataaaatggacccttatagagcaaatctgtgctagtactcaggattagtaaaacagtatgaaactaatgagatacactgatcgaaattacgaagtgacatactgatgattctgagtatgtacagggtgaggggtacaatcttcccttaagacctgccaggaaaggagagacgtggaaccaggagtggcagggacacccaagctggaggaggtgggtctgctcagtcctatgcagcgcaggctcagagcaccaccgaagacctttctgccaaagatctcatcctacccatgagaaccatcatactccagagactaaaaaacgccagtcccagctggagacgtggaaggaggtccattcctatggg

SEQ ID NO: 496720 - DNA, 328 bp, Homo sapiens
aaaaaatctattaaatccctttccatcgatcagctctgcttctttgcccagaggcatattcacgtctactggagttgacattctgctgctctgtcaactagtgggggtctgaaatgacagacgagaatttggaggttggcaccagacgagtatatcagactgatcatcgttttggttgcagattcctggatttccctagcaggctggcctctcatgcgagggcttatacaggcagtgcattgcaaaccaaaagggaacagagctaattctggtggtgtggatggggtaaaacagtcttcccccctagaatgtcaatggtaccgagctc

SEQ ID NO: 496721 - DNA, 357 bp, Homo sapiens
ctgaacctatatgtgactcctatatgcagcagcccagacatgcacacctatggggagcattgagtcactctcttctcattccgtctgaacaaagatagcactacaaagtcatgcttcctgccagcccagtggagaaatcttggagggattcccttggatttgcgaacccctgtcaatcttccaactggacatgaaaatgccgttggtcattgtggacaacgtatgtccctgaagtcaatgttccacgagaaagatgcaaccaatgacatgatgcatgaatcatgagctgcgcagatgtgtttgctctctggtcacatatgcccacgtgagacgattttcgccaccccatatgaccta

SEQ ID NO: 496722 - DNA, 460 bp, Homo sapiens
  misc_feature (285)..(285): n is a, c, g, or t
tggccaggctctctactactctaaggaaaaatatggaattagttttcacctatgctttaacaattaccacaaactcaggggcttaaaacaacacaaatttatcctctcaccatcccagaagtgacaaatctgagagggggctcacggggctaaaatcaaggggatggctgcgcggggctccttcgggacattctaggggaaaagtcggttttctggttttcagcagctaaaggcggccggtattcctgggctgggggccccctccatctttaaagccagcaaggnccagtcaggttttggtcacaaggctatctctcgggttcggacacttctacctccctcttcctgatttagggacccctatatttacgggctgggcaggtgggctcagacctataatcctagcacttggggagcgcgaggggggcagacggcttgggctcaggaggtagagagcctg

SEQ ID NO: 496723 - DNA, 309 bp, Homo sapiens
atgctggagaacaatccgacgtacacagtacttactaccatggtccctaaaagaccatatgattgtattatggccttccccctgagtatgggcaggatccatgaatgggatggattacattcctttgattaagttatgctgtgtgttaaaagagattttgcaggtataaagtccctgatcagtcgactctcagttaatcaacagagagcttttcctctgtgggcctggtctaattcggtgagccccttcaaagagggtcggaggctgtgcctgaagacagagatactttggttgggtttcgaagacgca

SEQ ID NO: 496724 - DNA, 290 bp, Homo sapiens
caggagggacggagcaggatcacactggatgctctctgtgggcccagtgtcctcacagggtccttaggagagggggtgggagggtcagagtcagggggagcctggaagacatagcacagatggctttaaaggaggggccacgggtgaaggcgcgggaacctccagaccccggagagggcaggacccggattctccccagggcctccagcagccagccctttcaacacatggactttagatttatttcacttttgggactgcaagagaataaactgtgacttttgttacag

SEQ ID NO: 496725 - DNA, 319 bp, Homo sapiens
gggggttttcatttaatgggtccccccccggttttaaaagggggcatgtcccctgctttaccccttaagggcggggggtgggccctggccatggtcccccgctggggggcggggggccctggggaccccaacttccccggggggttggggggccccccccatggaaccggtcccctgggtttttcccgggtgggtacccggccgaaaattggcctggaagccgttttgccttggggggggggcccggtttttagggctgttttggtcccccccggggttggcctggggggggggcccctttaaccccccccctcctcca

SEQ ID NO: 496726 - DNA, 128 bp, Homo sapiens
  misc_feature (123)..(123): n is a, c, g, or t
  misc_feature (125)..(125): n is a, c, g, or t
tattcatctatggccaaccagcattgtcaactcacctactcgaccgcgtaccatagagcgcctatgagacagcaaggatttgcatgccgtaggctccgttaacgcgctttccctgaacgctancnggg

SEQ ID NO: 496727 - DNA, 563 bp, Homo sapiens
cggctccgcgcggtgaggttgtctagtccccgctcggaggccactgtccgtcccagggtcccctgccaatcggtccaggtcttcggaccccagtagtcctcgaccactttggccgccctgccaacccggccaatggtcttccatccaggtgaacgggcggcccctggagatgattgagccgccgccccgctcccagtaccagcgtgctggaggcccgttctgcttcttccggccaggagccgatttgctggtgtagacctcccgtgtcccgtgtaaagggtggtggtcacgtggccccagatttatgctatccgtccgtccatctcccaagccctggtggcctattacccagaaatatgtggatgaggcttcccagaaggagatccaagacatcctcatcccgtatgaccggaccctgctggtagctgaccctcgtcgctgcgagtcccaaaagtttggaggccctggtgcccgcgctcgctaccagaaatcctaccgataagcccctcgtgactccaaactcacttgtataataaaccgtttttgagggattttaaagttta

SEQ ID NO: 496728 - DNA, 723 bp, Homo sapiens
ccacagatggtgctctgcgccgcgccgctgctccgcgcgccgcgtactacccgccgtggcacacactaatagttgccccccgtcgcgagtattattattcgcgcgcgcactctctctcggcgcgcgcgcgcgtgttcactactccccctcgctgctacacacacactgctctccacacagatatacttttaggacaaaaataaagagcttctcacacacctcgggagggggcaatatatgtcgcagcacacatactctctctcagtgcgctcgtacaagataccattgacatataggatagcaaaacatatgtgcgagagcaccatcgttcctgccgctgctagatttttctacaaaggaccatcccctgggagaagatgttgtgtcatgtacccttccatggagagatatctcattgtcggtgagagagcggcgagggctccccggcgcggtttctatatgcccgtgtgagagatatctagacacacggtctcgtaccaacacacttctcgcgcacgtatgtgtgggtaacacacacaccgcgacagtacgtatgtgtgacatagtaggtgctcccgccacgcagctgtgcgccacagtctctatgtagtattgctggtagtagatctcatcctacttggtgcacactcgtactccgcggcactcagcgtgggcgcacgcattgacccgccagttattaacacaagaaaaatacaataaaca

SEQ ID NO: 496729 - DNA, 532 bp, Homo sapiens
  misc_feature (2)..(2): n is a, c, g, or t
  misc_feature (68)..(69): n is a, c, g, or t
  misc_feature (85)..(85): n is a, c, g, or t
  misc_feature (127)..(127): n is a, c, g, or t
  misc_feature (143)..(144): n is a, c, g, or t
  misc_feature (194)..(194): n is a, c, g, or t
  misc_feature (211)..(211): n is a, c, g, or t
  misc_feature (231)..(231): n is a, c, g, or t
  misc_feature (242)..(242): n is a, c, g, or t
  misc_feature (256)..(256): n is a, c, g, or t
  misc_feature (270)..(270): n is a, c, g, or t
  misc_feature (285)..(285): n is a, c, g, or t
  misc_feature (288)..(288): n is a, c, g, or t
  misc_feature (311)..(311): n is a, c, g, or t
  misc_feature (321)..(321): n is a, c, g, or t
  misc_feature (323)..(323): n is a, c, g, or t
  misc_feature (327)..(327): n is a, c, g, or t
  misc_feature (329)..(329): n is a, c, g, or t
  misc_feature (333)..(333): n is a, c, g, or t
  misc_feature (346)..(346): n is a, c, g, or t
  misc_feature (352)..(352): n is a, c, g, or t
  misc_feature (356)..(356): n is a, c, g, or t
  misc_feature (365)..(365): n is a, c, g, or t
  misc_feature (368)..(368): n is a, c, g, or t
  misc_feature (385)..(385): n is a, c, g, or t
  misc_feature (390)..(390): n is a, c, g, or t
  misc_feature (395)..(395): n is a, c, g, or t
  misc_feature (403)..(403): n is a, c, g, or t
  misc_feature (407)..(407): n is a, c, g, or t
  misc_feature (413)..(413): n is a, c, g, or t
  misc_feature (421)..(421): n is a, c, g, or t
  misc_feature (426)..(426): n is a, c, g, or t
  misc_feature (431)..(431): n is a, c, g, or t
  misc_feature (435)..(435): n is a, c, g, or t
  misc_feature (466)..(466): n is a, c, g, or t
  misc_feature (470)..(470): n is a, c, g, or t
  misc_feature (487)..(487): n is a, c, g, or t
cntggggggggctttggtttttcaggggggggggggggggggggcttggggggtgggttgggggtttnngggggagttgggagtnggtgttcgcgggggtttgggccaacagctttttgtgaaaagnttttgtgttggggggnngggggggtattggtggtggggtggggttttgtgagggtgtttattttttnttaacagagccccagantttttttttcagttacagcntcagggaaacnaggttctggttggngggttctgcagggntctttccaccactgngcntctagttccaaaccttttttgtnaaaatacccncnctcncnattncctttccaaaatncccccnaaanccccccccnaanaccaacaaaacaaaatnaaatnaaatnaaaaaaantatnaatagntaagtttngtttnaaaanacantaaagagaaagttgaggtgaatgtgtgtttngganagaaagagatagtgtanaaatgtgaaataagaaatggggaagtaaaatggaagagaaaatgg

SEQ ID NO: 496730 - DNA, 651 bp, Homo sapiens
  misc_feature (524)..(524): n is a, c, g, or t
  misc_feature (551)..(551): n is a, c, g, or t
  misc_feature (557)..(557): n is a, c, g, or t
  misc_feature (582)..(582): n is a, c, g, or t
  misc_feature (586)..(586): n is a, c, g, or t
  misc_feature (588)..(588): n is a, c, g, or t
  misc_feature (598)..(598): n is a, c, g, or t
  misc_feature (601)..(602): n is a, c, g, or t
cagtcgtgacccatgtcaaaggtatatgcagctggatgtaagttaaagtggagaaaacagattttattcagtcgctgctgacagcaggggacagagctgagctcctttcagtataatgaagagtcctggacattatctatggaatgagcatagtgagcctctgcgggatggaggcagggcttgggctcggaacagcctggcggggagctgcccaggtttcctcgtctgcctctttcatcccagacttggagctaaggaagcacatccccaaaatgccgacgctccccagcaaaggactaggtaaatagcagctgggaagacagaaaatgtagttaatgcctagcaataatggaaagaaaaacttaatggatataaggtcagcagcagaatggaggcgacaggagcgcgttcgtgaactcagagatggaccgataggaactgcccatctgcccattctgaacagcagagagaatacgatggaataaaatgagcaaagttcccgacaccgatgagacctgggaatncgatggaataaaaggaacaaagtcccngtgccngtggggccacaacacaagatccgcnttcnanttgtgggganttnngggggtccgagagcttagttggagcccaaaggcagcaggcagcgtcttc

SEQ ID NO: 496731 - DNA, 919 bp, Homo sapiens
tacgtgtctcccactgaaggcatccgtggttgtttttaatgccacaaaaaagccaacccaagatcaactgacacccaccctgtcaagtgtccatgatgctgggccctgagggcggtgaaggctttgtgggtcaagctccgtggcctgccctggtcctgctctgttgaggccgtgcagaacttcctctctgacttgcacgtattcatgatggggccgcaggtgtccatttcatctacactagacgatgggccggcagagtggtgccggctttgttgagccttggcctcgcgcacgcatgctgctcaattggccctgacacactgcaccgggaaatgctgtgggaacaccgtgttacccttggagggtgttcacgtgtccccacagaagccgagtaatggcttgggtgtgcacgccagtggttcccaccagtgccgacagtgcccaacgtactggcttcggtgcggcttcgcaggacctccccatttgtggcttgctcaacggaacgcacactgtgttcagtccttctcaggtcgcccacttgttggcacaaccgggcatctcattgcctgtggtacccccgacggcgagtatccggggaacgccgtcgtgccggttgcctcgcaggagtagctgaaaaggtctagtcgccactccacggagagcctaggccccggacattggcgtggcttagagcgccggggggaggtaggcatactcgaatcccctctgagtcttgtccttcgcgtcaggcctatgccggcggcaatgcggggccttgtctgactcgcgcctgctacttggctgtgcccccagccggccgtgtctggcccgtgtcgtcgccgtcgcactgtgctggtgccgggtcgcgtccgcccgggtggggcccctccctcgggggctctctctccttcggtggggc

SEQ ID NO: 496732 - DNA, 139 bp, Homo sapiens
gcacgaggttactttattcatcctcctactcctactactactcttcttactcctactcttcttcatcttactcttacacctttttccgggcaactttagcaggaccctgtgcaccatcaaactttcctttggacttata

SEQ ID NO: 496733 - DNA, 129 bp, Homo sapiens
taggccattggccccgggggggggttaagggccagccaccattcccacacttccccactaataacatttgggattacggttccttttaggccctataaataaaacaaggccagatatttaacattggca

SEQ ID NO: 496734 - DNA, 392 bp, Homo sapiens
tgtaaaactatggatggtctgataaggcttttactgacccccctgacttcagagttatactctgtttgctacctcataaagctggttttgccgcccttttgtttttttatatatttataaaaaaagaaaaagttggtgattgccttgggaaattccccgggtattactggacctatgtggtgtattgtttaaccagtggtccctgtgaaactgttgctcttgatgttcctgatacaggtaaggaaaccgttggtcccctctgatcccaagtatatataccgttccgtattgtctctgttccttttgtttttatttcattgccaaaatccaacccgccttcccccttgggtaaataaatgattttgctgaataaagtaaagtctttaattcca

SEQ ID NO: 496735 - DNA, 725 bp, Homo sapiens
  misc_feature (725)..(725): n is a, c, g, or t
cggacgcctgaagatatggccactcagcctatgtctcgggtggattgcctaggaaagcaagtgatatggccatggatagttctcatgtaattagtttggctcacgcactagtacacgagtgacccgttgtagcacgtgggttcccgtcggaagccctcctcaacgagtagcgtggtgtgagagacataatgtcagtagagttaggaaaagctttataaccgggtgtgtcatatgcgttgctatttgaaagcgtagtagtgttggttttagtcctttctgcacacatgcactagtttgtgaactcatcatattttccaacacaagtgaagagagagatacatagaaacaagagctagaacacaccacaaaagaacatagaagacaaacaagagcaataagacaatcacatagaaagaaacaacaagacaaaacgaataagaacgagggcgaggtcggcaaggctagcactggccccaggggcgtcgactctgagtgtgggagccgacacagttccgttccaaggggaccctgggcaccacgagcgaagcaggctggcagtgacgtaagcggagggagcaacccgtgggaggttacccggagtacaccctgtcacgaggacgaaccataacatattggacgcaaccccgtggaagccttggatgccctaccatagccagcgccttgactcgactggggcttgccgaaccgacggagcacgggataan

SEQ ID NO: 496736 - DNA, 462 bp, Homo sapiens
gaggatccctggcaggtggaaatcaggataacagcaattgttcagggaataagagataccttaaactctgactgccagtgagccaagcggaacagagccatatttctcttctttcaaaagcaaatgggagaaatatcgctgaattttctcagcaaggaacatccctgggaaacagaatacaagcctgggggaataggcctatagacagcccccctgggtgtggccgtctcctatggtctgtaggctgtaggggtgaaatagaccccagtctcccatagttctcccaggcttattaggaagaggaaattcccacctaataaattttggtcagaccggttgctctcaaaaccctgtctcctgataagatgttatcaatgacaatggtgcccaaaacttcattagcaatgttaatttcgcaccggtcctgcggtcctgatttccaccttgccagggtaccgagct

SEQ ID NO: 496737 - DNA, 1219 bp, Homo sapiens
ggtggcatactgacctttgctccggcctcgctcgtgaagacacagcgcactctccccgctgtaggcttcctcccacagaacccgctttcgggcctcagcagcgctctggctgagcactgctgttgccgctgctgctgctgctacccatgtgctgggccgctggcaggctcaagcaggccccggggcgctctccctcaccaactcatcacttctacgcactgagctccaagccttctcacctgccctggacggtctcgcgccaccatcccatttgatcaggtcaacgactgactacttgcgactgcaaaagatggctctgaccgagccagcgcacggctgcctgctcctaactggcagcttccactgcaccaacactggctactaagcccctgctatatcccctccaaccgggtcaacgatgcgctgttccgtgactgcctgcgcactgcgaacagcacgagctacacacacgcggcgctcactctgtgcagaacaccatgcaagcagaagggccgtaccggcagcagcagagtccctgcccccagactggcccgaccgctcacccgccgaacgcggctcccgctctgaccgcaagatcccttatcgacggactgccaaccaaggcaccggccacgcgcgcacgcacccaacccaccctcactccgacacttacaccgctggcgaccaccaccgctctccctgcgcacagcacccacgtgcgcacgactgccgccgcacccgccgcacacgcaagcaagcctggagcaagccccacaagcacaccgcccccacacccacccccccccaccccgccgccacacagcccccgcctgctgccaccggccccaccacaaaccaagaaaccccgcgacgccccactccgcacctacgaccccgcaccgcacccacggcacgcacaccggccctcaacacccgacacgcacaccaaccccgctcaacgcgccacccgactgcccgcatcgccaccacaccgactcacagcgggacaaggcaggcacgccacgacactcgaccaccacaaccataaccccccctctgccccccgcgcgctcgcgacagcctccggcccagcaccgccgaggccacgaccgaccattacacccacgaacacctagtgcgcacagcaaccaccgacgccgctccccacacaaaccacccacaccagcccatcatccccgcccccccccgtcacacaccc

SEQ ID NO: 496738 - DNA, 785 bp, Homo sapiens
  misc_feature (541)..(541): n is a, c, g, or t
  misc_feature (543)..(543): n is a, c, g, or t
  misc_feature (646)..(646): n is a, c, g, or t
  misc_feature (767)..(770): n is a, c, g, or t
  misc_feature (772)..(772): n is a, c, g, or t
gtgacatcctgtagtccttcctgcacatatgctagttgagttcatgctagtccagatggtcgttgactaggactcactgagactcatgtctcgagacacgttaagactgacagagtgtctagcccgagtgcatagaactcttcacactccactatactatgcagtgaatatccatcaaggaaccactcccttacaaggtatgcaatcaagtccccataggcacgcgctcaccttccctccgaggctagccactggtgaactactcccaacaatgcatgtgctccatcatctgggttccgagcaggcgtccagcgaaaagtctttcatgactattccgtcttgtcgttggacaattttgaattctattcagattactgcgacagtaacattactagactttttacaaaagaaacaaacattgtctgtacaggtttcatgctagagctaatgggagatgtggccacactgacttccattttaagctttctaccttcttttcctccgaccgtccccttccctcacatgccatccagtgagaagncntgctcctcagtcttgtaaatgtatcttgagaggtaggagcagagccactatctccattgaagctgaaatggtagacctgtaattgtgggaaaactataaactntcttgttacagccccgccaccccttgctgtgtgtatatatataatactttgtccttcatatgtgaaagatccagtgttggaattctttggtgtaaataaacgtttggttttatttatcaannnnanatttaagttcccg

SEQ ID NO: 496739 - DNA, 866 bp, Homo sapiens
  misc_feature (622)..(622): n is a, c, g, or t
  misc_feature (624)..(624): n is a, c, g, or t
  misc_feature (727)..(727): n is a, c, g, or t
  misc_feature (848)..(851): n is a, c, g, or t
  misc_feature (853)..(853): n is a, c, g, or t
gtgacatcctgtagtccttcctgcacatatgctagttgagttcatgctagtccagatggtcgttgactaggactcactgagactcatgtctcgagacacgttaagactgacagagtgtctagcccgagtgcatagaactcttcacactccactatactatgcagtgaatatccatcaaggaaccactcccttacaaggtatgcaatcaagtccccataggcacgcgctcaccttccctccgaggctagccactggtgaactactcccaacaatgcatgtgctccatcatctgggttccgagcaggcgtccagcgaaaagtctttcatgactattccgtcttgtcgttggacaattttgaattctattcagattactgcgacagtaacattactagactttttacaaaagaaacaaacattgtctgtacaggtttcatgctagagctaatgggagatgtggccacactgacttccattttaagctttctaccttcttttcctccgaccgtccccttccctcacatgccatccagtggactgcttgctggtcgcttacatcactttactccataagcgcttcagtggggttatcctagtggctcttgtggaagtgtgtagaagncntgctcctcagtcttgtaaatgtatcttgagaggtaggagcagagccactatctccattgaagctgaaatggtagacctgtaattgtgggaaaactataaactntcttgttacagccccgccaccccttgctgtgtgtatatatataatactttgtccttcatatgtgaaagatccagtgttggaattctttggtgtaaataaacgtttggttttatttatcaannnnanatttaagttcccg

SEQ ID NO: 496740 - DNA, 909 bp, Homo sapiens
gtgcgccctgagtcactgcctggcagttccggcgcgtgtccccatatagtcgccgatattgggagttctacaacatgcagacaggacaaaaagaaagtgtgaatggatcaagatggatgatgtgaagaagtagaagaagaggaactggtgaagaaacaaaactcaaagcacgtcagtaccgtgtcagatgatgcaaagatcctcagattctttgcacgcccttcaagaaagatgtgatggtcttgttagaaacaccaacgaggataccatgtgaagagcctgcctagggtagttaaaagaaggaggtgagtgcttctaaaaaacctgcgaagttaaaagtgtgcacagatagaagccaaattctatgaggcaagtcacggatcttgaggggaagtatgcgtgtctctaatcagcctctattgtgatacgcgatgtggaaattattagtgcattttatgaacctacggaagaagcatgtgagtggcaacccagatgaagaagatgcagatcggggaaggaatcgaacgaaaggcagattgaagttgacaccaggtgaagaaagagaagaccccaagggaattccgtgaatgtgataactgtttataagaattgtgacttggtcaagtgatttggttcaggacaggaatgaacctattgtggaggcagtgaaagatataaaggggaggttctcagatggtggcagcatagaggtttgccttagcaattccatttgaaccatgaatcttcaaatgagggtgcgagagacaacaggaggggagacaagtgagttgtccttttttcggggacaaaatatgtgtgaggggcaatatggaaagaaatcatgactataacaaacaacggggcgggaagagagccctactcgcgtcagtggggagagagagggactca

SEQ ID NO: 496741 - DNA, 720 bp, Homo sapiens
  misc_feature (466)..(466): n is a, c, g, or t
  misc_feature (633)..(633): n is a, c, g, or t
  misc_feature (659)..(659): n is a, c, g, or t
  misc_feature (670)..(670): n is a, c, g, or t
cgcctctcctgcttgtgtaacagagggggagacctcttccgcctatgaggagccaccggttccgcttgcgctttttggtggttgtttcttgttcggccgtcgtctttgtgttaggttgcgccctctctccgtttgagggtgtctctggcgagggggcccctgtttttgaggtttcgcgtattttcgggtcgcgcatttttgtcttcctcactggggcctcgtgtgattgtttacacgccagccctgggacatggtctgcacgtcctgttgtcgatcaggggcttcaaactgaagtgtagcagagttaattccgagtgtgttccacgcctcgttgtgttatggttgtggtagtggtatgcagggcccggccttcgggtgtaaggaattatgccaggctccgtggtgagtgtcccgctgcttattctcgcggggtacggacacgtctttggtcttagggaacgctgtncctcggccatcgcaagtgtcgtcgtgtgcgttcctagacgtcctttgccttgtctgtacagtgcggtcgcgtatgcacagcgtctagttgtcggtccccttgaattgtcatatagagacgatatagagtagattagagagaagagagcacagatcatagagagtgancgatagacacaacgccaagaatagantagaaacagangaaacacaaacacagagtaacaaagacaaaacagataagaagaaaagaat

SEQ ID NO: 496742 - DNA, 512 bp, Homo sapiens
  misc_feature (463)..(463): n is a, c, g, or t
  misc_feature (471)..(471): n is a, c, g, or t
cacatttcattgtgaaaaccttctaattcataccttcaattatttaaaagcctttaaaagacctatgtaacaaacctgtatgttctgcacatgtatcccagaacttaaagtaaaatttaagaaattaaaattaaattttaaaaaacacttcaaggttaaaaaatatatatgagctcctgttactgttaatgtatattgggtttaatattcttttatacagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacanaatcattnttgttgatgctgaccagattgtgagacatgatctaaaagaa

SEQ ID NO: 496743 - DNA, 555 bp, Homo sapiens
  misc_feature (10)..(10): n is a, c, g, or t
  misc_feature (34)..(34): n is a, c, g, or t
  misc_feature (46)..(46): n is a, c, g, or t
aaacctttcnttagtcccctcgggtattcatgancatttcaatggntttttagtcatattacccaatgattatttttttctcatcttaaaaggggtattttcaattaaaagcaaacccaggtgcttggatactgaggttacaccaaggaaaatctgaagatatttatcaaatagttgggtgagttatgcaggctgcttttaaatttttacacataaatacgtttttagtgtaatacaaccaagagaatcaaaacaacaattaaaatgttaagattggcctggcgcagtggctcaagcctataatcccaacactttggtaggccgaggcaggcagatcacaaggccaggagttcaagacctgcctggccaacatggcaaaaccccatctgtactaaaaatacaaaaatttgccagacatggtggcgcacacctgtaacttcagctattcaggagactgaggcccaagaattgcttgaatcttcgggaggcggaggttgcagtgagcagactgcaccactgcactccagcccaggacagagagcaagactctgtctc

SEQ ID NO: 496744 - DNA, 541 bp, Homo sapiens
  misc_feature (124)..(124): n is a, c, g, or t
  misc_feature (130)..(130): n is a, c, g, or t
  misc_feature (136)..(136): n is a, c, g, or t
  misc_feature (160)..(160): n is a, c, g, or t
  misc_feature (181)..(181): n is a, c, g, or t
  misc_feature (267)..(267): n is a, c, g, or t
  misc_feature (294)..(294): n is a, c, g, or t
  misc_feature (312)..(312): n is a, c, g, or t
  misc_feature (335)..(335): n is a, c, g, or t
  misc_feature (478)..(478): n is a, c, g, or t
  misc_feature (480)..(480): n is a, c, g, or t
  misc_feature (512)..(512): n is a, c, g, or t
  misc_feature (514)..(514): n is a, c, g, or t
  misc_feature (519)..(519): n is a, c, g, or t
  misc_feature (524)..(524): n is a, c, g, or t
ccagtgttagctcacccggcctcatcatagcgccccactgtgtgctaacatggcctcatcatagtgtcccaacgtgcgatcacctggcctcaccatagagtcccagtgtgcactcacctagccncatcanagtgcncagtgtcactcactagctcatcanagtgtcccattgtgtgctcanctagcctcatcacagtgccccagtcggcgctcacctagcctcatcatagtgccccattgttcgctcacctagcctcatcatagtgncccagtgggcactcacctggcctcatnatagtgtcccagtgtgcnctcaccgtgcctcatcatagtgncccagtgtgcgctcacctagcctcatcatagtgtcccagtgtgcgctcacccggcctcatcatagtgtcccagtgtgcactcacctagcctcatcatagtgccccagtgtccgctcacctagcctcatcatagtgccccagtntncactcacctagcctcatcatagtgtcccagtntncactnacctngcctcatcatagtgtcc

SEQ ID NO: 496745 - DNA, 890 bp, Homo sapiens
  misc_feature (841)..(841): n is a, c, g, or t
  misc_feature (849)..(849): n is a, c, g, or t
gcacaggaaatattacttccagaagggtggttgggtgaaacagtgcacagcaactgtgaccttgataatattcacttaaaggatactgagaaaactgttacagcagaatatgaactagaatacttactactggaaggacaatgctttgataaaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaagtttcacagtaagcttgcataaagaaaacaaaaaggaaaaagatgtcctaaacattttttcagttgcttctggtcatttatatgaacgttttatacagaattatgatgctttctgttttgcgtaacaccaaaacaccagtgaaattctggttgctaaaaaattatctctcaccgacatttaaagaagtaattcctcacatggctaaagagtatggattccgatatgaactagttcaatataggtggccccgttggcttcgtcaacagactgaaagacagaggattatttggggttacaaaattcttttccttgatgttcttttcccactagcagtggacanaatcattnttgttgatgctgaccagattgtgagacatgatctaaaagaa

SEQ ID NO: 496746 - DNA, 993 bp, Homo sapiens
ggtggaggcgcctgaacacactgcagcattacaaggtcccagtatggagcgaactgtggccctcgtcccctgcctcaccaagcatgtgctccgggaaaaccaggattatgtccctggagagcggaccccgaatgctggaggatgtagatgaggggggcatccggtccctggcacctggtgaagccaaagtgatgagccggagccgcccaggcctcggagtgggcagtgctttcgtgggccggggtagcgtgagcgcgtccgagaggtcctactccctgagcatctacctgacccgtcctgactgtccagtgaagggcatcctgcagagaggttcgtggatgacctgttccaggtgattctcagtaccagccgccccgtgccggtcgcgtgtgaagtacttctttgacctgtctggacttcgagcacggcccagaaacgtcatggccaatcgtcgcagaccaaggacaccagtccacattctaggaaagaccaagaagcttgccatctgagggttctggagactcaagtagtaagtaataaaaccccgcaggtggtgttccgatggtacaaaccattcttggataacattgaatgctgtgcgccttgtcattgcaacatgaccttccatggactgcctgcatccctggcctgaccacaagctggggcgggagtccccgatcaggcgaattttctgtttgcacgggatcattccccggtacaagcggatggtggaaaggtactgatgcatgacatcagacatgaactgtcccatgccagcgatcactgagatgaactctgttctggtgaaatgtgctggaactagctccggagaactcgggggggagtggcctgtatgaactctacaagtaatcaagtagttctttgaccacgattgtcctgcccggggaggatggccggcaaaaaatgggtgggcatcggtcacagatgggcggtgggaacagggccatcttgacccgagccgctgcgtgttcc

SEQ ID NO: 496747 - DNA, 415 bp, Homo sapiens
  misc_feature (68)..(68): n is a, c, g, or t
agtgaaaaatggtttaaatgcaaagggcctttttgagcaggtagagtcacgatccgggcagggggggnaagctcccctttgttgggggcagggtggggaaaaggggcagggacctcggaaaaggggtgaagtggcgcgctggttccccggggcactggcaattagaaggattatttaaactaagaaaggtcctgggtggtttaagtgaataaggaaactgaaaaggtgacgtgcacaactgcctattactcccaggagtggaggataatttcatatttcatggaaataaactcagggcccggagcggtggctcacacctgtaatcccagcactttgagaggccaaggagggaggatcgcttaagcccaggaattcgaaatcagcctaggcaacatagtaagacctcatctctgct

SEQ ID NO: 496748 - DNA, 707 bp, Homo sapiens
gcacaggaaatattacttccagaagggtggttgggtgaaacagtgcacagcaactgtgaccttgataatattcacttaaaggatactgagaaaactgttacagcagaatatgaactagaatacttactactggaaggacaatgctttgataaaagtgacagaacagcctcctcggggtctgcagttcacactaggcacaaaaaataaacctgctgtggttgatacaatagtgatggcacatcatgggtattttcaattaaaagcaaacccaggtgcttggatactgaggttacaccaaggaaaatctgaagatatttatcaaatagttgggcatgaaggaactgactctcaagcagacctagaagatatcattgttgtattaaacagcttcaaaagcaagatactcaaagtaaaagtgaaaaaagaaacagacaaaattaaggaagatatccttaccgatgaagatgaaaaaacaaaaggactgtgggattccattaaaaggtaattactaatgaatattttaatacatcactagattgatccagaagtctagtatgtggaagttccacaggtagtgaaaatttaagtaaggcaaaggtcctctaatctaggagggataagataaatacataaatgttactactgtgtacaagataggaaactagagctataagacagatgaaaataaaatactatcaaccagtgaa

SEQ ID NO: 496749 - DNA, 659 bp, Homo sapiens
tgatgctctcgcacgatgtctggatgctcatggtgtgctgtcgtgtgttgcttgtggctgctgtgccctgagtggcgacgtgcggctgtgtagctgctggtggtgtggctgctgctgcggtgtgtgatggatgatgtgagctgtgcctggcccgcctggcccaggagcttttttacctgtatggaattggggagcatactgcagtcatttaccacatgccagctttgtgactacaattaagtatcttttacaaaagtgactggctaccactcccccgcacaggactcaacagatgttgacttctcatccccgagttctttcatggccaaaaagcaaatggatatccacctgacaaatcttcggtgatccaagaagcagaaacaatatcagctggattctggaaggagaagcctcaacaacacaacttcacccaccagactcctggcttgcagctcttgaatgatgccacatgctgtggaacatatactttgcactggactttagcagcaatggcaaatacctggctaccttgttgcatgatgatctcaccatccagcatctggagcaccaaggacttcctagcatgctgatgatcacctgcatgcatgatagccaactgtggagctggacaacgccaccctggtgcgcttcatccctgg

SEQ ID NO: 496750 - DNA, 101 bp, Homo sapiens
ctatcgattggcgggcacttatttgaattccagtatagctcagtaaacatcaagtcactaccttcaaccccacgccgaagtttctttctttatttcttttt

SEQ ID NO: 496751 - DNA, 211 bp, Homo sapiens
tacaggatccctttacaggctgatgccaacacaccaggctaatttttgtatttggtagggacagagtttcgccatgttggccaggctgatctcgaactcctgacctcacgtgatccgcccgcctcggcctcccaaagagctgggattacaggtgtgggccaccgtgcccggccaagtgatttactttgtcattgcaaagctgtacttcttt

SEQ ID NO: 496752 - DNA, 108 bp, Homo sapiens
ctgtaagcacctccttgggcctgggagctccatggggagtaagacttgtagtctcccaccatctctgcaacacccactgcatggtacactagtagctggcagctttgt

SEQ ID NO: 496753 - DNA, 210 bp, Homo sapiens
agttcagggaccagcctggccaaagtgatgaaaaccccggctctactaaaagtataaaaaaattagttgggcatggtggcgcatgtctgtattcccagctactcaggagactgaggtaggatcgcttgaacctaggaggtggaggttgcagagagtcgagatgggaccactgcactccagcttgggtgacagggagaccccatttcagga

SEQ ID NO: 496754 - DNA, 233 bp, Homo sapiens
ttttgcccccccgggggggttttgggcccgcccccccccaaattaggtgccgcccccccaaaaggggtttggccggcccccaggaaacagggccccgccttccggggccccaattccggccagcccctcccccctttgggtcccgcccctttacccccggctttgctggccctggggaggaccaaattggtcccgcccgccccttattccattaaaccgttttggggggtgga

SEQ ID NO: 496755 - DNA, 316 bp, Homo sapiens
ccaggtgatttccaggaccttcagcaggaaagcaggctctaagagcagatcttctcattgatgggcccaggcaaacagcagtggctactcattgtctgtcttgctgctttttttcctcttgtggcccagtcatctagcttttcccttcttcagagatcttagtcactcttcttttccgtagtctcctttgttgataagaaacagaggtagtgctcaattcatgatagttcattgagtgaccaactgaatgaatgaaggaagaaatagccttccaaggtgtctcctgttcatactactcttactgtgtatctacact

SEQ ID NO: 496756 - DNA, 510 bp, Homo sapiens
  misc_feature (1)..(1): n is a, c, g, or t
  misc_feature (380)..(380): n is a, c, g, or t
ntaggcccaggagactcagcacagccacgtgcaggaagatttatggactgaaaaaggaaagtgacatacagaaaacgaaagtgaggtacagaaatagccgaatggttacagcttggcatctgccttattttaacacagtttgaacagttggccacctttgaccacaactcagtaactggctcaagagtaggctagagtctaactccctttaggttatagttcaccatgtacagagaaacctggaggctgaacttaaagtatgtaaggaggcagctttaggctaaacttgatttaacattgctaaaatttagaagacataaatttaaaaactgaagtagagggctaggcgcggtggctcacacctgtaatcccagcatttngggaggccaaggcgggcagatcacgaggtcaggagttcgagaccagcctggccattatggtgaaacccaatctctactaaaaatacaaaaattagctggatgtggtggtgcatgcctatagtcccagcta

SEQ ID NO: 496757 - DNA, 1502 bp, Homo sapiens
cggacgcgtgggtcgacccacgcgatcgccttcccaagcccccttccttcatcctatgggggtctcaggctgcccccatcatgggggatctgggacccggcccaacccatacctgaccacatcccccagaccaccgtggcatgcatattttgaagactgcactggacccacaggggcccatgaacactgacactctactcacatctccacctcaaccctccatgaccccatgagcacacatgaaaggagtcagagcaggcggagaacgaaacgaggccatcagtgcatgacatccacagagactagcatgaggacctgcggcatcgagaaaaagctcccattgaacagatggaacaacggaaataacaacggaaacccacagggagacagagaacaacaaaaccacccaaaatccaaaagccaagggggcataccccaccgacaagacaaccccatagagcatagacatcaccagaagacccaatgcgaacaccggaccagacgagaaaaccatagcaacaaaaacgcaatagaccgcacggtacacccggatcacaaaagacaccatgggcaccctacagtgacccccttggcaacaatccacgagggaacaacagcaaatggggaccagcccacgcagaccatgtggggaccccactacgggactgaccacggcgcgggggaccacgccacgaagcggggggagatcccccgaaacgccaacacccaaagggaccataagaccatacccgtgagataggacgtaagcaccagcacaacaagggagaagccacccagagagaaaagaggggaaacacacaactaggaagcgcaccccctagcactggaaggcaaagctagcgaagaacgaccacgaccagatggagcacacatagagacagcgcagccaagcagcataagagaccacccaacgggcccccacgagtacgcaagtgagccagtgagagcccaaccctgagaaagaggccaacaaatgaactagagagaaaagcacagagagaaagccaagcagacacgcagcacgacgacaagcatacaaagcggaggaccgagcaacagcggccacacaaaaacacaaagaaagacgcgcccgaagacacaccggtggatagcaccgccgccagcggcaaagccacagcgacgcaaggggagcgagcacccaatcgccgagccgtgcagaccacacacagtgggatcagcggtcagaaacccacggggggatcacacaataggtaggacgtagaagcaagtagatgcagcacacgagcaagcgagccgcagacacacacaacacaacgagggcccgagaggcggaaccaggaatatcagtcggaaagtcggaggttcgacgaagcacgccacacccgggggctgggccacctagcagcacgcaccccacgagagatgcggcacgccgagcactcacaagccaacagactggcccgagagcagcagaacagcgaagtacgagcagagcacaa

SEQ ID NO: 496758 - DNA, 320 bp, Homo sapiens
agcacgctggagtcaggagcattgcaggcggaactagaggagaatttaatccatgatatgcatgtgtgtggtggagggtgccggcgaggtgctaaaggtcaccatttccctgatacctcaagttcattcagaggcaggaatgagacagctgtcactgaccacacttcccctccccctatctgcagtcctcagcgtcgccaaatagtctgacatgcgcatgacagacccccacagtgcagaagctgctagaaacctcaagccttggagcccaaccccttttttgacagatgctatgagtggagacatgacttatcaagatc

SEQ ID NO: 496759 - DNA, 862 bp, Homo sapiens
  misc_feature (647)..(647): n is a, c, g, or t
gaatgcggctctccaaacaacgggggggattctcccccgggttaccccaggacgccaagctccctgggcgccgtggtgatcccccccccgggtttggtgcggccggccaccaactcgcaacgtgctccttccttgtgggaccccccgcttgtgcgcgggacccccccacgtggttcgacgagccgagtcccatgccaaaggtgtgcaccaccaactggcagtctccataaaacgggcccttaactttcccgtgtttccccaccagcgtttgacacatccccgtgttcttcctcccgcgccgtcgttcccgggtcccggatatcagggcccacaaagaggtaggcattatccatcttctgtgtgtgcggtgcgtcgcccccgtacgacaatacatagagacattcttcttgtccagcaccaccacacgtcaccagaacccctccagtatatgtggtgacgccgtacatagtcgtatgcaaggacagcatctcctccttttgccgacgcctcctaagtacagaaaatacgtgaggtcttctcggccagaattgcaaggactaagcaccccccgcaaggaaatcaataacaatttctcttccacccacgatctccctccttctcgagacacacattgtgtgcaaaccgcnaacgcagcggcgcacccacgtcgtcgtgacccccccctcacatcctcctcgtgaaaccaccatgagtggttcctccaggtgataatccccgctcggttgcgggtaccgtcttcaaagccccaggggtcgtgttatcacagacgaaccactttcatcgtcttcgagaccaagcccccccggtaaaaaggggaaacacccaaaaacccaacaaaaca

SEQ ID NO: 496760 - DNA, 138 bp, Homo sapiens
agcgacctacggtcgggtagctgggactgtaggttgtgcacatgctggtaattttttatttttagtaaagatgaggtctccctgcattgcccaggctggtctgaaactcctgaacgcaagcaatcctcctgcctcagc

SEQ ID NO: 496761 - DNA, 227 bp, Homo sapiens
cgccgatgggttgaccacaacctcgtacatcagtcctgcttcggtcaaactttaaaaagggaaaaaatacatgcaaagaaggcagccggccggttctcctgtgcgcagagggctggctgcttctccccctccttagcttttactgagccgcccttcctgccgggggtcctgcctccagtggaggtttggccatttaattgctcagagcttatgaaatgcctcccgcc

SEQ ID NO: 496762 - DNA, 125 bp, Homo sapiens
tactgaacctatctatactacgtatctatcgacgcatctatacgctctatactgacttatctatactacctatctatactaccccctaattgtcggcgcggaggggggtagtatagactggtcag

SEQ ID NO: 496763 - DNA, 1295 bp, Homo sapiens
  misc_feature (233)..(233): n is a, c, g, or t
cactaattcgccaaaatgacgaacacgaagggaagggagagagaggctagccgactatattgttctctaccgccttctatacgtagacaaatcactgcgtacgcttagtgtccttctcgcgtgcacatagtaatggcgaaaatcctcatagagggaagacggtgcactattcgtgaggacagtcgacacgcgggcatactgtggctatcggtggtttgcaacaacacgaatgncccctagcaacgtcgcttgaccactggacgaaaagctgggatagtagatcatacaatggtgtagcccaagcagtgctggtaaggacattgtgcttggtacatagcaaaaccacaggtttacacgtggctaatgatttctttgctcaacgtatgaatctaattgttgccgttattgatgcagcagtttgaagagcagctttcctatgcgaagccggacgcatacgcctttcgcgtgagagagccagtgtggatagggaaatagtcgagtcaagaagataaggaaaggaacgtcgaaaacgagtaaatagggataccatggggtgcgagaacgtataaacgtctgccgacgcctcatgcgtccagcccacgaaaggagaaggcacaagtgatctgctcgagacagccgaatctgggatacggagccctgtagtcctgcttgtgatagcccctattcctcgtacctgaacttcagtggctattaacttacgggtgtcaccaaagggaccattgcatgacacgggcataggtttcgtaggggcttcatatgaaaagtagagagagcgagcgcaggcgggggaggaacctggcaaaggggcggcttccggggggaccagagaacaagcacagcaacgaagggccagggggcccggatggaacacgcgaaaggcccttcccccgacacagtgcggacggacggcggcttggtaccattccccagtttggttgaaaggttaaaaccccttttggtttgtgtggaaaaagtgggtccccccctgtagaggccatccgggagcggagcacccccctcccccggggaggagaccgtagagccctgatgagcaggggcttatttgaacggcccgggcggcgatagatcacacacaagaggcgcagaaccaagacctgtagttctattcatagacaacccaaatctttagtgagagacgagtagaaccaaacagcaggggcgcggatcactataatcacgcgtgatgaccctcgttgggagtcagtccatagtcaaagatgtactagtagaacaactaagcgagtagcgagcgt

SEQ ID NO: 496764 - DNA, 200 bp, Homo sapiens
gggaaactgttttaggtggtggaaccagggaagcagagagcagagcatgcagttatggaagaagcaggaaaagcaagaagaaaagacagcagcatcaagaggaggaggacatttttggatgtaagggattagaaggatagccgggctagggaagcagaaagcagagcacacactggctcaagcagcacacggtaagagga

SEQ ID NO: 496765 - DNA, 545 bp, Homo sapiens
agctgcatcagtgtccccagacgagaatacaagccaagggctgtgaaaaggagttctagtgagctcaatggagtttccaccactctgtagtgaagacgacaggttctaacatttcccattagaacaggccttgttgtcggtggtctctatgaactttgaggccaggaaaaccaaggaggaattacggatttaaacgaaggggacatcacttacgattaaccacatcaaatacgatgaaaactggctatgaacggaatgatacacggagcaatcggggattcttccccaattaatttacggtggaacgtgattcgtgcactttaccttcagtaaaatgtgttaccacagaactcttggacataactttctgtaacttgaaattgaattcacaaccagtgtggctctcagatgcgagtgtttcttgtgacatcctttgggtctctgaccaacttaatgactttcgtatgtgtgctctctttataatgtattttataccactttaatttggtttaatgaatttcttgtccgtgctacatgaaaatatg

SEQ ID NO: 496766 - DNA, 163 bp, Homo sapiens
tgatgggtgacactgattgtagccggcgacagtactgtgtcaaccaccctggacatcctatctactgtgtcaaccacacagtgctctgtgcagatggctatatcctcaatgcgcacaggaagtgcgtggcacatcaacgcgtgtgtgatggacgcgctgccat

SEQ ID NO: 496767 - DNA, 356 bp, Homo sapiens
agaacctaattacgcataggtaaaggtatcgtatcagtccctcaagctgctgcaggtttagttgatctagcagatgcaggtgctcaattcgttactggacaagatgttcaaggtggacgctttactaaagcattagaagacgcaggcgtacgctttaaagatactaaagatattatgtctggttggtttagtgaaggcactcaacgtcagctgcaaggaattagctgcattacctggaatgagtactcaaaagtctctcggtgggaaccttagttcactgggtcaaactgcaggctacgtataagataatccttcattagcgtcgtaattagggtttgaaaccctaattagggtta

SEQ ID NO: 496768 - DNA, 614 bp, Homo sapiens
gaactatggagtggtggagccggatgactctatgatgtgtacttgtctatgcttgaatacctaaatggagaactgttcctgggtgaccctccagagaagctgacattggaggaagcacgggcgtactgcagagagcggggtgcatagattgccacacgggcaactgtatgcagctgggatggtggcctggacactgcaatccatgatggctactgatggcagtgtgctgctaccccatcgtgacacccagccagtgcatgtggtgggggcttgcctggtgtcaagactctcttcctcttccccaaccagactggcttccccaataagcacagccgattcaacgtctactgcttccgagactcggccagcctactgtccatccctgaggcctccaaaccatgctccaaccagcctctgatggactagaggctatcgtcacagctgacagatgacctggaggaactgcagctgcctcaggaatgccacagagagtgactcccgtgggggccatctagatccatccccatcagtggaggacggatggaggtggaagctccatccagaagaccaagagaggtgccctaaggacgcttctagaattgaaccagaatccg

SEQ ID NO: 496769 - DNA, 683 bp, Homo sapiens
ccagtacgtcactatttattcttttttatttgagttcttaaatagtagcgtttaaatgggcagctgcccacgaggagaagtcaaagtctggtctgcccccggagcaggaggcttgggcttggagggcccatcccagcaaaacctaaccatccacctccttccattgaactgaggccaggaaagtgcggattaccatgggttaccagcgatgatgttggccgggtccagctaggtacgtgagttagggtggggttgtaggggcctcgtagatatggttcgtaccacttgaccctggatggtctgctctcgcgaagctggttggccaccagcgagtggatctccttggcagagcgggttgagtggttaaaagggtggaaaaacaggttcccttcaagtttcaaggtataaccgggggtcgcctcaggtcttacgtatccggtaattccttctcacatagcggacaacccgtgggtgcctccaacgcgcagcccagaccccattttcggggaccccagccgtggccagccgtgagccgaggtgacaccagagggacggcacaggatcccttgcgccagaccacgtgaaaaactggctgtgcgcgaaaggagccccgaagatgtgtagggcggaagccgccacccggggccagaaaccccgtgaggggccggaaccacctggtccgg

SEQ ID NO: 496770 - DNA, 268 bp, Homo sapiens
  misc_feature (2)..(2): n is a, c, g, or t
  misc_feature (5)..(5): n is a, c, g, or t
cncanacaatgaaacaatgcaaatatttgtgaataaatatatatgtgatatatacatacactggaatgggtattttgcttcaataaggaatgacaaatgttgatacatattacaacaacggataaatcttgaagatatgaccttagtgaaataatccagaaacataagcataaatattggatgacttcaataatatgagggactttgactagttaaatttatagataaagacagtagaaggttggtcactaggtgtgctaaagttatt

SEQ ID NO: 496771 - DNA, 224 bp, Homo sapiens
tcgatacttcctacaggagcacggcagattataccacgtgaggcattcctcagtgcacagcgcaattttgtgcaaacgtcgtgctgggtactgctcggtctgctacctgctgcaagtcaaggagagacgtgactgtaatatcccttgggggatggacagagaattgatcaatgtctgacattcatgccactatcagggcgaaatcagcaacatagtctcgtatg

SEQ ID NO: 496772 - DNA, 326 bp, Homo sapiens
acaggagtctttgctttgggacggcgggctgagcaacttaaactatttgaaatgctagtgagcgaagctcgccagccactgttgcggcatggtccagttcgtgaggctctgctcaccctgctggatgcctgtggcagccctgtgcccagtaagcccagcaactggatagaaggcttggtgctacttcctcagccagctgtgtgtttgtggtggcccaaggagccttcataggctcgaagttcttcgcagcagaccacctccttgagccttaggagccgctcccccggtcttctttctctatttctacgccgtccccaatgcacaag

SEQ ID NO: 496773 - DNA, 872 bp, Homo sapiens
tggtgcctgttgtgttgcggcacattagttgtgccgtgcaatcattgtggccgcccttatgagttgccccctcgacaatatgggcaaccaggtacagttctcggggattgccttgtactttacgcgcctatccgagtttcttgtccgtgaccactactagccggcctgttggtggcccgcatgacccgtggccccgcccatattggtgaccgatagcgtgtcttttaaaggccgccgtgcggggttccccctcgctcctcggtctaggtatccgctcgcccggcggtctgtccgcccggtcactggctcgcctcgcggtaagtttttgtgaacctgtgcttgtgcgcgtccatcagcactgacaacctatgtcttccgggccgttcttggcgtgccccagacactgttttcgtactggtgccagcccccgtggaacttccccctcccccgccgcttctcggtgccccggtgtaattaggttcctgcttctcggccaacaacacaatctttctcgacgacgttgtctgtacccaatgtcatggggggggtctctgtcgcctgattcattatcagcctgccgttcgcggcccaataccatcccctgctcttcactatagtcgcctgcaccccgcgacgaatgatgttcgcgccccgtgacgccctccctccgtgattgtgatgccctggcctcgggacccctccctggtggtttacccggatggtggccggggcaccccgcaaggacgcgcgcttggcccctcctcgggcaaaagatccaccggctgggatgctgtctccgccccaagtctgtgaggtccttaaactgcaccgtattcccccttgaacccaaaaccccatggccccaaaaaaac

SEQ ID NO: 496774 - DNA, 106 bp, Homo sapiens
agcagtgtgtatcttcatcttcctgcagtatggactcattggcaatgtagtcttgatgaatggagatacaacttcccttttgaaactccagcgatactccgccggt

SEQ ID NO: 496775 - DNA, 277 bp, Homo sapiens
tcttgacggttgaatgtttgctgcctctgggataagtaagtaggagagggtataagaaggacgctgacaccaggctttcctgtagatacttattcacagagccaggatgcttgagtactggtggtggtgtggaagggattgtccattgatcctccttgacctttgccataagagaggccttatttatgggctactggctttctctcatttgttatgtgtttattttattcttttcatgcagtgatcagaatataatgtccaaacattcaagccgtca

SEQ ID NO: 496776 - DNA, 322 bp, Homo sapiens
gcaatctcggctcactgcaacctccgcctcccagcttcaagggattctgcctcagcctcctgtggagctgggattacaggcgtgtgcaccatgcctggataatttttgcatttttagtagagatggggtttcactaagttggccaggctggtctcaaactcctgacctgaagtgatctgcccacctcggtgtccaaagtcctgggattacaggcgtacaaccccgcccttgctttctctaatactgagctcacccgtgctatctagtaggtgccctccagccacccaccgtttcttggggaacatcatgtcgtgtgtggctt

SEQ ID NO: 496777 - DNA, 409 bp, Homo sapiens
  misc_feature (1)..(1): n is a, c, g, or t
  misc_feature (63)..(63): n is a, c, g, or t
  misc_feature (67)..(67): n is a, c, g, or t
  misc_feature (69)..(69): n is a, c, g, or t
  misc_feature (79)..(79): n is a, c, g, or t
  misc_feature (83)..(84): n is a, c, g, or t
  misc_feature (131)..(131): n is a, c, g, or t
  misc_feature (133)..(133): n is a, c, g, or t
  misc_feature (151)..(151): n is a, c, g, or t
  misc_feature (158)..(158): n is a, c, g, or t
  misc_feature (202)..(202): n is a, c, g, or t
  misc_feature (240)..(240): n is a, c, g, or t
  misc_feature (297)..(297): n is a, c, g, or t
  misc_feature (334)..(334): n is a, c, g, or t
  misc_feature (347)..(347): n is a, c, g, or t
  misc_feature (359)..(359): n is a, c, g, or t
  misc_feature (362)..(363): n is a, c, g, or t
  misc_feature (365)..(368): n is a, c, g, or t
  misc_feature (370)..(370): n is a, c, g, or t
  misc_feature (375)..(375): n is a, c, g, or t
  misc_feature (396)..(396): n is a, c, g, or t
  misc_feature (403)..(403): n is a, c, g, or t
  misc_feature (405)..(405): n is a, c, g, or t
nttgctgtagactggacaggcatgagttagattctctggggcttctgcagagactggtttggnaaantnggtgctaggnaaannatctgctccctgcaacctccccattttaatctttcagtattgaaaantngagaggaaccggattcantttgctngggacagaggcagtggggtgtggaggtgctcagagcagcctttnggaaggtgttggggaagctggattcccaatttttagcntccaggcctgggatggacctaggatgctgagaaagggcatacactgctgatttagtnacctgctagttaccagctcactgaggaaccagaagantgtacagttcttngtttgaaggcanttnntnnnngnggggngggagggatgggagctgaatnttttccngncccc

SEQ ID NO: 496778 - DNA, 135 bp, Homo sapiens
gagaaattttgagaagcatctaaaaaaatccacaattagtgcaaaaagaggggacaatactttaagttatttgagctatatgaagatcttaagtgtattgtaacgtagagaattgtcctacattgtctctcaacg

SEQ ID NO: 496779 - DNA, 173 bp, Homo sapiens
cttgggcaatcgtgactattctctacataaccacaaagacattggatcaccataccttattattctgcgcttgagactgtcagtcctaggcacagcatctatgcctccttattcgagccgatctgggccagccaggcgaccttctaggtaacgaccacatctacaacgttatc

SEQ ID NO: 496780 - DNA, 231 bp, Homo sapiens
cttagaggatccccctgcaaccagtaacctattcttcatagccgaatacacgaacattattataatatacatccctcaccactacaatctatcctaggaaccaacatatgacgcactctcccctgaactctacacaacatattttctcacctagaccctgcttctaacctccctgttcttatgaattcgatacagcatacccccgtattccgctgctaacgaataccgctg

SEQ ID NO: 496781 - DNA, 326 bp, Homo sapiens
cgttttgggggggggcttttaaggcccctgcccccggggttaggggccattaaattattttttcccggggcgggggaaagccgggaactagggattgctttgggaaaaaaccatgggggccttcccaaagattgttttttttggaggggggaaaaccccttttaattttgcgggccctcccccaaagagggggttgggggttttcccgggggggaaaaaagaggtttttccccacccgccagaggggggggaaagggtgaaaattcccaaacccgcccgggggggcctttttccttaaaaaaaattggaaggtttttaaattccca

SEQ ID NO: 496782 - DNA, 214 bp, Homo sapiens
ctctagaggatcttccccgactagccgacgggcagaaggagctgaagcttggccaggcgtgtagcgggcgcactacgggcacgctgggcggggcacgggctgtgtggagaagtgagcgcgctcgtttgacccccgtgcccgccaccccgagccactagcggcgatctcccaaggcctgcccgaggcctctgtcctctgtcgggctagtcggggg

SEQ ID NO: 496783 - DNA, 759 bp, Homo sapiens
  misc_feature (684)..(684): n is a, c, g, or t
agcgggttttaatttgtctcaggagaaataatgtctaacatagccacccagctttgaatatgaagtatatagaagcagctaaaataataagcttagataatttaattcattccagaacatttgctacataccagctattttgctctactctgcagatataaaaggcaaagaaggtatggcttctactctcaaattgcctaaagtctgtgttgaaaagcataattaactagcatcctagagtggaatttagtattaaggcaaagcctgtttatttaacaaatatttattcatcaagtgctttctgtgtgccaggcacatttctaaggctgtgggaatacagtgatgaactaaacagacaaaaccctcccctcttgtctaaaaggaaagatggacaatacatgagtaattaagcttagaaggcaagtggcttcgttttgctcactgctatatccccagcatctactgcagtgcctggcacatagtatgcactcaaatatttaggaatgtgaatcaaattaattagtacaatatttccatattttaaatggtcatggaggactgagaagggaatagttcattctggctacaagagctagaaaactccagcccaaccttgaacggtctataggaaattgaaaagtgatgtgagtaaacatagcaatgccagatagaagatagaaaatnctgcgcaaagtcatagaggtatgaaaagagcataagaattgggcaatacttggaaattcagtgtaggccaaagat

SEQ ID NO: 496784 - DNA, 826 bp, Homo sapiens
ggcagaaatggcggctgcggcggctcgagtggtgttgtcatccgcggcgcggcgtgcggctctggggtttcagcgagagtcttctaatccgaggcgctgcgggacggtcattatattgttggcagagaacagattaagaagtacacaggcatgcgtacccaagttgttctgaatgttcctgaaacaagagtaacatgttgtatgaacagtggactcagagtagcttcggaagactctgggctctcaacatgcacagttggactctggattgatgctgggaagctagatacgacacatgagaagaacaatggaagcagcacactttctggcagcatatggctttcaatgggcaccaaggaagagcatcccagtgtagatctggaagcgttgcagattgaaatatatgggtgctcatctcaatgcctatagcctccagtagagtcagtactgtatactatgccaaagcgattctctaagagacttgccacacgtagctgtgagaatattcgttgctgcagtatacatacaagaacgagcacacttgggcagaagcagagcattgacacgtgagcgtggacgtacatccttagagagtatagcagcgaaaggttggaaactcaaattgtacagatgcagagtatgtggctcgcgattgactctctccattgtccagccactgctttcacttcgaccaaattagctagacacgtttgcgcgaacggtgaccaaagttggagcggaagccaaacttggagtagcttattccaatattcttaggtacatctcctggacagtggacttccaggttggcctttcatgatacacc

SEQ ID NO: 496785 - DNA, 847 bp, Homo sapiens
  misc_feature (250)..(250): n is a, c, g, or t
ggtgacgaccccgggtttgagggacaacgaggcaagcctgggggtcccaaggacataagggagaagccaggagatcctggaacgagccgtaggagctcggatctgctagcgagtaccagggcagactgcagagggggagaacagaagcgagccgggagcggagaccgggcatccgagggcgacgcacagatgggtcaactgaggagtcataatcaaggagcgaagtcgctagggcatacgatcggaggangcgaacaggtagctgacacggggcgcatgatgcgggtacccaaggccctagccagggctgcacagggcctcgacccgggctttgacgggcatttcaacggaaccctccttgagccccaaggggcagaccccaggttggcctttggcactgcaacaggacgaaacaggcgcgacgcctgcgatgctggacgcgggcaggcgcggcgagacctagggaagctcggcgacgcactctggagcacgaggcgccagctcggcgagacgcctgtggccccaccggtagagacacaggagacggcgcggcgacgactgggacacccatggacctgcacggatgcccccgtgggagcgggcgtgcgccctgcgacgagagacggacccacggggagacccccaaggcactgctggtggaccaagcaggacgaccctgggtgaaggctgtgccggcacgggtgatcacgcgcaagagacaggccacgtaggctgtccctgggagatccgggcgatggctgggccttatcggacctaagggctaccgaggcgatgagggtaccccaggtccgagggggcagaaggagcccaggacctgcggacccct

SEQ ID NO: 496786 - DNA, 105 bp, Homo sapiens
gggacctagagagcgtggactttagtaaaagaattatgagtggttcaacatgcaggccctgagtccgccatgggatacgcgggagctaggtactaaatggcagtc

SEQ ID NO: 496787 - DNA, 807 bp, Homo sapiens
gccatatggtctcaaaggaatgaggtgtaggtggtggaaaagcattgtaggaggtcagatttgaatatagacaaggtgggttatcacgtgagaatgtattggaagaatgcctgtgaagccaggtgtgggttctactcagtgccatagatagatgagtcttctctcgtaggtcaccattacatagtaatttggattctgaatttcacattaaattatttgagtttatacagacctaaattttaaaatctgtacatatattattggatgtataagatgaatatggctgatttaaattttatttatgcacatacttaaaggacagaaatgtctgggaaagtaatctgtcaaaataatgatatgtacctttttaactttttaaataaataacaagattttaatgtgtgtctccctcagggttgtccaaagttttttttctccctcaagtataactagtggtacctatatgtcgtatcttctagcaccaactgtgtagagcaatggtgcaaataatgcttgaatacaagtggtaagccaaaacagaataatactttatagtagttaattaatcctgaaattcggaaagcttccccaatttgccctgtgcatcctaaaccaaactgttgcaggtcttctaccctatttattgtgggcccatgtgttatgaacggccctgcaccgtttcaaaggcgggcaccacacatatcacacgcccagtggcgcgtacagaaaccggtttgaatacttacccgcgggggccaaatacgcgtctgaaaatatcacgcgggcggcggcaactccaaacagcgg

SEQ ID NO: 496788 - DNA, 844 bp, Homo sapiens
agccccccactggtgcctatcggggcaaaaactggggccccgctgatagtgtcaccaacgggtgcccctggtgggggctttgtcccatccgcgcgcctttttcaatccgagagagtttcaatcaccccgtgaagaccctttttgtcgccactggcagaatacacaaatttgttgcagacacccgagataattggttgtttctccccgcaagcgtctttgccacctcgttctctctggtagacagatggtgcttctcgccctcactgtgcggggtatcacatgtcccctgtgatacacccctcgtgggggggccacgcgtttggcaccccgggctctcgagactttgtctgcttgtacctcacgacgttttctgtagggggtgcttgaatcttcatgatgactcggtcgctaatctaacatctaatcctttgtccaatacgggagacaccggggaaccccctgtgggatcacatgggggcgggaatttttcggacggatgccctgagggtgtcctcacagtgcagatcgccgctcaaccactccacggggggagagcgcacccaccctcgaacctcacgaagcgctcccacacccacgagagattcctgcttccgtggattgaaggcgcgggaagctggagggccacaccactccactcggcgagagtgggtaaaagggcattcccacggcgtgaggtcagcaagccacactcctgcgtggggggccccactcacactttgagacccaggactggtaggggtttcaaagctcctcatggattggggcttcactcagccactggcggcagagggaaggggctgaattaacacctggaagcctggca

SEQ ID NO: 496789 - DNA, 142 bp, Homo sapiens
caaccagagccaccaaaaaacgcacggagataacgtaagaggacgtcatcgtttagataatggcgcaaatccggccgtactacatttgtaggtcctgatgtatcgccgcgcttcacgtggcgggacgtgtgggatctgggga

SEQ ID NO: 496790 - DNA, 508 bp, Homo sapiens
tttcccggacagtttccgcctaaattccgggaaagtttgtaccccgaaattgttcctagggggtcccaccccaatggagggcctgggggacctgaaagcgttaaggggtgtttgggccatttcacctttggcctggaaagtacagacctttttttttttttaaaccaaaaaagccttgtaacttatggacctttacatcccggtaggtttcccgttacgggacagtttcccggacccctgggtcccaggtgggcaggtgatgcccccggggcctttgtagccccttccccttttttcctttccccgccctgggatagcatatgtttttgtaagtttttgcctaccgtaatttttaggaatttccgaagaaattctgcaagcttttccaaattgggctttaaatcttattccaactaataggattaatgggatatgttaatagaaacgtgtttattttttttggaacatttccgtttggggttttttaataaaggatttttaaactcca

SEQ ID NO: 496791 - DNA, 534 bp, Homo sapiens
gcaagccctgcgtaaggcctcaggttgtgaccttcggctgttttgccctgattcaagaaggctgactcgccttacgtatggctgttccaagggtggcatgttcattcctaaagactcactgtgctgaaggagatatttccttttgcttaactttgtaagtgtgaaaaactttgaaggacttttcagggaatagaaatcaatcatcattaatccttctcatatgacaaactgtttcattttttataacagcttctgttcattgtcaaaatacgttcatattttacacagtgtacatataatatttgtatgctgctttttattcagcataatgttacatacattttattattttgtattattatgtattattactacaaagtctttatagctatcattgtatgtaacgacacaattagatcttccaaaatacttcttttttttgagactgtctgcctctgttgcctaggctggagtgcagtggcacaatctcagctcactgcactactccagcctgggctatcagatggagactct

SEQ ID NO: 496792 - DNA, 136 bp, Homo sapiens
cctctgagatgcaaagtgtccaatgaataactgtctatgggactcattgcgaaaggaatggagcggcactgggatgcttgtagagcatcatgccctgtaaatcactaagcaactctatgggcatgcactactcgca

SEQ ID NO: 496793 - DNA, 719 bp, Homo sapiens
aatcatggtaaagctctaaatagtaacacgaaacactgaagattgagaatagtgaaaaaaaaaaaggcaaagaaataaatatcaccaaagaaaaaagatataattgtagctaaaatataaaactaaatcaccagttaattaaactatacagatctaatacaaaccaaaaccagcctgaaagacccaaccttaaaaaatgctaaaaaataaggcataaatctgcataatatagagtttaatttccattctctcttttccctctactatgtatgcttaacctgatctgcctctagggacttacaagaaaacggcttccggtatcccgtttcaatttgacctcaaatgtcctgagcaaagtttttgatatcctgctgagggatcaaagagtaggtaagctttagacatcattatttctactaattcagtagttatgatcgtagcgccaaattaaaattcttccactggttcttctggaaggaattaaaactttaacagtgccttggctgcacagtataatgtttttaaaaaagaaacccaagcaaatctattgctaaacgaggttcttattatttaacaaaaagaattattttgacaatttaaaccttgggagaacagtcatagaatcatttcttacgtgagaataaactaaaactgtctgagcctggttattctctcccaggtaaaaagccttagaagcttgtgtgcggaaatttggtttc

SEQ ID NO: 496794 - DNA, 860 bp, Homo sapiens
  misc_feature (5)..(5): n is a, c, g, or t
  misc_feature (100)..(100): n is a, c, g, or t
  misc_feature (187)..(187): n is a, c, g, or t
  misc_feature (196)..(196): n is a, c, g, or t
  misc_feature (209)..(209): n is a, c, g, or t
  misc_feature (216)..(216): n is a, c, g, or t
  misc_feature (257)..(257): n is a, c, g, or t
  misc_feature (263)..(263): n is a, c, g, or t
  misc_feature (269)..(269): n is a, c, g, or t
  misc_feature (280)..(280): n is a, c, g, or t
  misc_feature (307)..(307): n is a, c, g, or t
  misc_feature (322)..(322): n is a, c, g, or t
  misc_feature (330)..(330): n is a, c, g, or t
  misc_feature (375)..(375): n is a, c, g, or t
  misc_feature (398)..(398): n is a, c, g, or t
  misc_feature (419)..(419): n is a, c, g, or t
  misc_feature (431)..(431): n is a, c, g, or t
  misc_feature (453)..(453): n is a, c, g, or t
  misc_feature (633)..(633): n is a, c, g, or t
  misc_feature (679)..(679): n is a, c, g, or t
  misc_feature (733)..(733): n is a, c, g, or t
  misc_feature (853)..(853): n is a, c, g, or t
gtttncgggacttccacttctgttgcgttaggtcgagaggagccggagacgagtatccagaggccgaactcggtgtttctgacaatatgtgtctctgtcnctgccccgcagattcattctataggaaacccagcgttttgtccggcagaaccagtccccggcatcaaagccgaaccagatgagagcnacgcccgtnattttcatgtggncattgcnggccctcaggattccccctttgagggagggactttaaaacntgaacnattccntccagaagaanacccaatggcagcccctaaagtacgtntcatgaccaaaattnatcatccnaatgtagacaagttgggaagaatatgtctagatattttgaaaganaagtggtccccagcactgcaganccgcacagtcccgccatcganccaggccttgtnaagtgcccccaatccagatganccattagcaaatgatgtagcggacagtggaagaccaacgaagcccaagccatagaaacagccagagcatggaccaggccatatgccatgaataaaattcaaattgatacgaacatcaagtgtgcatcactccccccgtcccgccaagacttcctcctctttgtttgcatttaatggacanagttttagaaacattacagaataaaaaagcccagacatcttcagtnctttggtgattaaatgcacattagcaaatctatgttttgtcctgattcactgtnataaagcatgagcagaggctagaagtatcatctggattgttgtgaaagtttaaaagcagtggcccctccctgcttttattcatttccccatcctggtttaagtataaagcactgtgaatnaaggtag

SEQ ID NO: 496795 - DNA, 114 bp, Homo sapiens
taccgttatgtctgtaggccagcgcgttagaaggagcaggaagcgcagcagggagaagtaggactccgtgccggcgccaaactggcccccgatcctcttcagtgtccacgccca

SEQ ID NO: 496796 - DNA, 580 bp, Homo sapiens
cgtctagtgtacgaggcctgtgtggttagagctgagtgtagggccgctgagctggagtcttgctgagcgggcgccgagctcccgccatggccctggaacacgctgtcctcgcgcttcctgccggtgtggacatctgacgaatttgacgatgaacaaatttgtggacgagcagtgatggaggctggctgtgcgtgctggctgtgcggagccaggcctggacccgagctgaggtggacgggctcctgctggcaaggtggacatgcttcgtggcattccatgcagccttgctgtgaactctccctgtcaacaccaagaatcaagctgtgaatggagctgagcccagtggcgtggtgctgaaagtgctcacaaacttcaagagcagtgagattgagcaggctgtgcagtcactggacatgaaacggcgttgacttgttaatgaagtacatttataaaggctttgagaagcccacatgaacatacgcatgcgcagtgttactccagtggcacgaaaatggccttagcagtatggaggactagtgctccattataatgagttcttacagcaatgaaagactgttta

SEQ ID NO: 496797 - DNA, 5542 bp, Homo sapiens
ggactttagaagccgttgctgccctctctgtcacctgaagcggggccctctcccatcccacccttgccccgcctccctgcccccaccgggccggccctgcccgccgccggaccctggcatgtcaagacctggtccgcgcctgcctgcccagcccgcggaaccccggcggccccgcgagctaggatgaggggccaggccgccgccccgggccccgtctggatcctcgccccgctgctactgctgctgctgctgctgggacgccgcgcgcgggcggccgccggagcagacgcggggcccgggcccgagccgtgcgccacgctggtgcagggaaagttcttcggctacttctccgcggccgccgtgttcccggccaacgcctcgcgctgctcctggacgctacgcaacccggacccgcggcgctacactctctacatgaaggtggccaaggcgcccgtgccctgcagcggccccggccgcgtgcgcacctaccagttcgactccttcctcgagtccacgcgcacctacctgggcgtggagagcttcgacgaggtgctgcggctctgcgacccctccgcacccctggccttcctgcaggccagcaagcagttcctgcagatgcggcgccagcagccgccccagcacgacgggctccggccccgggccgggccgccgggccccaccgacgacttctccgtggagtacctggtggtggggaaccgcaaccccagccgtgccgcctgccagatgctgtgccgctggctggacgcgtgtctggccggtagtcgcagctcgcacccctgcgggatcatgcagaccccctgcgcctgcctgggcggcgaggcgggcggccctgccgcgggacccctggccccccgcggggatgtctgcttgagagatgcggtggctggtggccctgaaaactgcctcaccagcctgacccaggaccggggcgggcacggcgccacaggcggctggaagctgtggtccctgtggggcgaatgcacgcgggactgcgggggaggcctccagacgcggacgcgcacctgcctgcccgcgccgggcgtggagggcggcggctgcgagggggtgctggaggagggtcgccagtgcaaccgcgaggcctgcggccccgctgggcgcaccagctcccggagccagtccctgcggtccacagatgcccggcggcgcgaggagctgggggacgagctgcagcagtttgggttcccagccccccagaccggtgacccagcagccgaggagtggtccccgtggagcgtgtgctccagcacctgcggcgagggctggcagacccgcacgcgcttctgcgtgtcctcctcctacagcacgcagtgcagcggacccctgcgcgagcagcggctgtgcaacaactctgccgtgtgcccagtgcatggtgcctgggatgagtggtcgccctggagcctctgctccagcacctgtggccgtggctttcgggatcgcacgcgcacctgcaggcccccccagtttgggggcaacccctgtgagggccctgagaagcaaaccaagttctgcaacattgccctgtgccctggccgggcagtggatggaaactggaatgagtggtcgagctggagcgcctgctccgccagctgctcccagggccgacagcagcgcacgcgtgaatgcaacgggccttcctacgggggtgcggagtgccagggccactgggtggagacccgagactgcttcctgcagcagtgcccagtggatggcaagtggcaggcctgggcgtcatggggcagttgcagcgtcacgtgtggggctggcagccagcgacgggagcgtgtctgctctgggcccttcttcgggggagcagcctgccagggcccccaggatgagtaccggcagtgcggcacccagcggtgtcccgagccccatgagatctgtgatgaggacaactttggtgctgtgatctggaaggagaccccagcgggagaggtggctgctgtccggtgtccccgcaacgccacaggactcatcctgcgacggtgtgagctggacgaggaaggcatcgcctactgggagccccccacctacatccgctgtgtttccattgactacagaaacatccagatgatgacccgggagcacctggccaaggctcagcgagggctgcctggggagggggtctcggaggtcatccagacactggtggagatctctcaggacgggaccagctacagtggggacctgctgtccaccatcgatgtcctgaggaacatgacagagattttccggagagcgtactacagccccacccctggggacgtacagaactttgtccagatccttagcaacctgttggcagaggagaatcgggacaagtgggaggaggcccagctggcgggccccaacgccaaggagctgttccggctggtggaggactttgtggacgtcatcggcttccgcatgaaggacctgagggatgcataccaggtgacagacaacctggttctcagcatccataagctcccagccagcggagccactgacatcagcttccccatgaagggctggcgggccacgggtgactgggccaaggtgccagaggacagggtcactgtgtccaagagtgtcttctccacggggctgacagaggccgatgaagcatccgtgtttgtggtgggcaccgtgctctacaggaacctgggcagcttcctggccctgcagaggaacacgaccgtcctgaattctaaggtgatctccgtgactgtgaaacccccgcctcgctccctgcgcacacccttggagatcgagtttgcccacatgtataatggcaccaccaaccagacctgtatcctgtgggatgagacggatgtaccctcctcctccgcccccccgcagctcgggccctggtcgtggcgcggctgccgcacggtgcccctcgacgccctccggacgcgctgcctctgtgaccggctctccaccttcgccatcttagcccagctcagcgccgacgcgaacatggagaaggcgactctgccgtcggtgacgctcatcgtgggctgtggcgtgtcctctctcaccctgctcatgctggtcatcatctacgtgtccgtgtggaggtacattcgctcagagcgttctgtcatcctcatcaacttctgcctgtccatcatctcctccaatgccctcatcctcatcgggcagacccagacccgcaacaaggtgatgtgcacgctggtggccgccttcctgcacttcttcttcctgtcctccttctgctgggtgctcaccgaggcctggcagtcctacatggccgtgacgggccacctccggaaccgcctcatccgcaagcgcttcctctgcctgggctgggggctccctgcactggttgtggccatttctgtgggattcaccaaggccaaagggtacagcaccatgaactactgctggctctccctggaggggggactgctctatgccttcgtgggacctgccgctgccgttgtgctggtgaacatggtcattgggatcctggtgttcaacaagctcgtgtccaaagacggcatcacggacaagaagctgaaggagcgggcaggggcctccctgtggagctcctgcgtggtgctgccgctgctggcgctgacctggatgtcggctgtgctcgccgtcaccgaccgccgctccgccctcttccagatcctcttcgctgtcttcgactcgctggagggcttcgtcatcgtcatggtgcactgtatcctccgtagagaggtccaggacgctgtgaaatgccgtgtggttgaccggcaggaggagggcaacggggactcagggggctccttccagaacggccacgcccagctcatgaccgacttcgagaaggacgtggatctggcctgtagatcagtgctgaacaaggacatcgcggcctgccgcactgccaccatcacgggcacactgaagcggccgtctctgcccgaggaggagaagctgaagctggcccatgccaaggggccgcccaccaatttcaacagcctgccggccaacgtgtccaagctgcacctgcacggctcaccccgctatcccggcgggcccctgcccgacttccccaaccactcactgaccctcaagagggacaaggcgcccaagtcctccttcgtcggtgacggggacatcttcaagaagctggactcggagctgagccgggcccaggagaaggctctggacacgagctacgtgatcctgcccacggccacggccacgctgcggcccaagcccaaggaggagcccaagtacagcatccacattgaccagatgccgcagacccgcctcatccacctcagcacggcccccgaggccagcctccccgcccgcagcccgccctcccgccagccccccagcggcgggccccccgaggcaccccctgcccagcccccaccgcctccgcccccaccgccaccacctccccagcagcccctgcccccaccgcccaatctggagccggcaccccccagcctgggggatcccggggagcctgccgcccatccgggacccagcacggggcccagcaccaagaacgagaatgtcgccaccttgtctgtgagctccctggagcggcggaagtcgcggtatgcagaactggactttgagaagatcatgcacacccggaagcggcaccaagacatgttccaggacctgaaccggaagctgcagcacgcagcggagaaggacaaggaggtgctggggccggacagcaagccggaaaagcagcagacgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctgagcgggtgggcggcggccacgcactgggccacggaggagggatgctgctccgcccgctcctgccgcagacgggcacagacacgctcgcgggcagcgggccaggcccgcaccccggcctcagggcgctcagacggcggccaggcacagggcccgcagtgctgggaccagagccagatgcaggacaggaggcggcccggccagcgggcacagggcaccagaggccgaaggtgcctcagactccgccctcctcgggccgaggcccagcgggcagatgggcggacggctgtggaccgtggacaggcccagcgcggccagcgtcccagggtacccgcctgagctcctgctgcggaggagctgcctgcttggcccggccggcctggcaccgttttttaaacacccccatccctcgggaagcagccagctccccacaccttccagggccctaggcccctcctagacccaggtggagggcacagccctccgaccctcatggcccccaggggcaggactgagtcccctccaggaagaagcaggggggaatctattttttctctccttttcttttcttcaataaaaagaattaaaaacccaaaaaaaaacacaac

SEQ ID NO: 496798 - DNA, 186 bp, Homo sapiens
ttcgcttgatgctcaccatatggtggccctggcattcagctattacacgtctcctaagatgtctcgggtagtgtattagttcctttctcatactgctatgtaagacatactggcaactgggtcatttctaactgaaccagaggtttattgtactcacagttccaccaggctggagaggcctccgaa

SEQ ID NO: 496799 - DNA, 423 bp, Homo sapiens
cgtgtcgcaaatgatccagatagagaggtaacatgcatataaaatcatctgcccttatgggagagacattcatatgattcggccatgaatatcttccattgggcagctggtcctttggtatcacacttcaccaaataaaccaaaaatttatcccgaatagcttgctacctatagccatcaactgagtgcctttttttttttcttgggtttggagatgggagtctggctctgtcacccaggcgggagtgcaggggtgcaatctcagctcacgtgcaacctcggccatggcactccagccggggcaacagagtgaacctcggtctcaaaaagaaaaaaaacacaaaacaaaacccacgtgaggggagcggggagaggccccaccggccgggaaactccagacaagccacagattcaaccagggga

SEQ ID NO: 496800 - DNA, 520 bp, Homo sapiens
  misc_feature (39)..(39): n is a, c, g, or t
  misc_feature (211)..(211): n is a, c, g, or t
aggcttccactgcaatgcaagtcacctgcctgcctcacnccggttgtgcagacacacttgcacccatgggctcaacactcaagcccatgatgtctgctcatgctctgtaaaccctgagccctaagagcacctggtgtccctgcaccccagcaactagatccgtaaccaaaccccaacctcccaggcccaaacaccctgggtcatccagtcntgaacgctggcctggcagcatggctcaggtgctcctgctcccccacacccctgcaccagcctggcttgtagtgctgagggcctggggaatggggatgctagggaggaaaatggggaagcagccagctccccacaccttccagggccctaggcccctcctagacccaggtggagggcacagccctccgaccctcatggcccccaggggcaggactgagtcccctccaggaagaagcaggggggaatctattttttctctccttttcttttcttcaataaaaagaattaaaaacccaaaaaaaaacacaac

SEQ ID NO: 496801 - DNA, 167 bp, Homo sapiens
cttttggggtctttgctctatctcagccgcagaccgcttatctcctacacaccaacgaagagcctcatgccagccagccccggagcgcttgagagcagccccagggacccaggcctctgtgcctggacacccctctggcctgaacccggaggcgccagcgctcatgc

SEQ ID NO: 496802 - DNA, 2424 bp, Homo sapiens
ggactttagaagccgttgctgccctctctgtcacctgaagcggggccctctcccatcccacccttgccccgcctccctgcccccaccgggccggccctgcccgccgccggaccctggcatgtcaagacctggtccgcgcctgcctgcccagcccgcggaaccccggcggccccgcgagctaggatgaggggccaggccgccgccccgggccccgtctggatcctcgccccgctgctactgctgctgctgctgctgggacgccgcgcgcgggcggccgccggagcagacgcggggcccgggcccgagccgtgcgccacgctggtgcagggaaagttcttcggctacttctccgcggccgccgtgttcccggccaacgcctcgcgctgctcctggacgctacgcaacccggacccgcggcgctacactctctacatgaaggtggccaaggcgcccgtgccctgcagcggccccggccgcgtgcgcacctaccagttcgactccttcctcgagtccacgcgcacctacctgggcgtggagagcttcgacgaggtgctgcggctctgcgacccctccgcacccctggccttcctgcaggccagcaagcagttcctgcagatgcggcgccagcagccgccccagcacgacgggctccggccccgggccgggccgccgggccccaccgacgacttctccgtggagtacctggtggtggggaaccgcaaccccagccgtgccgcctgccagatgctgtgccgctggctggacgcgtgtctggccggtagtcgcagctcgcacccctgcgggatcatgcagaccccctgcgcctgcctgggcggcgaggcgggcggccctgccgcgggacccctggccccccgcggggatgtctgcttgagagatgcggtggctggtggccctgaaaactgcctcaccagcctgacccaggaccggggcgggcacggcgccacaggcggctggaagctgtggtccctgtggggcgaatgcacgcgggactgcgggggaggcctccagacgcggacgcgcacctgcctgcccgcgccgggcgtggagggcggcggctgcgagggggtgctggaggagggtcgccagtgcaaccgcgaggcctgcggccccgctgggcgcaccagctcccggagccagtccctgcggtccacagatgcccggcggcgcgaggagctgggggacgagctgcagcagtttgggttcccagccccccagaccggtgacccagcagccgaggagtggtccccgtggagcgtgtgctccagcacctgcggcgagggctggcagacccgcacgcgcttctgcgtgtcctcctcctacagcacgcagtgcagcggacccctgcgcgagcagcggctgtgcaacaactctgccgtgtgcccagtgcatggtgcctgggatgagtggtcgccctggagcctctgctccagcacctgtggccgtggctttcgggatcgcacgcgcacctgcaggcccccccagtttgggggcaacccctgtgagggccctgagaagcaaaccaagttctgcaacattgccctgtgccctggccgggcagtggatggaaactggaatgagtggtcgagctggagcgcctgctccgccagctgctcccagggccgacagcagcgcacgcgtgaatgcaacgggccttcctacgggggtgcggagtgccagggccactgggtggagacccgagactgcttcctgcagcagtgcccagtggatggcaagtggcaggcctgggcgtcatggggcagttgcagcgtcacgtgtggggctggcagccagcgacgggagcgtgtctgctctgggcccttcttcgggggagcagcctgccagggcccccaggatgagtaccggcagtgcggcacccagcggtgtcccgagccccatgagatctgtgatgaggacaactttggtgctgtgatctggaaggagaccccagcgggagaggtggctgctgtccggtgtccccgcaacgccacaggactcatcctgcgacggtgtgagctggacgaggaaggcatcgcctactgggagccccccacctacatccgctgtgtttccattgactacagaaacatccagatgatgacccgggagcacctggccaaggctcagcgagggctgcctggggagggggtctcggaggtcatccagacactggtggagatctctcaggacgggaccagctacagtggggacctgctgtccaccatcgatgtcctgaggaacatgacagagattttccggagagcgtactacagccccacccctggggacgtacaggtgggctcccgaggggcatcttggaagagggtgtcgggaaggtgtctggggagccctcctcgaccttagagatggatcaccaaccctagccacagcacacgcaactgaggg

SEQ ID NO: 496803 - DNA, 838 bp, Homo sapiens
ggacgcgtgggtcgacccacgcgtcgcggacgcgtgggtccggacgcgtgggcgcccaacaagaggccctgggagagcctccggaaagcccacgggacgcccacgtgggtgaagaaggagctggagccgctgcagccgtcgccgctggagcttcgcagcgtggagtgggagaggtcgggcgccacgatcccgctggtgggccaggacatcatcgacctccagaccgaggtctgagcgggtgggcggcggccacgcactgggccacggaggagggatgctgctccgcccgctcctgccgcagacgggcacagacacgctcgcgggcagcgggccaggcccgcaccccggcctcagggcgctcagacggcggccaggcacagggcccgcagtgctgggaccagagccagatgcaggacaggaggcggcccggccagcgggcacagggcaccagaggccgaaggtgcctcagactccgccctcctcgggccgaggcccagcgggcagatgggcggacggctgtggaccgtggacaggcccagcgcggccagcgtcccagggtacccgcctgagctcctgctgcggaggagctgcctgcttggcccggccggcctggcaccgttttttaaacacccccatccctcgggaagcagccagctccccacaccttccagggccctaggcccctcctagacccaggtggagggcacagccctccgaccctcatggcccccaggggcaggactgagtcccctccaggaagaagcaggggggaatctattttttctctccttttcttttcttcaataaaaagaattaaaaacccaaaaaaaaacacaac

SEQ ID NO: 496804 - DNA, 187 bp, Homo sapiens
acttctaggcctgctatcgttggacctggctgcgcgccacatgctacgtgtctcgggtagcgcataaccatgtcacacggatgttcactagtatcttaatgtcttacgtgataaaaatcatccagaggaattgcgtaaaatactcattgatcctaagatggtagaacttgcacctgataatgattta

SEQ ID NO: 496805 - DNA, 106 bp, Homo sapiens
  misc_feature (5)..(5): n is a, c, g, or t
gtganctagaggacccggtcacttgctacacctttgattggagaatagtattagaaactaccatctgggcgctgacttacttttttacagaatcactctggctgtt

SEQ ID NO: 496806 - DNA, 315 bp, Homo sapiens
cctgtctttgatgctaatctctcttccttttcatccgtctgtactacatttctctttacctagtcatatcatttattgtcccttatttgatttacctttttctaatgatgacattttgttttttttttttttttttttttttgtttttttttttttttttttttttttttttttttttttttttttttttttttttttttttttttttttttttttttttttttttttttttttttttttttttttttttttttttttttttttttatagtaaatatttaattgtttccatcagcaattccagcacaagttttcc

SEQ ID NO: 496807 - DNA, 168 bp, Homo sapiens
ggggggccccccccccccctttggggggtaacccctttttccccgggggggccccccctttgggggggcccgggggtttttttcccccccccccccccccccccctggggttttttttttttttgggggggggggggaaaataataaaggggttttttggccccccca

SEQ ID NO: 496808 - DNA, 209 bp, Homo sapiens
ggatttttttccccggggaccagctctgtgaaggaaataaaaagccccatgtgtgttaaaaaaaaaaattaaaattaaaatgaaaaaaagctttttttcttttctttttaaaaggatttaaaatctgtttctctcttctgttactttacacggaagaaagctctgctcttctgtggtcttaaaaccaaatgaaataaacgtgcaaagga

SEQ ID NO: 496809 - DNA, 153 bp, Homo sapiens
gaggatcccggcagaggcagctggccatcagctgagagatcagaggtggagcagggataggagcggaagcagcgcactcttggcctgtggctgcccgcaagaagctggagggagagctggaggagctgaaaggctcagtatgtgcctctgcct

SEQ ID NO: 496810 - DNA, 280 bp, Homo sapiens
  misc_feature (118)..(118): n is a, c, g, or t
  misc_feature (123)..(123): n is a, c, g, or t
  misc_feature (148)..(148): n is a, c, g, or t
  misc_feature (161)..(161): n is a, c, g, or t
  misc_feature (210)..(210): n is a, c, g, or t
  misc_feature (219)..(219): n is a, c, g, or t
  misc_feature (255)..(255): n is a, c, g, or t
ttaaggccatcccttatatcttacatccggcgcttacactctatggaaaccgctaccatatcctgcaccacccttccactggtatacaaagccgcacatgcctccacatgccacgaangcaangaccccgtacgcctaaccgcgttgngtacccactacgnaatgcacccacccccttcctctcctcttcccctccggttccgcaccaanggggccttngtcatatcttcgaccaccaaaatatagtagtcctangcacccgaaacgttccttactgatc

SEQ ID NO: 496811 - DNA, 363 bp, Homo sapiens
atgtagttaggacctcgagggctggagtgatctgtgtgcccgggagacgtgaacttgttgtactgggagtacatcaagcgggagggatatcatgtccggaagcacacgagccaaggtctcggatcccacgtctcagatgctggtattgtacaagcttagcctgagctgggatgcaggtgagcgaaggcatggcctcgtcgatattgtgtaggcagccaggtcagtgatgttgtgctgggacatactataagtcccagtggtttgggaagctgagttgatgagattccttgaggccaggaggtcagggcggcagaggtattatcatagcattatattctagctttgtgtgacacaagcgatccc

SEQ ID NO: 496812 - DNA, 611 bp, Homo sapiens
  misc_feature (29)..(29): n is a, c, g, or t
  misc_feature (42)..(42): n is a, c, g, or t
  misc_feature (79)..(79): n is a, c, g, or t
  misc_feature (86)..(86): n is a, c, g, or t
  misc_feature (125)..(125): n is a, c, g, or t
tatgattcaccagttagccacagtagtanaacagcaaagtcnaatggcatgaaggatgcagggccaagcagcccagcgnacgtgcnttcaaatagttctcatggttatcctaatgacactgtttntttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggaggtcattgggatcctgggcagagtcaagtgcagtaaaagataactatggtgaaaccttgctgattccaattaactaagaaggtctctctgaattaggagaaaatatgaatttaaagatgtcatcttatataattttgaagtttatacagtgacccacacttatacaacctaataaaatttcttaagggaatcatattaataagccaaaa

SEQ ID NO: 496813 - DNA, 576 bp, Homo sapiens
  misc_feature (29)..(29): n is a, c, g, or t
  misc_feature (42)..(42): n is a, c, g, or t
  misc_feature (79)..(79): n is a, c, g, or t
  misc_feature (86)..(86): n is a, c, g, or t
  misc_feature (125)..(125): n is a, c, g, or t
  misc_feature (414)..(414): n is a, c, g, or t
  misc_feature (419)..(419): n is a, c, g, or t
  misc_feature (439)..(439): n is a, c, g, or t
  misc_feature (459)..(459): n is a, c, g, or t
  misc_feature (480)..(480): n is a, c, g, or t
  misc_feature (493)..(493): n is a, c, g, or t
tatgattcaccagttagccacagtagtanaacagcaaagtcnaatggcatgaaggatgcagggccaagcagcccagcgnacgtgcnttcaaatagttctcatggttatcctaatgacactgtttntttggcttcctccatagccactcagccagaactcataactgttcatattgtcaaagggccaatgggctttggttttactatcgcagacagtcctggtgggggtggccaaagagtgaaacagattgttgacagcccaaggtgccgaggcctgaaagaaggggatctcatagtggaagttaataagaagaacgtgcaggccctaactcacaaccaagtggtggatatgctggttgagtgtcctaagggaagtgaggtcacattgttggtgcaacgaggagggctgccagtncccangaagagcccaaagtcgcaancactggaaaggaaagacagncagaatagttctcagcacagngtttccagccacngaagcctgcacacagcatccccaagccacacggagcacaggtgctccccgagtgcccacctgcagaggcccaagcttccagat

SEQ ID NO: 496814 - DNA, 272 bp, Homo sapiens
ggcgcgaattcactagtgattgtgagctgagatcgcaccactgcactccagtctagtgcgacaagagcgaaactccatctcaaaaaaaaaaaaaaaaaaaaaaaaagggaattaaggtcctgatacttgctacaaaatgatgcagggcccctgaaaacaacacgctaggttaaattggcccagacacaaaaagccaagttttacattgattcccagtttacattgaaattatctagacataagaaaatttcacagaaaacaaagattagatt

SEQ ID NO: 496815 - DNA, 107 bp, Homo sapiens
aaagagaaggaactgcggaaactgggaggaatcatataaaaagtataaatagccaccgggcacagtggctcatgcctgtaatcccagcactttgggaggctgagatg

SEQ ID NO: 496816 - DNA, 283 bp, Homo sapiens
ttggaaaatggacagatttctgaaccgctttcacctgggcgaacctgaagcaagcacccagttcatgacccagaactaccaggactcaccaaccctccaggctcacagaggaaggccagcgagcccaagcaccaaaccaggcggagctcgctgcctgctagatagaagcttcgccctccgcgcatgtggcaccactgctcaacaccgaagacacgactacggaaccccctttgcacaccgaccccactcttatcccacctcacaaaaacaataaaacaccacc

SEQ ID NO: 496817 - DNA, 378 bp, Homo sapiens
  misc_feature (280)..(280): n is a, c, g, or t
  misc_feature (300)..(300): n is a, c, g, or t
  misc_feature (332)..(332): n is a, c, g, or t
  misc_feature (336)..(336): n is a, c, g, or t
  misc_feature (352)..(352): n is a, c, g, or t
  misc_feature (355)..(355): n is a, c, g, or t
  misc_feature (359)..(359): n is a, c, g, or t
  misc_feature (365)..(365): n is a, c, g, or t
aagtcccccctcgggtgaaaaaattggggtttgggtgcgctattacttccggaacggcacccccaacatgttccgggaataccggggccttacccccccagggggtgttacccaatgcttcccaaacatggggggccggcccccgcgcccgagcccccccccttcagatcattaagggggaggagattccggccaacaaattcccccggccggctgtcaaacagtttcccgactccaaaatcaagtttcccctgcccccccgggttttgggccgtcagcncaaaccccgctttccccccnaaagggcccacccctttttttaggggcagggncctngtccgggggggccccnaanaaantcaggnacgccccggggga

SEQ ID NO: 496818 - DNA, 404 bp, Homo sapiens
  misc_feature (370)..(370): n is a, c, g, or t
  misc_feature (385)..(385): n is a, c, g, or t
  misc_feature (399)..(399): n is a, c, g, or t
ttaccccattgattggatataccacaattttttaatccgttcatcttgttgatggacatttaggttgttttttagcgtttagttttaccaataaagatgctataggcatccagataatagtgtttgtatggacacatgctttcatttttcttcagtaaataacccagcagtggaatgctgtcatctggtaggtatatatttaatcttttaagaaactgctaaactgttttccaaagtggttgtaccattttgcgctccctctaggcattgtatgaggagttccagtcattttattatctttgtcagcacttatatggtcagccctttttaattttaggcccttctagggggggtgtttagtgggtatccncttatggggttttangtggcctttcaccnatgga

SEQ ID NO: 496819 - DNA, 140 bp, Homo sapiens
  misc_feature (61)..(61): n is a, c, g, or t
gcatatcagaaacttaggctgggtgcaaaggcctctccttcttctctcttcacatccctgncgggactctaggtcactgtaatcccagctactcgggagactgaggcaggagaatcgcttgaactcaggatgcttcttga

SEQ ID NO: 496820 - DNA, 171 bp, Homo sapiens
tccagacgaaggtgtgtacagattatctcgaagcagacagctgatgtgtttgaaaatgaagaacgcttaagacaggcatgttgaattactaggaaatgcctccagactactagtacgagtacgttaggctatggtctttacaagacatattgctgcgatgtgttaacctat

SEQ ID NO: 496821 - DNA, 113 bp, Homo sapiens
tacatggagccccatttccatcaggcctctgtgagtctataccccatcagcccctgagccagtgagtctgtctgtccgcccacctgcccatggtggcgcctcatgttggtttc

SEQ ID NO: 496822 - DNA, 1388 bp, Homo sapiens
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 496823 - DNA, 415 bp, Homo sapiens
  misc_feature (41)..(41): n is a, c, g, or t
ctgtaggaattcggcactagcgcctcgttaccccacacgcntttggcacactgaagtgggtaacctctatatccctcctctttctctctagctcggcttattccagaggtgtgtgtcgtcgagatgcacacacgagtgagggtgcgtcatagggttaaagatttgggagaagaaaatttcaaagccttggtggtgagtggctttgcgtcagaatcttcagcagtgtgcatttgaagatcatggaaattagtgagatgagaggaccggatttgcacctttttggagacaaattatgcacaggtgcgactcttcgtgaaacctatggtgaaatggctgactggtgtgcacaacaagaacctgagagaaatggatgcgttttgcgacacaaagatgaccccccttccccgagtggtgg

SEQ ID NO: 496824 - DNA, 1710 bp, Homo sapiens
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctcgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 496825 - DNA, 630 bp, Homo sapiens
gatacagccatttccactgcaccctattactcgacagaggcagttccgaacgactacttatatacgacagccagacgacatccttactttaattccgagcaactccagttcttcagctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccacttgaatgccgaaatgcctgaggaatagcttcttgatttgcctcattaggtgcctgatcttgctgatgttatttgacggatatgccacaaagctttctggctctgtcagccggtccaggctcg

SEQ ID NO: 496826 - DNA, 1946 bp, Homo sapiens
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaccctgccagcagccctgggaaaaggctgtggcctcagggcgcctcccagtgccagaaaataaagtccttttggattctgaaaaaaaaaaaaaactaaaaaaaaaaactccggggcctttttcgggggcggacaaacgggggtttggaaggggccatgggcaaagttttcctggacccgttttttttgccaaggggaaatcgggggcgcccctaatgggggcgatattcgaaaagccggttaacccgtttcgggaaaaggt

SEQ ID NO: 496827 - DNA, 1761 bp, Homo sapiens
  misc_feature (2)..(3): n is a, c, g, or t
  misc_feature (1118)..(1118): n is a, c, g, or t
  misc_feature (1129)..(1129): n is a, c, g, or t
  misc_feature (1135)..(1135): n is a, c, g, or t
  misc_feature (1258)..(1258): n is a, c, g, or t
  misc_feature (1293)..(1293): n is a, c, g, or t
  misc_feature (1342)..(1342): n is a, c, g, or t
  misc_feature (1349)..(1349): n is a, c, g, or t
  misc_feature (1370)..(1370): n is a, c, g, or t
  misc_feature (1412)..(1412): n is a, c, g, or t
  misc_feature (1431)..(1431): n is a, c, g, or t
  misc_feature (1443)..(1443): n is a, c, g, or t
  misc_feature (1455)..(1455): n is a, c, g, or t
  misc_feature (1499)..(1499): n is a, c, g, or t
  misc_feature (1502)..(1502): n is a, c, g, or t
  misc_feature (1505)..(1505): n is a, c, g, or t
  misc_feature (1513)..(1514): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcgaaaactatgctgaggcacaggatgtgttnctgggcatgtntttgtntgaatatgcacgaaggcattctgagtactctgtcgtgctgctgctgagacttgccaagacatatgaaaccactctatagaagtgctgtgccgctgcagatactcatgaatgctatgccaaagngttcgatgaatttaaacctcttgtggaagagcctnagaatttaatcaaacaaaattgtgagctttttgagcagcttggagagtncaaattncagaatgcgctattagttcgntacaccaagaaagtgccccaagtgtcaacttcaactcttgtngaggtctcaagaaacctangaaaagtgggcngcaaatgttganaacattctggagcaaaaagatggcctgtgcacaagctatctatncgnggncctgccanntatgtgtgttgcctgagaaaacgccacgtagtgacagagtcaccaaatgctgtacagaatactttgtgaacacgcgaacatgcttttcagatctggaagtcgatgaaacatacgcttcccaagagagtaatgctgaaacattcacctttcatgcagatatatgcacactctctgtgaaggggagacacatcttgaaacacactgcgcttgttgagcttgtgaaacacaagcgccaggcgacatgcaa

SEQ ID NO: 496828 - DNA, 552 bp, Homo sapiens
caataattatgttttataatatctgcctaaaaatgctttccacaatctttttggtaacttgcaatcttaaaattatgctaagtaatacatattcattaactatctagattatttctaagtcagataaaccactgaaaatttatttttaagcataagtttaattttatatacttttggcttcttatttttatatcatatagagaggctacatatatttaggtctgttactaaacattctttttgccacattaaaacaattgtattacgaggaagcacatacctataaaaattgtgagatggtatattcataaaatttgctgatctgctacagaatgttggtacttgacagacaactcacaattgtctataacctagttttttctgttaccaaaaaaagaggttacttatggttaaaaattttaatcaacatatgtaaataaagctactagaactaataaagataaagggaaatgacttgcaagcacaatttgcaaagcaggaagaatgtgtttttgtatgggaaaaataaaaatacctgtcttaaaaaaaaaa

SEQ ID NO: 496829 - DNA, 1766 bp, Homo sapiens
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaccctgccagcagccctgggaaaaggctgtggcctcagggcgcctcccagtgccagaaaataaagtccttttggattctga

SEQ ID NO: 496830 - DNA, 1537 bp, Homo sapiens
  misc_feature (2)..(3): n is a, c, g, or t
  misc_feature (1172)..(1172): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcaaaacttagcttaggccaaaggatggcttcctgggcctgtgttttgtttgaaatttcccagaagggttcctggttaacctttgngggctggttgtgtgaactttgccaaaactttttaaaccccctttagaaagggtggggcccttgggaacctcctttaatggtttgcccaaagggttgggggagatttacccctttttgggggagacccccaaatttatttaacccaaatttgggggttttttgggggcctctggaggacgaaatttccaagagccctctttgttttttcaccacacaaggacccccagggggaccccccccttttgtggggtgctaaaaaccctcgaaaatggggggcaatatgtgtatccttccgacatcgcccttgggaagacagctccccattgtgacatattctggggaacagcaccagcttttcctttggg

SEQ ID NO: 496831 - DNA, 1612 bp, Homo sapiens
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 496832 - DNA, 1703 bp, Homo sapiens
  misc_feature (2)..(3): n is a, c, g, or t
  misc_feature (1200)..(1200): n is a, c, g, or t
  misc_feature (1235)..(1235): n is a, c, g, or t
  misc_feature (1284)..(1284): n is a, c, g, or t
  misc_feature (1291)..(1291): n is a, c, g, or t
  misc_feature (1312)..(1312): n is a, c, g, or t
  misc_feature (1354)..(1354): n is a, c, g, or t
  misc_feature (1373)..(1373): n is a, c, g, or t
  misc_feature (1385)..(1385): n is a, c, g, or t
  misc_feature (1397)..(1397): n is a, c, g, or t
  misc_feature (1441)..(1441): n is a, c, g, or t
  misc_feature (1444)..(1444): n is a, c, g, or t
  misc_feature (1447)..(1447): n is a, c, g, or t
  misc_feature (1455)..(1456): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcgaaggcattctgagtactctgtcgtgctgctgctgagacttgccaagacatatgaaaccactctatagaagtgctgtgccgctgcagatactcatgaatgctatgccaaagngttcgatgaatttaaacctcttgtggaagagcctnagaatttaatcaaacaaaattgtgagctttttgagcagcttggagagtncaaattncagaatgcgctattagttcgntacaccaagaaagtgccccaagtgtcaacttcaactcttgtngaggtctcaagaaacctangaaaagtgggcngcaaatgttganaacattctggagcaaaaagatggcctgtgcacaagctatctatncgnggncctgccanntatgtgtgttgcctgagaaaacgccacgtagtgacagagtcaccaaatgctgtacagaatactttgtgaacacgcgaacatgcttttcagatctggaagtcgatgaaacatacgcttcccaagagagtaatgctgaaacattcacctttcatgcagatatatgcacactctctgtgaaggggagacacatcttgaaacacactgcgcttgttgagcttgtgaaacacaagcgccaggcgacatgcaa

SEQ ID NO: 496833 - DNA, 284 bp, Homo sapiens
tttagaactattgcgaggataagttatagatattttatctctccttgggagaactactcatccatttacgatagaagatacagctgaatttcttgtgtgttgttttagaagatgagaatcagataaaagagagttgcaaatctacattacaacccttgaagaaatgtgaggtaagccttaacaacatttgaataatttaaatggttactattagagaaggcttttttagtaacacaattggagtgccggggccaatgtgaatagagaaatgtgtgagagtagtg

SEQ ID NO: 496834 - DNA, 98 bp, Homo sapiens
gcatgttttgtgtatataaaagggggggtttttttaaaaatatattcccagattatccttgtaatgacccgaatttgcaataaaacccatcagggtta

SEQ ID NO: 496835 - DNA, 1578 bp, Homo sapiens
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 496836 - DNA, 1025 bp, Homo sapiens
  misc_feature (2)..(3): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagatttgaacttcatttagactgtaagtcttgagaacatcattattggaataatcggactatatttgcctaagttgtttgtt

SEQ ID NO: 496837 - DNA, 2133 bp, Homo sapiens
  misc_feature (1469)..(1469): n is a, c, g, or t
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtatgcccgcccagccccactccccaactggagaagctcagcacagggcggagtgggggcaggcacanggcacagggcctggaggggctccaggtgttgaggactcttcccggcaccgggagcccctgcacggcctctgccctggaggtgctcggccctcggtctgcctgggaacttcctgggcctcacaggccatcacagcagggggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctgaaaaaaaaaaaaaactaaaaaaaaaaactccggggcctttttcgggggcggacaaacgggggtttggaaggggccatgggcaaagttttcctggacccgttttttttgccaaggggaaatcgggggcgcccctaatgggggcgatattcgaaaagccggttaacccgtttcgggaaaaggt

SEQ ID NO: 496838 - DNA, 1705 bp, Homo sapiens
  misc_feature (2)..(3): n is a, c, g, or t
  misc_feature (1062)..(1062): n is a, c, g, or t
  misc_feature (1073)..(1073): n is a, c, g, or t
  misc_feature (1079)..(1079): n is a, c, g, or t
  misc_feature (1202)..(1202): n is a, c, g, or t
  misc_feature (1237)..(1237): n is a, c, g, or t
  misc_feature (1286)..(1286): n is a, c, g, or t
  misc_feature (1293)..(1293): n is a, c, g, or t
  misc_feature (1314)..(1314): n is a, c, g, or t
  misc_feature (1356)..(1356): n is a, c, g, or t
  misc_feature (1375)..(1375): n is a, c, g, or t
  misc_feature (1387)..(1387): n is a, c, g, or t
  misc_feature (1399)..(1399): n is a, c, g, or t
  misc_feature (1443)..(1443): n is a, c, g, or t
  misc_feature (1446)..(1446): n is a, c, g, or t
  misc_feature (1449)..(1449): n is a, c, g, or t
  misc_feature (1457)..(1458): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctcatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcgaaaactatgctgaggcacaggatgtgttnctgggcatgtntttgtntgaatatgcacgaaggcattctgagtactctgtcgtgctgctgctgagacttgccaagacatatgaaaccactctatagaagtgctgtgccgctgcagatactcatgaatgctatgccaaagngttcgatgaatttaaacctcttgtggaagagcctnagaatttaatcaaacaaaattgtgagctttttgagcagcttggagagtncaaattncagaatgcgctattagttcgntacaccaagaaagtgccccaagtgtcaacttcaactcttgtngaggtctcaagaaacctangaaaagtgggcngcaaatgttganaacattctggagcaaaaagatggcctgtgcacaagctatctatncgnggncctgccanntatgtgtgttgcctgagaaaacgccacgtagtgacagagtcaccaaatgctgtacagaatactttgtgaacacgcgaacatgcttttcagatctggaagtcgatgaaacatacgcttcccaagagagtaatgctgaaacattcacctttcatgcagatatatgcacactctctgtgaaggggagacacatcttgaaacacactgcgcttgttgagcttgtgaaacacaagcgccaggcgacatgcaa

SEQ ID NO: 496839 - DNA, 1369 bp, Homo sapiens
gagagttggttgtgtgttttgataagagtaagtgtggtggtactaaatctctattgtttgtagatttgcgatatgggtgttgtagatgaaagagggaatggttgtaaaattgttctgtcagaggaataatgtggggcatgataatagttggggtgtgttataaaggggtctgttgtagtagtatgtattaattcctatggctgtttatactattcttgtggattggcggcttaagacttgtgtgattatgaataactccttagtgtatgactcttcttgcggggaaaatgtctctaatgtgtgttgagagccggggtttgcccaatatctcccaactggggtgattatggatgtgccagcggaacttcttctgccgtgataattgtgggtattttactgccccggggtataatattctgccccccgtcgtagggcttccgacacaggagagtcactccacacgttttccacatcgtagattggaatcgttgttagagttgcgggttttccgttggggtggaatagcccacggttgttcccggtgtcccatcccccaagtgtgggggcggggcgtaatcttcggtcacattaatggagacgtctgccccgctgtagcaacggggttcttgcaaaatatgaagttgtagattgcggtggtgataatctcgctcacgatatagagctcagctctgggcgttcattctctcggggaaagctttgttgaagaagaaatagagatcactttggtgctgtatcgaataatgggggcgaccaatatgtgccccgcgagaaatggttgtctgtcgctaatcgggggtctcttggttatttgtggagctctctcacgtggcctttgtccacacatcgtgttaccctatatagcacacatgtctggtgaccacgggtacaccccacgttatagccgcgagagagtgtagatgtcctgataatactccgccatgggcgcgcagagatccacacagcccacgcggagattggagagaggttttgtggagaaaggtgcactgttctcctgtaaacgcgcacatgagagtgagacgctcgccgtggacaaagagagaacttagaattgtctctctgtgtaagtctcgaaagagaacacttcttcaccacgtgggaaaccccacgggttctatttcctacggctcctagcacctgagaaacatgcaaaatgcacaagccactttgaagtgccctttcttgagaattttaagccccaatatgagcacactggccactttttgtaaacgaggagcccccacggcctttttcactaagactttgtattcaacttagtttaaagtagatttgccattagcttttttgtaaaataaaagcacaggacaga

SEQ ID NO: 496840 - DNA, 1465 bp, Homo sapiens
cggcacgagggttgccgctgcgcacctggctcaggtgagctgccccgcccccgcccggcgcgagccccaggtcctggcagcagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctctggtaccaggacgcgtatggggaggtggagataaacgcgactgccccgaggaccgcaagttcgtgaacttcatcctaaagccgcagctggagcggcgtcggggctacaagctcttcctggacgaccgcgacctcctgccgcgcgctgagccctccgccgacctcttggtgaacctgagccgctgccgacgcctcatcgtggtgctttcggacgccttcctgagccgggcctggtgcagccacagcttccgactccttcctccgatttttggaaagaagtgcagctggcgctgccgcggaaggtgcggtacaggccggtggaaggagacccccagacgcagctgcaggacgacaaggaccccatgctgattcttcgaggccgagtccctgagggccgggccctggactcagaggtggacccggaccctgagggcgacctgggtgtccgggggcctgtttttggagagccatcagctccaccgcacaccagtggggtctcgctgggagagagccggagcagcgaagtggacgtctcggatctcggctcgcgaaactacagtgcccgcacagacttctactgcctggtgtccaaggatgatatgtagctcccaccccagagtgcaggatcatagggacagcgggggccagggcagcggcgtcgctcctctgctcaacaggaccacaacccctgccagcagccctgggaccctgccagcagccctgggaaaaggctgtggcctcagggcgcctcccagtgccagaaaataaagtccttttggattctga

SEQ ID NO: 496841 - DNA, 1769 bp, Homo sapiens
  misc_feature (1126)..(1126): n is a, c, g, or t
  misc_feature (1137)..(1137): n is a, c, g, or t
  misc_feature (1143)..(1143): n is a, c, g, or t
  misc_feature (1266)..(1266): n is a, c, g, or t
  misc_feature (1301)..(1301): n is a, c, g, or t
  misc_feature (1350)..(1350): n is a, c, g, or t
  misc_feature (1357)..(1357): n is a, c, g, or t
  misc_feature (1378)..(1378): n is a, c, g, or t
  misc_feature (1420)..(1420): n is a, c, g, or t
  misc_feature (1439)..(1439): n is a, c, g, or t
  misc_feature (1451)..(1451): n is a, c, g, or t
  misc_feature (1463)..(1463): n is a, c, g, or t
  misc_feature (1507)..(1507): n is a, c, g, or t
  misc_feature (1510)..(1510): n is a, c, g, or t
  misc_feature (1513)..(1513): n is a, c, g, or t
  misc_feature (1521)..(1522): n is a, c, g, or t
aggcccctctttgtttttttctctctcttcttgtggcgaattccggaccaggtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctaaaaggtataaagctgcttttacagaatgttgccaagctgctgataaagctgcctgcctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcgaaaactatgctgaggcacaggatgtgttnctgggcatgtntttgtntgaatatgcacgaaggcattctgagtactctgtcgtgctgctgctgagacttgccaagacatatgaaaccactctatagaagtgctgtgccgctgcagatactcatgaatgctatgccaaagngttcgatgaatttaaacctcttgtggaagagcctnagaatttaatcaaacaaaattgtgagctttttgagcagcttggagagtncaaattncagaatgcgctattagttcgntacaccaagaaagtgccccaagtgtcaacttcaactcttgtngaggtctcaagaaacctangaaaagtgggcngcaaatgttganaacattctggagcaaaaagatggcctgtgcacaagctatctatncgnggncctgccanntatgtgtgttgcctgagaaaacgccacgtagtgacagagtcaccaaatgctgtacagaatactttgtgaacacgcgaacatgcttttcagatctggaagtcgatgaaacatacgcttcccaagagagtaatgctgaaacattcacctttcatgcagatatatgcacactctctgtgaaggggagacacatcttgaaacacactgcgcttgttgagcttgtgaaacacaagcgccaggcgacatgcaa

SEQ ID NO: 496842 - DNA, 1332 bp, Homo sapiens
  misc_feature (973)..(973): n is a, c, g, or t
  misc_feature (975)..(975): n is a, c, g, or t
ggaaagttctgatcaagaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccagcctctgacctgtccaggtgccctgtccagctgactgcaaggacagagaggagtcctgcccagctcttggatcagtctgctggccgaggagcccggtggagccaggggtgaccctggagcccagcctgccccgaggaggccccggctcagagccatgccaggtgtctgtgatagggcccctgacttcctctccccgtctgaagaccaggtgctgaggcctgccttgggcagctcagtggctctgaactgcacggcttgggtagtctctgggccccactgctccctgccttcagtccagtggctgaaagacgggcttccattgggaattgggggccactacagcctccacgagtactcctgggtcaaggccaacctgtcagaggtgcttgtgtccagtgtcctgggggtcaacgtgaccagcactgaagtctatggggccttcacctgctccatccagaacatcagcttctcctccttcactcttcagagagctggccctacaagccacgtggctgcggtgctggcctccctcctggtcctgctggccctgctgctggccgccctgctctatgtcaagtgccgtctcaacgtgctgctccagggcacgtctttccagaattcaaagagagcgatgccatgtttgctgccgagagagtgagtgtgggcggccgccaggggttctggagtcgggctgctcaggaagcgtgaaggggagtgctgggagcccggcttgtttgagggttggtggctgagctctcgtctgtctgggacctgaggatgcctgtgtgtcctggncngagcgtacagctgtctctgcagggcgaggtggagacgtggcttgagggcctttagagtggctagggggctcgggaaaggaaaacaagcacctttgatgaggaaggaagtcccttcctcaggcctcggcagcttcaccccaggccacgccgctgggaagggccgcccggggcattgctctcgctcgtgctggggtcctctctgggtccgttgccttctgtggggcaggggaggctctgtgcctctggggctggtggggcgggaagcgtgtggtcctgactgctgcccctcctcaggccccagactgggtggacgctgaggaatgccaccgctgcagggtgcagttcggggtgatgacc

SEQ ID NO: 496843 - DNA, 1704 bp, Homo sapiens
  misc_feature (2)..(3): n is a, c, g, or t
  misc_feature (1061)..(1061): n is a, c, g, or t
  misc_feature (1072)..(1072): n is a, c, g, or t
  misc_feature (1078)..(1078): n is a, c, g, or t
  misc_feature (1201)..(1201): n is a, c, g, or t
  misc_feature (1236)..(1236): n is a, c, g, or t
  misc_feature (1285)..(1285): n is a, c, g, or t
  misc_feature (1292)..(1292): n is a, c, g, or t
  misc_feature (1313)..(1313): n is a, c, g, or t
  misc_feature (1355)..(1355): n is a, c, g, or t
  misc_feature (1374)..(1374): n is a, c, g, or t
  misc_feature (1386)..(1386): n is a, c, g, or t
  misc_feature (1398)..(1398): n is a, c, g, or t
  misc_feature (1442)..(1442): n is a, c, g, or t
  misc_feature (1445)..(1445): n is a, c, g, or t
  misc_feature (1448)..(1448): n is a, c, g, or t
  misc_feature (1456)..(1457): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacatccttacttttatgccccggaactccttttctttgctctgttgccaaagctcgatgaacttcgggatgaagggaaggcttcgtctgccaaacagagactcaagtgtgccagtctccaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcgaaaactatgctgaggcacaggatgtgttnctgggcatgtntttgtntgaatatgcacgaaggcattctgagtactctgtcgtgctgctgctgagacttgccaagacatatgaaaccactctatagaagtgctgtgccgctgcagatactcatgaatgctatgccaaagngttcgatgaatttaaacctcttgtggaagagcctnagaatttaatcaaacaaaattgtgagctttttgagcagcttggagagtncaaattncagaatgcgctattagttcgntacaccaagaaagtgccccaagtgtcaacttcaactcttgtngaggtctcaagaaacctangaaaagtgggcngcaaatgttganaacattctggagcaaaaagatggcctgtgcacaagctatctatncgnggncctgccanntatgtgtgttgcctgagaaaacgccacgtagtgacagagtcaccaaatgctgtacagaatactttgtgaacacgcgaacatgcttttcagatctggaagtcgatgaaacatacgcttcccaagagagtaatgctgaaacattcacctttcatgcagatatatgcacactctctgtgaaggggagacacatcttgaaacacactgcgcttgttgagcttgtgaaacacaagcgccaggcgacatgcaa

SEQ ID NO: 496844 - DNA, 854 bp, Homo sapiens
catcaatcgcccacatcactcgagacgtaaattatggctgaatcatccgctaccttcacgccaaatggcgcctcaatattctttatctgcctcttcctacacatgagggaggcctatatacgggatcatttctctactcagaaaccgtgaaacatcggcattatcctcctgctggcaaactatagcaacagccttcataggctaatgtcctcccgtgagcgccaaatatcattctgagggggccacagtaaattccaacattactatccgcatcccatacatggggacagaccttagtccaaatgaatctgaggaggctacctcaagtagaacaagtcccaccattcaacaggattcatttaccctttgagttcatctgtgcctttcattatggcagcctagaagaatccacctcctattctggcaacgaaaacgggatcaaaacagcccctaggaatcacctcccatcggataaaaatcacccttccacccttattacacaactcaaagacgccctcggataagtttctgctaccattcgctccttaaatggacgttaacatgtaatctcacacagaccctcccataggggaccccagacagattatacccctaagacaaagccctttaaaaaacgccctccccaaattaaagccggagtgattatttgcctattcccgcctaaacaaattcttccgatcggcctaacaagctaggagggggtcttgccgtattaataatcgatctgatcctagaataatcccaatctccatattccaaagaagaaggttatattgggccatagacaatatttatggcatctagggagactctattaaccggatgggaacacg

SEQ ID NO: 496845 - DNA, 1587 bp, Homo sapiens
  misc_feature (2)..(3): n is a, c, g, or t
  misc_feature (944)..(944): n is a, c, g, or t
  misc_feature (955)..(955): n is a, c, g, or t
  misc_feature (961)..(961): n is a, c, g, or t
  misc_feature (1084)..(1084): n is a, c, g, or t
  misc_feature (1119)..(1119): n is a, c, g, or t
  misc_feature (1168)..(1168): n is a, c, g, or t
  misc_feature (1175)..(1175): n is a, c, g, or t
  misc_feature (1196)..(1196): n is a, c, g, or t
  misc_feature (1238)..(1238): n is a, c, g, or t
  misc_feature (1257)..(1257): n is a, c, g, or t
  misc_feature (1269)..(1269): n is a, c, g, or t
  misc_feature (1281)..(1281): n is a, c, g, or t
  misc_feature (1325)..(1325): n is a, c, g, or t
  misc_feature (1328)..(1328): n is a, c, g, or t
  misc_feature (1331)..(1331): n is a, c, g, or t
  misc_feature (1339)..(1340): n is a, c, g, or t
anntcccctttcactgttgccgtagtgctagcttttctcttctgtcaaccccacacgcctttggcacaatgaagtgggtaacctttatttcccttctttttctctttagctcggcttattccaggggtgtgtttcgtcgagatgcacacaagagtgaggttgctcatcggtttaaagatttgggagaagaaaatttcaaagccttggtgttgattgcctttgctcagtatcttcagcagtgtccatttgaagatcatgtaaaattagtgaatgaagtaactgaatttgcaaaaacatgtgttgctgatgagtcagctgaaaattgtgacaaatcacttcataccctttttggagacaaattatgcacagttgcaactcttcgtgaaacctatggtgaaatggctgactgctgtgcaaaacaagaacctgagagaaatgaatgcttcttgcaacacaaagatgacaacccaaacctcccccgattggtgagaccagaggttgatgtgatgtgcactgcttttcatgacaatgaagagacatttttgaaaaaatacttatatgaaattgccagaagacaaaaatttggagaaagagctttcaaagcatgggcagtagctcgcctgagccagagatttcccaaagctgagtttgcagaagtttccaagttagtgacagatcttaccaaagtccacacggaatgctgccatggagatctgcttgaatgtgctgatgacagggcggaccttgccaagtatatctgtgaaaatcaagattcgatctccagtaaactgaaggaatgctgtgaaaaacctctgttggaaaaatcccactgcattgccgaagtggaaaatgatgagatgcctgctgacttggcttcattagctgctgattttgttgaaagtaaggatgtttgcgaaaactatgctgaggcacaggatgtgttnctgggcatgtntttgtntgaatatgcacgaaggcattctgagtactctgtcgtgctgctgctgagacttgccaagacatatgaaaccactctatagaagtgctgtgccgctgcagatactcatgaatgctatgccaaagngttcgatgaatttaaacctcttgtggaagagcctnagaatttaatcaaacaaaattgtgagctttttgagcagcttggagagtncaaattncagaatgcgctattagttcgntacaccaagaaagtgccccaagtgtcaacttcaactcttgtngaggtctcaagaaacctangaaaagtgggcngcaaatgttganaacattctggagcaaaaagatggcctgtgcacaagctatctatncgnggncctgccanntatgtgtgttgcctgagaaaacgccacgtagtgacagagtcaccaaatgctgtacagaatactttgtgaacacgcgaacatgcttttcagatctggaagtcgatgaaacatacgcttcccaagagagtaatgctgaaacattcacctttcatgcagatatatgcacactctctgtgaaggggagacacatcttgaaacacactgcgcttgttgagcttgtgaaacacaagcgccaggcgacatgcaa

SEQ ID NO: 496846 - DNA, 819 bp, Homo sapiens
ggtttgtttcgcatctacacaccagcgatggacggtccctgcaaatctgcaagggacccagtctccagctgagtttcaggtccaggaacacagcctgttagaaacgtccaagacacgtcccaaggataagaagaaaaatggagagctacagagcctaagacaatgggagttgcacgaatcgaaaactattactatcagaagcatttcccagccaccaaaaggaaaatgaaaacggaacgtgactttaaccactcaccagatggagactgtgattattaaagaaatcacaggtttcgcctcttgcaatctgcatctggtgagtgagtgaaggtgaccgcgtggagctggagagctttcttaggactggagcgcccctcaccccaaacctgtttcccgtgcgtgatgatgacttcacgaaacgcggtttcagttctaacctcagcattccactgtcggggatcctggcactgcgagccccgctgctcgatctggtgtcatcaccgggcagctagtcttgtatgtaagacaccagtgtcatgtatattaacgaaatacactaacaaaggttcggatggacgatatccatacaaaatcatcgtaaaggccagcctcagaaagcagaagtcccgggaccggtgctcccccggagggcagctgccgcccctgagcaaactgcttgcgggtctcacttccaacaccccggggattctgacatgcacacgggtgtgtcatccaggaacaggtgcggaatcaaggcgggcgctgaatcaggccgactcggagcactgcagcgacatgaccactaacacgtacccaaac

SEQ ID NO: 496847 - DNA, 149 bp, Homo sapiens
  misc_feature (67)..(67): n is a, c, g, or t
tacagtctgttaagatgttatcgggaccggcatcatgaggtgaaaggatacttgtaatgcagggatntctaacggtgccgggcgccatgatcgtgacactgcatccagcctgggtgacagaacgagaccctgtcaaacaaaaaaaaaaa

SEQ ID NO: 496848 - DNA, 568 bp, Homo sapiens
agcggatcgccaagaaaggtgggaagagaatttaggagggctccgatcctcccactgggcatcgggtgtgaaactggtgctgcctaacgcgctgggagtcacctggggaagcggggctgggcccaccatggtccaccctctctggccgctaaggcagagaaggaacgcagccaccctcgctcatggtgctcccccgcccgcctgaccctcgagaaggaggactgagagcctgaagggctgtgagctgtacgtgccaggtgcacgggatccagcaggttctcaaagactgtatcgtgcacctcttgcattctccaagccctgaacgccgccatgaagttcctccgggagcacttcgagaagctggagaatggaagaaaacaggcagattttggcgcgggcacaaagtcaatagctcacagtcgagactccccatgaatgcggaggtggtcgcacaggccccacacgaacgactggggcgaagaacgcgcccgcgggagagaaagcgcgtgactgccggagcgagaacaccgacagaagaagccgtgagctacgtccagaaagggaacca

SEQ ID NO: 496849 - DNA, 229 bp, Homo sapiens
gttgtgctgcggtgttatagaggatccccggttgtagttgttctagttggatatatattaaaggatataactaatatgagtatgttgaagagatatctgtactactatgttcattgcagcattattcacaatagctaagatatgaaatcaacctaagtgttttcattcattgatggatgaatggtgaaagaaaatgtggcgtacatacacaatagaacaactacaaccg

SEQ ID NO: 496850 - DNA, 521 bp, Homo sapiens
attttgatagtactcatttaactgtctcctccttcccctaaggaaacgtttacatgagtaagctttcagggcatctgaaattagcacctatttgttttaaaatgtaggtgaaaacttctttatttaattttaaactacttaagtgacaatagaagcagtgaaactacggattttgtgtccatctcatctagctcctttgtcattttgtagtgttgacagatctttccatcagtgtcacttctgcttgtaatctgctttatgtttacacagatctctaaatcagtgtgcctacgggttctaacctttcctacaaagtataaaccaccacaagcttcaacactgaagatgggctttctgcatgggctctatggtgttaattaatctcccctctttggtttctgtctgggttttacatctgtgttcagccgatgtggatcttttctgtgtataattttaatgttttagtcagtgtccactttatgaatcactcttagatattaaaaaaataccttgctttacaa

SEQ ID NO: 496851 - DNA, 329 bp, Homo sapiens
  misc_feature (166)..(166): n is a, c, g, or t
caaaaaacccccccccccccttgggggaaagaggcccggccctttgtttaaatcctgccccttgaaaaccaacccttatttgccaaaaccccccccagcctttaacgggccttttgaaaggaccccctgaaaatttttttttggttggttggtttaaaccaacccnggggggggggaccggaaccccccccccccattgggggttttgggaaagccagccctctttaaattgggaattgggttttttttttaaagggggaaccccgtttttttttttcccaaggggaccggggcccctttggtttttaaaaaaaccggtttccctccca

SEQ ID NO: 496852 - DNA, 166 bp, Homo sapiens
gtgtgtggcagccgccaggttgccctgggcgtcacggccaccgcgccgaccgtgccgaacttcttgtcggcatccagcggatcggccggtgcgggctggccgcgcgcgaccatggcctggccgtcgtgatccagcacggcggcttccggcgtttcgcgggtaccga

SEQ ID NO: 496853 - DNA, 237 bp, Homo sapiens
gtccagtgaggacctttggctggattgtctcacgctgagtcgggtcctgtacgtgccaggtcccccctaaggactcagatcagaatccgaggtggacactttccaggtcagggctgcggccctgtgatgggcctacttttcaatcaggcctccctccttgtagcttgaagctagaagaacttctcccgggtcgctggcacagcaggccgtagctcgcctgtccagggggagttcgta

SEQ ID NO: 496854 - DNA, 580 bp, Homo sapiens
  misc_feature (1)..(1): n is a, c, g, or t
  misc_feature (98)..(98): n is a, c, g, or t
  misc_feature (115)..(115): n is a, c, g, or t
  misc_feature (158)..(158): n is a, c, g, or t
  misc_feature (238)..(238): n is a, c, g, or t
ngccaggggtgtgttgtggcgccaaaccggggtttttcaagtgtgttccctccccccctttcccccataggggtgggggggtggggggggtttttatnccagagcctttttgtanccgccgttgctggggacgccccccgttgtttttgcccctttanaacaccggggcccgttccccccccgggtttttttttggggcgcggggggggtaccaattttcccccgggaaccccttttnccctttgggcctttttggggccccctttaaccccgttttttccaaaaaaccggggggggcccggccgggttttcccgggtttttttgccccccggggtcccccccggggtcccccccggggtcccccccggggcccccggtttttttaaggggtttttttgggggggaattttcaccccacccccccccccttcccccgggggttttaaaattttgggggggggggcccccctccccctaggggggggggtttttttttgggggcccggggtttttttccccgggtgggggttttttttttttcccccccggggccctttaggccccctttttgccccccca

SEQ ID NO: 496855 - DNA, 321 bp, Homo sapiens
  misc_feature (241)..(241): n is a, c, g, or t
  misc_feature (266)..(266): n is a, c, g, or t
aaaccctgtctctactaaaactacaaaaaactagccgagcgtggtggcagcgcctgtagtcccagctactcaggaggctgaggcaggagaatggcgtgaacctgggaggcagagcttgcagtgagtggagattgcatcactacactctagcctgggcgacaaagcgagagtctgtctcaaaaaaaaataaaaaaataaagatgtttgtcatctttttgctaaataaataattaaaaacctnaatgtattttgtgctgcaaatttgncaacagcaagaagggtggaaaaggcttttaccccacaagatggggggaaacattt

SEQ ID NO: 496856 - DNA, 859 bp, Homo sapiens
  misc_feature (186)..(186): n is a, c, g, or t
cttcctgacagagtcgtacagttccagccaggacggggatcaccacgctgcacattgtctgtgcgtcgtccagagtgtcctgtaattgacctcggtggcattaccgatgacgtatgacactacgggaggactatgatagcgtgtcgttcaatgcagctatgtcgcaaagattgttaggcccaagtnaaactacgacaattagctgccagaggttgtgcgagtcagccgtatacgatgtagccaagaccttggggaagcgtcaactctaggcccctgtgagcaggtgccttgagaagagcttgtgcacgcggacgtgctggctggtgaaagagacgcatagatgctggtgctagactggcgtgacccttgtgggcgcttcgccgagcactagagtgtgcagcaaccccgacgttacactcagagagtagacgatccaggcaagtttagctagcaccaaatattgcccgcatccgcttgaccatagcgtcacgaaggcgtcagagagaaagctgcgcagtgacctggggtcgttgtggagcccacaaagcgcttggatccatgaagtcgcacgatcccatcgcgtatatgaaatggttcgaaacaagagttccccaccgtgacgaatccctggcggaacttactcgttgaattacgaggataggccattgcgcagaacacatgattatggcccgcaagaccacttatcggggacattgaacaagggcatctttcaaggaaccaggaagccgtggcttgttgggctcgacgcaattttcccttgcacattcctttttacccagaggttccacccgaatacttcaacccacccagaagttcttcgggaggtaaaggaatccac

SEQ ID NO: 496857 - DNA, 869 bp, Homo sapiens
ggcacagaattcaattctgtggcgtcctctggtgttgagtggtgcggcctagtgtgtggtgtgcggaggagctccaggcccgtcggcgcttgagtggtctcacgtgtgaagacatggcgtacagatgggcatgggaagtatgtagatccatcaatctgtggagatagcttgagtgtgtctatcagaggatagagtgtaagctgtggacctttgtcagcaagaccatttctcatcagcccggcgttttccataatggaggtgaagtgtctgtgtgccagaaagtcaccgttcaggggaggtgacattacggagttataatttctggagataccatggacctggaagacaaccaacatttggagaccttcatcaaacagaattaggcccctctggtgctggctgccacgtgggcatcaatcagaatggcacaggcaagtctgtccaagaagccagctcttccagcagtggccccatcagaatatccctaagaggacagatgtgaagagccaggatgtggcgtacccccgcaggcagaaaccaggctcaaagagctatgtcgacaggcaccatggaatccttgagtcaagccaaaagttccgcgtacggacacaactccacggggtcaatactaacgtagcagggcaaccccaaaatcagggcaacccccaacaaaaagtggatacacagacacggcccgcacgacagcactcaccagatgaagagtggccccgggcatcacaccgcggaaacccgcaacagctctcgcacgaggaatcgagaccaggacaagcaccagaggagagagaggaccatacgaagggaacgaacggacccaaaaagccacgaccaagaagcggacgaaaatacca

SEQ ID NO: 496858 - DNA, 896 bp, Homo sapiens
  misc_feature (31)..(31): n is a, c, g, or t
  misc_feature (280)..(280): n is a, c, g, or t
  misc_feature (290)..(290): n is a, c, g, or t
  misc_feature (302)..(302): n is a, c, g, or t
  misc_feature (312)..(312): n is a, c, g, or t
  misc_feature (322)..(322): n is a, c, g, or t
  misc_feature (331)..(331): n is a, c, g, or t
  misc_feature (343)..(343): n is a, c, g, or t
  misc_feature (355)..(355): n is a, c, g, or t
  misc_feature (359)..(359): n is a, c, g, or t
  misc_feature (368)..(369): n is a, c, g, or t
  misc_feature (371)..(371): n is a, c, g, or t
  misc_feature (377)..(377): n is a, c, g, or t
  misc_feature (379)..(379): n is a, c, g, or t
  misc_feature (383)..(383): n is a, c, g, or t
  misc_feature (393)..(393): n is a, c, g, or t
  misc_feature (397)..(397): n is a, c, g, or t
  misc_feature (403)..(403): n is a, c, g, or t
  misc_feature (424)..(424): n is a, c, g, or t
  misc_feature (428)..(428): n is a, c, g, or t
  misc_feature (431)..(431): n is a, c, g, or t
  misc_feature (433)..(433): n is a, c, g, or t
  misc_feature (446)..(446): n is a, c, g, or t
  misc_feature (460)..(460): n is a, c, g, or t
  misc_feature (462)..(462): n is a, c, g, or t
  misc_feature (469)..(469): n is a, c, g, or t
  misc_feature (473)..(473): n is a, c, g, or t
  misc_feature (480)..(480): n is a, c, g, or t
  misc_feature (491)..(491): n is a, c, g, or t
  misc_feature (508)..(508): n is a, c, g, or t
  misc_feature (514)..(514): n is a, c, g, or t
  misc_feature (516)..(516): n is a, c, g, or t
  misc_feature (521)..(521): n is a, c, g, or t
  misc_feature (536)..(536): n is a, c, g, or t
  misc_feature (540)..(540): n is a, c, g, or t
  misc_feature (547)..(547): n is a, c, g, or t
  misc_feature (566)..(566): n is a, c, g, or t
  misc_feature (575)..(575): n is a, c, g, or t
  misc_feature (578)..(578): n is a, c, g, or t
  misc_feature (585)..(585): n is a, c, g, or t
  misc_feature (590)..(590): n is a, c, g, or t
  misc_feature (625)..(625): n is a, c, g, or t
  misc_feature (631)..(631): n is a, c, g, or t
  misc_feature (638)..(638): n is a, c, g, or t
  misc_feature (646)..(646): n is a, c, g, or t
  misc_feature (649)..(649): n is a, c, g, or t
  misc_feature (671)..(671): n is a, c, g, or t
  misc_feature (675)..(675): n is a, c, g, or t
  misc_feature (678)..(678): n is a, c, g, or t
  misc_feature (684)..(684): n is a, c, g, or t
  misc_feature (702)..(702): n is a, c, g, or t
  misc_feature (712)..(712): n is a, c, g, or t
  misc_feature (714)..(714): n is a, c, g, or t
  misc_feature (720)..(720): n is a, c, g, or t
  misc_feature (728)..(728): n is a, c, g, or t
  misc_feature (740)..(742): n is a, c, g, or t
  misc_feature (744)..(746): n is a, c, g, or t
  misc_feature (753)..(753): n is a, c, g, or t
  misc_feature (783)..(783): n is a, c, g, or t
gcctggagtctgcgaaggccgggacccggtnccccggcccacagtgggggtgtgcaaacccgagagaactggattgcgtacccactgcagagtgctgaagacggggtagccacgaggttgcaaattcgtgaagaatcagcatcatgtttggcagctgagtattggagccaggagcctgccatgaggttttgagaacagagtgctgttttagagctggcagcagcatctcagcccaagagaaggttatattcccagaggatgtcagtcccaaggaccagtngccgccatcngtttggattccnaaaacccacnggcaccaacnccgggtgcngaaacacgcctnccctatgtaccngagnacatgcccnncngacccnanaganatatttggcnaccnttcccngaaaaggcccattgggtaccncccntcncnccccccccccccnttgggttttttttntnttttganacantctcgcngtattgcccangctggagtgtggtggcncaatcncngcccntcgcacccccaatcncccngccctangcaaccccccccccctgtngctgggacnacngcccacngcacncctgcctaaaatttttttttgttgagacggattcnctatgntgcccangctggtcncangctcctgggctcagatggtccncctnccncagctnccaaaggcacaggccaanttgtagcttngncccttnccatcatncccaacaagagnnncnnnacctttnaatgaattgactttcataaattggttatgntggtgggcaagttctttaagctggaaattgtaaatccctcctgaaatgttttttcatgcagttaccatgaactaatactccaataaaggatggttttgggtgtcaaaaaaaaa

SEQ ID NO: 496859 - DNA, 158 bp, Homo sapiens
aaaaacattacttaaccaggcatggtggtggcatgagcctatccagctacttgagaggctggggtgggaggattgattgagccaggaggcaaggctgcagtgagccatgattgtgctactgcactccagcctgacttacaagagtgagaccctgtctc

SEQ ID NO: 496860 - DNA, 204 bp, Homo sapiens
tctgcgctaacttgatgatgtatgtcgtcgtctaggaccctgtgttgaatttgtttatccggcaaaaattgtttaaacaatatgaaatctgggcaccttgaaaaaagaacaggataacagtaatgttcagggaacaagggagataaccattaggtctggctgcctgagagctgggtggaacagagccatatttctcatctttca

SEQ ID NO: 496861 - DNA, 1419 bp, Homo sapiens
  misc_feature (877)..(877): n is a, c, g, or t
gcagtgcctctgtggtccagcgccatggcgccctccaggaagttcttcgttggtggaaactggaagatgaacgggacggaagcatgagtctgggggatgtctcatcggcattcttgaagacgcgggaccaaaggttgcctggcctgatcaacacggcagtgtaggtgtgtagtggctgccgcccataactaggcgtatgattcagactgttcggccacgcgccaagaacgctaggatacccaatgagttagctggtgagtgctgtcgcatgaactttggtacataagagttgacctacatgggaggcttattcactggggagaggattcaagctcgcttgggctattggatccgaaatgatcttggcgtggaagctcaccatttgggagtgtcgtccttgggtggggcaacatactaaagtaagtcagcacaatggcagttgttactacctgggggcgggagaattcctgacttagaagcctggagtagcgagtcgagaacacaacgttggtgggcgccattgcttacgttgccgtctaaaagggggcacctccctgccgatgtctaaaaatcccgaccgttggcaactttgtggggactaacacgcgtttcaacaagttcgatcggaggcggcgaaagcggctttagggacattctcagcgttggccagaaacggggttacgagcttaaacacgaagcaaggacgcagcccacgggtggcatttccggcaggaaattacccatcggtttcgcattaggggactcgttggggattaccccaggcgggggatgcgtggattcccgtaggggaccgcattgacttttagatgagacgcccttgggatgtctttgggcgcacgcaagcatttgtggcgtnaacagttggtgggaaaaaacggcaaccatttggacgaagaaggaggaccccacaattaacacagggtgccaccccacaaggatgggaagaggtagacatacgtgcacttaacaaacggcgtttcgcgcgggtacagaggggaactttgtggtcctctatggtatagagatacccgaacagacggatccattctcgtagagagctaagccgagatgtggtggaggagcattcacagagaagtgacaaagccacacaggagtaaggttaaaacttattgaaatagggagaatgaaggagcatacagtgtggtggggaaaacattggagtgcaggtacacaagcaccaaatttggataagagtatggtgtaacagacattgtagggagaagcgaacgtcggtctactgtgggatatgtgaaaattgtattgaggaagtagtagtcgtgttgaagacatcgatgtttggaggggattgtgtgttggtgagatggttatagaccgtattcataagagatctcgcgtgaggatgatattaacgggtat

SEQ ID NO: 496862 - DNA, 292 bp, Homo sapiens
  misc_feature (239)..(239): n is a, c, g, or t
tatacaaagtaggtttcaaaataggcatacaaagatgttcagtgcagaattatggtaatattttttaaaacccaccagttaaacgtaagcaacctcaggagatgtgagaaggtctaattttctttcttttttttttttttttggcctgaacatggcctcattctttagaatttaaaaaagtcatacctggcaaggaatcccgggtgactcgggtaggtggccttacatactggtccttnaaatatacatgtatatttcttcttcttcacccagttttagaaaagaggggatg

SEQ ID NO: 496863 - DNA, 336 bp, Homo sapiens
catggtcctggccctgttgtgccgtctgctctcgtcttacccagccccatgctgtgagtacttgtcatcatggcactccagcagggttagagggacaggtcctactcatctgaaattcctcggatatgccatctctgtctccctgggtgccagcagccctgcctgacatgttcactggggtggccctggagagccatggcagtcgtgacatatagtatgtcgtatgcacatgatcctgtgtgtatgtgcgtgctgtgcgtgtgtgtgtgtgtgtgtgtgtctctggctcattcagtttctggggtcaaatcagctccttctctccaagtgcactac

SEQ ID NO: 496864 - DNA, 570 bp, Homo sapiens
  misc_feature (129)..(129): n is a, c, g, or t
  misc_feature (143)..(143): n is a, c, g, or t
  misc_feature (162)..(162): n is a, c, g, or t
  misc_feature (181)..(181): n is a, c, g, or t
  misc_feature (202)..(202): n is a, c, g, or t
  misc_feature (207)..(207): n is a, c, g, or t
  misc_feature (213)..(213): n is a, c, g, or t
  misc_feature (223)..(223): n is a, c, g, or t
  misc_feature (229)..(229): n is a, c, g, or t
  misc_feature (238)..(238): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (254)..(255): n is a, c, g, or t
  misc_feature (264)..(264): n is a, c, g, or t
  misc_feature (266)..(266): n is a, c, g, or t
  misc_feature (280)..(280): n is a, c, g, or t
  misc_feature (294)..(294): n is a, c, g, or t
  misc_feature (305)..(305): n is a, c, g, or t
  misc_feature (307)..(309): n is a, c, g, or t
  misc_feature (313)..(313): n is a, c, g, or t
  misc_feature (317)..(317): n is a, c, g, or t
  misc_feature (327)..(327): n is a, c, g, or t
ccccagaggaactggcagtggtgcgttgccaagtggtcagaagctggaggagttgaaggcagaggagccagataacttcagcagcaaagtagtgcagaggggccgagagttctttgacagcaacgggancttcctgtacagantttgagtcggggcttggcntatggagatgcctcgtganacacagctgggcaagtattantgtanatggancagcctgganttctgnatatggatnagccnccntgnaatannaagaggtgntnagcctggactgtgngaggaaagagctgngtggatagatncnnncttnctgnggtagtgctnccagtctgacctttgtagaccttcagactcactgtttttgcttaggctatctgtgtgttcaaacccatccagggtgcatgagtggtcacgattttgtgtgatacttgcaatttatgtttgagaataagtgtaaagtttgcgttgtgacctcatttctctctcgatcagtgttactctaacatttgggggacggtgtagtcaactggttttcctgccatcaaaatgtagtatcgtgtagcagtc

SEQ ID NO: 496865 - DNA, 260 bp, Homo sapiens
gccccaaaaaaaaaaaaaaaacctttttttttaaaactttttttttgttaaaacccgtattaaaaatctccctttatcataagtccctttttttttttacccccaattttgggaaagtaccccataaaaaagttcagtcatgccaggtttgtttggggtggaaaggaccacccaggtagttaaaaatttttttttaaaaataaaaagctttttaacccctgtaaaacaccctgtattttaaaaccctctgttaaaccgta

SEQ ID NO: 496866 - DNA, 417 bp, Homo sapiens
acaagaaacattactcgtagtcatcaccagtattagatggtcaccgcctgcccgttgagcatcctgtttcacacggccgcggtacctgaacctgtgcaaaggtacgctatactcacttgtgccctcttaaggtagtggacctgtatgcctggctcctcgagggttcagctgtctcttacttctacccagtgagaattgacctgcccgtgaagaggcgggcatgacacagcaagacgagaagaccctatggagctttaatttattaatgcaacctgtacctaagaaacccacaggtcctaaactaccaatcctgcattagaaatttcggtgggggcgacctcggagcagatgcctaaactccgagcgagtacatgctaagacttcaccagtcaaagcgaactattatactctattgat

SEQ ID NO: 496867 - DNA, 393 bp, Homo sapiens
tcgcaacggccatgcaagtacattgagcgagaatgaccagcgtcaagaatggagctgctgttgacggaggcgatgttggatgtctcggaatgctgaagtcccgttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctcc

SEQ ID NO: 496868 - DNA, 106 bp, Homo sapiens
cggtcatcacgctggacgcgtgggagcaagggcgaggtggtgagccacatcgcttcggacaaccgcgtgggcggtaaaatggccggcgacttcatcgccaagaaag

SEQ ID NO: 496869 - DNA, 100 bp, Homo sapiens
  misc_feature (49)..(49): n is a, c, g, or t
caatcgagctcggccgagatctccttcaggatcgactgttattaaacanagcatcgcgaagggccgcgcgagtgtttgacgcgatgtgatttctggccca

SEQ ID NO: 496870 - DNA, 278 bp, Homo sapiens
acattggtccaacaccactcccagctaaaaattatatttttttgaggcgatagcatctccctatgggggcgcaagctagaaaaaaactcctcgattcaagcgatcctctcaaagggtggggattacaggcataagccattgcgcccagcctgaggaaattttttcaacagtcacattttcaaaagtgaggagggaaattagtattcttgagctcatagatcagagattgtaaactgtctgcctttggaccacatttgggtgtaaaaatattttatttg

SEQ ID NO: 496871 - DNA, 315 bp, Homo sapiens
  misc_feature (39)..(39): n is a, c, g, or t
  misc_feature (60)..(60): n is a, c, g, or t
  misc_feature (113)..(113): n is a, c, g, or t
  misc_feature (273)..(273): n is a, c, g, or t
  misc_feature (308)..(308): n is a, c, g, or t
  misc_feature (310)..(310): n is a, c, g, or t
ttaaatctcaatattaagacaatgagggctgggcacccnatgcacgcctgtaatcccaanacttcgggaggccaaggggggtggattgcttgagctcaggagtttgagaccancctgggcaacatggtgaaacccccatctctacaaaaaaccacacaaaaaaatcagccgggtattgtggtgtgtgcctgtggtcccagctactcgggaggctgaggtgggaggatgcttgagcctaggaggtggaagttgcagtgagctgattgagccacntgactccggcctgggtgacagagccagaccctaantntaaaa

SEQ ID NO: 496872 - DNA, 659 bp, Homo sapiens
ggcggggcgcggtggctcacgcctgtaatcccagctctcagggaggctaagaggcggggaggatagcttgagccccaggaggttcgaggacctgccgtggcgcaactatagccgagaaccccgttttctcccagaaacacggaaaacaacaacaaaaacccaaacggcaccataacatacaaaacacagacaaccacacacaccaccacaccacacacaactctttgtttctcgcagcgcggccactcgcagaccccccctctgggcagaaaaaacgatgtctctctatcaaaagaacacaccacccatcaagcggcgataatgtgacggccgccacagcgagcgccccccacaacggaggcatcaacagacgattggaacacaccatcgcggcggcccccccaccagaccacccaccgccggtgtccccccacacaaaggaggagcacaccaacccccggggggcccacacaggagccccaccaccgccgccgcgcacaccccccggaagcaagccacacaccccacccaaaacaccccgcaaccaaaaactaacaaagaaacaaacagcgccccccccccgcgccgcgcgcaaaacccccgcgcagcgccgcgcctcccccccccccagcgcacaccccccacacacccaccccccc

SEQ ID NO: 496873 - DNA, 552 bp, Homo sapiens
gagaattctgcagtttcctccgataaaagaacatgcatattgaagtgaacacgttgtagaagtggagctttgcttctgagatgagccggatggtgactgtacatggacccgagtgtacgttatactgttaagagaactcggtgggatgactatgaaatgtatatgggagaagtgtacatatgtaatatatggttttattgttttatatgtgccaaagttcacttatcacgagatactgcctgaaaggaaatggaagagaggatgtttgtgggcattttgcagtgctacatgcaatgcccagaacaggcacctggtgctgcatccgcagctactcaaaacgataaagccggaggatagttcaacaacatagcaagtctctgtctcagtaaaacaaacaaaaataataccccaaacaacatgacaatctgtggttggagaaagtttttgaaaaagtgtatattcaagagtgttctctcaccccagtcctatcccgtgtgaaataagagccctcagatcccactggacagaaaaacttagatagtttttctaact

SEQ ID NO: 496874 - DNA, 305 bp, Homo sapiens
ggagatgtagccgtggcgcccaaacttgcgatctttagcccagaatggcaacaggccatattgtccggtgagcacttctaaatcggaggtctgatcgtcgcaatcctcctccgatcgcattcggatgaaaggcccctctttcagcggccataaatcgaggggcatctgtgtttcgggtgccaccccaaaacctgccagcaagcgatcgttttctggtgcctcgtaatgggagcacatggtggggcccttctgtgttgattacaggatagacagcattcgccaggtaattgtttgttgtaaaagtg

SEQ ID NO: 496875 - DNA, 355 bp, Homo sapiens
taaaaccccccattttcccccccccccgccctccaaactggggggtttgggaagccccgctttaatgtttggccccccccaaggggggtatggggccggcccctggggccccctttgaattttaccccttttggggtccccgaattgtttttagggggcccgcccccctgttttttcccctcccttggaagggggcccaggggccgccctttattggcccccccgcccggggtttttttttttttggagggccccctttttttggttttttggggttttttttaatcccaccgggttttgcgggttttatgcccctttttccttgaaataaaaaatggaattttttggtttccca

SEQ ID NO: 496876 - DNA, 567 bp, Homo sapiens
  misc_feature (123)..(123): n is a, c, g, or t
  misc_feature (287)..(289): n is a, c, g, or t
gcacctgcaggctcctcttctatttctcctccaggggcagagattttcgacatactcaggtaggtggtagccacgatgtcattgtgagtcaggcggtcccagtctatgatacgaatcctcatntttttcgcacatggagggaaacatggcaggcagtgtgatgttctggttccactgagggttggccgtcttctccaagatcttgctgcacagcattttccccgcaaagctgacctccacaaaggggtccaccaagttcttcttgttactctcgaagccaaagatcnnnttcacgttgtccatcacggcatcgtccatctgcggcaagtcctcggcccggaagaccttcaggcagaagtgggctcctcgcagggctacgcctgtgggccggagcaggttgctttcaatgtcctccttgtcttcagaggggtcttttctctccagacgcgcttcgtccccaggccccagcacactaaggcttgttttcaggtagcctctggccccagcaagagaaattcatcgggtctgagagcaggcaaccaacttcctgaaattggccgttccggg

SEQ ID NO: 496877 - DNA, 641 bp, Homo sapiens
gcaaagtttgccatgtggccgtccccagactcttctgctatacctttatgaaccttctcaacaatacattgcatacactcggtcttatgcaagaaacttgcatgtctgtctctctgttaaatccaggtgtaccgactttgtaatctgggagtcagtgttgatgacccagttcagatactctgtgtgcctacaatgatagcaagtccataataaggttctgcatgtgattattgttcatgattacagatcgagaaggctccaattcatttccattgcttggctcgcatacaaggctctacatatctggtgccagatcttcatatcatctatcactcccttcattttgaacttgaaggagccgatgacttacattctaaaactttttggatgttttcattcagcctgtatagcactgcacttcccatttatcccaactagcattcttttttctttaatttttgagacagagtctcactctgtcgcccaggctggagtgcagtgacgcaatcttggctcactgcaacctccgcctccccaggttcaagcgattcctctgccttagactcctgagtagctgggataataggcgtgagcaccactcccagcctttcatttcttgtcacttatttgcggatgtataa

SEQ ID NO: 496878 - DNA, 387 bp, Homo sapiens
attctcgatacctagctgcatggagagtatacctcgcagagaatactatcgatactatggggatagctatactccagtagatcaaaagaattggcggcagagcacacacatggaactgtcctggaaggacaaatcagggtagagatgcacagtcaggtgactggaggtttcttccgcaaagcatgaccaccaggaaatcagaatcagccagtccctcagaatcaggaacaagatcattgcatgagaggagaaataagacagtacccataagagaacagtccagtaccgaatctgaaccctgagttcgtttggtagtcaatcccttcagggctgtgcgtgtgtagtgtgtgtgtgtagtgcgtagtaggagtgcgtgcctagcatgtg

SEQ ID NO: 496879 - DNA, 242 bp, Homo sapiens
acagttgaacctactttttgacacttccatagtctacaagtattcatggaacaaaaaaaccctatatgctatactgtgcacctagaagcttttatataacaacgtcttttggtttgtatagtatgggattctttaaatatatattattctcatttagtgccctctttagccagaatctcattactgcttcatttttgtaataacatttaatttagatattttccatatattcgccacgtgga

SEQ ID NO: 496880 - DNA, 168 bp, Homo sapiens
ttataatgggtggtgctgaccttcttggccatcccggtacgatgggcaggatgcaggaaccagcccgcgggccagggcctggatcacctggggggtggcgtacttggggtctgaggcaaagctctgggtggtgggcatggtcttcccaggtgagcttgagagccgggg

SEQ ID NO: 496881 - DNA, 272 bp, Homo sapiens
gaggacccatgcagttgacgttggggggcgcgcccgtgggcgcgggccccgtgttggccgccagcttgttttgggcgtgcgccgtgggcctctacatggggcagttggagttggacgtggagttggtgcccgaggacgacgggacggcctccgcggaaggccttgatgaggggggtcggccgccacccgagtgagcgacacggccgtggggcttggcaggcgttggacagggcccgaggattgggacattaaacctgccctcccctcctcca

SEQ ID NO: 496882 - DNA, 98 bp, Homo sapiens
  misc_feature (49)..(49): n is a, c, g, or t
gccagcacactcccagattgtcatcgaggctctggctctcgttggatgnaagcggcgctgcgagccatccagcaccagtgggggctcgcaggtacagt

SEQ ID NO: 496883 - DNA, 149 bp, Homo sapiens
agtgtcatggtacgcctggctgctccaccctactcccatggtagaccaagaagccttcatacatctcaagtaggagggacaaaaaagggggaagggggggcacgacacgctcatcattcaaatatcaaacaataataaataaagtatta

SEQ ID NO: 496884 - DNA, 157 bp, Homo sapiens
gcttaggaataaatcttaactaccatcatggtaattctgagtcactgaagaggaaacacaagagaaaaggatcaacaccgcttatacttgtgatggtgaccactatacattcccaacgcaagagctaggccttgtggagcgacttccgatattttat

SEQ ID NO: 496885 - DNA, 1200 bp, Homo sapiens
  misc_feature (488)..(488): n is a, c, g, or t
gtctacaagcaaggctgctgcctcttatcacagaggctgcggctgaggctgtttccgatctcctgtctcaactctgcactggctagcatctgacgcttggtatagcatttcattactcttccgctatcaatacatctagaaaacactgacttactgcatagtgacaaaggacaggggttgcgccggggtcgaggatgactcccccggagggcggctcacacccttccaagtcgattaggccgcgcgtctcttcagtgtggctacccaagaggggtgtgttcacctgataatatgaggcgagatgtccgtacaatgtatatgaggtattacacgtactagctggggccggacccgggagtttcccacaagaacgccaacggaacacgtggcggagatacaatacacgcgctggacagtgtggagccactcatctgtgagcaacaggcaatctgtttcaactctacatcggtgggggtaagcgtgacaanttgaagatgtagcgaactacatagtgtaaccataagagcgatatacttacaaaagtgcacgcccttagcgcgttgataggctatcccacagattgtggtatggccaaccgtccgtggttgacttgtgttggttcacagacgtgaacgccttcgccttagatcgcgcacgagatgggcgctaagcccgagccggacgaagggactagaccggcaaggaattcagatgttattggaggaacactattctaataaaccccgaggaccataggttacgaaaaaaagcgtaatctcaatgggctttgttgcttaattcccgcctggtaccagccctcttgggccggtaaccaactttcgggcaatcagtggatggaactcacggtggactgagggtccaccccacaaactggtgtcccattcttaaacgaaggggggtaattgccctacccccccaatagccaattccttgcagtcctgtaacccttgggactatggccgatggaaccttggactttgactaacctccatgaaagacatctctcacaccgagcgccggccttaaccgctttcacccaccaacggcgaaccgggaaattgctggcagttgacattaacgagaaagctgtgctaggttgctccttggactccaagcaaaaatggcagcgtggttcagacctctggggaagaactcaaacctgcctaacggccggtcttc

SEQ ID NO: 496886 - DNA, 326 bp, Homo sapiens
  misc_feature (4)..(4): n is a, c, g, or t
  misc_feature (324)..(324): n is a, c, g, or t
aatnaaatatatgaggttgtcattaatgactagaatgtctttcacagtccctttttatttatttattcagagacagacatgaacacggctcattgcagccttgaccgcctgggcccaagcaatcttcctgcctcagccttccgtgtagctgggaccaaacgtgcaggccaccacgtccagctaattttttgactgtgtgtagacaggggttcactatgttgcccaggctggtcttgaactcctgggctcaaatgatcctcctgccttgacctcccaaagtgctgggatgacaggcgtaagccactgagcctggccacagtcctntt

SEQ ID NO: 496887 - DNA, 441 bp, Homo sapiens
ataaacgtacactaattatacaaatactatacaatcaaatcaagaaacattaagaaaatattaatagcaaaaatgtcaaaaaaagattggaactggtcgggtatagtggctcacacctgtaatcccagcactttgggaggccaaggcgggtggatcacctgaggtcaggagttcaagactagcctagccaacttggtgaaaccccatgtctaccacataatacaaaaattaccgcaggtatggtggtgtgtgcctgtaatcccagctactagggaggctgagccaagagaatcgctataagccaggaggcagaggctacagtgagttgagatggcgccagtgcactccagccttggatgacagagcgagactccatctcaaaataaatatctctctctctctctatctatctgtctatccatctggagggctttgaatgct

SEQ ID NO: 496888 - DNA, 282 bp, Homo sapiens
cccattgcccagcagaaccgggttttgcagttggccaaaaaattgggcagcctggtggagaacaacgaacgggtgttttaccccaaacagggcccctacgggggttacttccaagaccaaaaggacggctcccgcaaaaacgaggggtacatgccccccggtggctacccccaacaacagtttcaaacggcctattgagctttccactttgtttcccgcctgggccatccacccttgaagtcttaaaccccccctcagtcactaaaggtttgtttaaagtta

SEQ ID NO: 496889 - DNA, 421 bp, Homo sapiens
ggactcccggggctcttatctacagaacagctgacgagagagttacgatcacagttcaaggacacacactgtcagattcctcgccggtgactcagccgaactttcctgctttctcccaggacatgacagttcatacaatcagcctgagggaactccttacattctaaacaagaataacaccaaaaatgtctgaggattgtcaatataactgctaagtcctccgcgagtagaaagaccagaagattcaacagacaccgtgagagtgtggccggcagcgacccgggcacggtcctcaagcagggagtgtgcgggacccttatccctcttccctttgcctggctctcccactcacctctgaagcctcagttctggggcgacaactccaggaagccttacctactctcaccctagcgccccgatg

SEQ ID NO: 496890 - DNA, 519 bp, Homo sapiens
  misc_feature (99)..(99): n is a, c, g, or t
  misc_feature (259)..(259): n is a, c, g, or t
gagcagaaggtggagccagccctctttccacccgtacctctttttacagcagtgccctcccggtcattcttcccacgaggcttcctttgggatgaaggnctttcagccagcgtggatgggttcaacgcgcgtggcgatccctccctcacccgggaagcccttgtgcactggctggggctgctaaatgctgatggctggattgggagggagcagatactgggggatgaggcccgagcccgggtgcctccagaattcctangtacagacggaggcaagttccgacgcccaagcccccaagcctactttgcctgtagcccatatgctagaggttggtgaccctgtacgacgttgggctttttccgttcctagacaggcccttggccccggcctgcatgcctggttttcctggctccatcagagccagtgcaggcccactggccaactaattctttaacccggctgggccggggacggggaccctgccttaccaaccttactggaacccaaggacctaccctg

SEQ ID NO: 496891 - DNA, 514 bp, Homo sapiens
  misc_feature (17)..(17): n is a, c, g, or t
  misc_feature (106)..(106): n is a, c, g, or t
  misc_feature (110)..(110): n is a, c, g, or t
gcatacagtgttgagtnctggtgaacgagtatgatgatatggagagggtatcatcttatttcgtccttcacatctcactaacaagtttgaggacaagactgtggcntatncagagcatataatgaccacgtggtcaataattacatacagtttatccagcgacataacattttaggtatctgccctcacatgacagaagacaataaagatttgatacagggtcaaggacttacttattgcttactatgatgtggactatgaaaagaacgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggagttctcgcgtgatgggaaggctctggagaggttcctgcag

SEQ ID NO: 496892 - DNA, 661 bp, Homo sapiens
ggtacagcagttcgaggactgtcaccgtgctcaccatcgcccaccggtttcaacaccatcgatgtactacacaagggtgatcgtctgggatataggagaaatccaggagtacggagtctcatcggatctccggcagcagagaggtcttttctacagcatggtcgaagacgcaggcttggttgtgagcgccagagctggcatatctggtcagaactgctgggcctatatgccagagcacagggaggagtcagtacccctggtaaaccaagcctctcacacagaaaccaaaacataaaaaccaaaaccagagtacgaaaacatattcgaagcatcagccaccgtcatccggtccccttcctggaactggccgtgacatcacttgagagacagagatgcaaacctaccaaaacatgcacatcctgtgcctggtgcactgaaatagacacacagcctcacgcacccaggaatgcaagtggtttcctggcgcttcccacggaggagttttggcagccagacttctggaggaataggttgtatagaagatcctagtgaccaaattcagcctactgcctcggatctctccagccgaagtctgtggactgcaagtctttgagatgcttctggctcccatcacctctaacatccttgtctgggtctacaa

SEQ ID NO: 496893 - DNA, 380 bp, Homo sapiens
gagaacctcctgctgcatgtacagattgccacagaggggaccctagggctgagcaggagaggcttcatggagggggtgtgtgtgtgtgtgtttgtgcatctactatgtgtgtttgggtcaggttgggacactacacagaggtggatcacctgaggtcaggagttcgagaccggcacagccaacatggcgaaaccccatctactaaaaatacagaaattagccgggtgtgggtggcacacgcctgtaatctcagctattcaggaggctgaggcagaagaatcacttgaacctgggaggtggagattgcagtgagccaagattgcaccactgcactctagcctgggcaacagagtgagactccagagagtctccgtcgaact

SEQ ID NO: 496894 - DNA, 213 bp, Homo sapiens
  misc_feature (17)..(17): n is a, c, g, or t
  misc_feature (106)..(106): n is a, c, g, or t
  misc_feature (110)..(110): n is a, c, g, or t
gcatacagtgttgagtnctggtgaacgagtatgatgatatggagagggtatcatcttatttcgtccttcacatctcactaacaagtttgaggacaagactgtggcntatncagagcctgggagacagcaagaccattcccggagacactgcttggctcctctatgacacctatgggtttccagatggatctgactggactgacttgctgaaga

SEQ ID NO: 496895 - DNA, 1418 bp, Homo sapiens
  misc_feature (724)..(724): n is a, c, g, or t
agcggaggtctacccagtgaactgaccctgctctctcctttccctgttagacatgtgactgctgtgtactctcaatgaggaagatatagatgcgagaacagaacatagagccgcactctactactggcgtgacttctgcaatataccggagactctggattgagaggagcactccatcagacatgatgttcactttagtcacggtcagatgcaccggacacttcgctgacttggaagaaagcactgctgattatatcggcatcctagtgagctccatgacgagaagatgaattatgcagttaacttgtccttgtcttggatgctcattattgacgtagagtgagttggtcagtcctaatctggaggttcttgaacagatcatctggcaatctcacttgggtgaacaaactttcaatcggacattgtgacattacgacggtaagaagactccttggccaattgtactctaaagctccttggccaattgaatgcactttgttgggtaggcaagttaaccgttgctgagataattacgagtaccacttggaatcgcgtcccatgcgtattttactaccacttcgtctcatcttgactggtgcccaagcactttctttcaacggcattgctaattggaaccatggtaattgaagtcgctttatttcgacccgtaaagcatcaaacggtttggtcgcgaaatactggtcagagccgtgctctttactangatagaggaacaacgactgggcttcccttatttgcattggcaccgactacttctggcgaagaaggcgcaaactttgaccaccacaggaagttccgttccgtggcaggtgccgcccaggtggcgacaactgtcttgagccctttgggtagcggggaaaggcgtttgtagatggcttattccagaccttgtttgggaagtaaagggccaaatgcccgacaaatttcgtgggtcctctcaatccctggttaatttgaagacctcctggagccggggcgtccaatttttggcggttagccagaacccaaccggtatcgtcagatcccctcattggcctggggttgcgccagaaatacgtcatggaggccgacagcgaggggaacttttgcctgggccctaattgaccccatgtcgcacggttgggacattcccagggtacacacttttccctgaaatcttaacttcagaggctcgcgttggacttgtatggttggaagcgtacaccaatttgaaccccctcaaaggcggcagggggctgccacagtggggaagagggcccggagagacaaagttttgccgcacgaatggtgcttgggcgtaacccagaatggtgtggggcacctcaggactttcccctagacaaactaaatttgcgcaggaactcacagctggagagcttggcactacagacgacacc

SEQ ID NO: 496896 - DNA, 310 bp, Homo sapiens
cgtgaagcacttactagatttagctaaacatccatgtcatgcctcgctgcaatgtgacgtgtgttacacggcggcgcaatacttgagcatttagctacttctgtaatgctgtacagaactcaccaatttgtgcacaggtgtggcgagaacaccgtgcatgatgaaatcttcatcactgtgtcataaagcatgctggtgtatactgttactgtccgcctctttacacatgcaatatgtgacttctgtgaagcttgggtttgccatggtaggaaatgtctcagtacacatgcttgtgcctgcgaacctatga

SEQ ID NO: 496897 - DNA, 1025 bp, Homo sapiens
agtttaaacagatttctcaagcttacgaagttctctctgatgcaaagaaaagggaattatatgacaaaggaggagaacaggcaattaaagagggtggagcaggtggcggtttaggctcccccgatgggacatctcttgcatatgttttttggcaggcaggaggaaggatgcgagcagcagcacaaggcagcaggtcaacacaatgttgtacatccagctctcagtaacccctagaagacttatataatggtgcaaccaagcacacaactggctctgcaacaagcaatgtgatttgtgacaaatgtgacaggtcagcaggaggtaagaacaggagcagtagagtgctgtcccaattgccgaggtactggaatgcaaataagaattcatcagataggacctggaatggttcagcaaattcagtctgtgtgcatggagtgccagggccatggaggagcggatcagtcctacaagatagatgtaaaagctgcaacggaaggaagatagttcgagagcacagcaaaattttagaagttcatattgacaaaggcatgaaagctggccagaagataacattccatggttgaaggagaccaagaaccaggactggagccaggcgatcttatcattgtgtaagatcagaaggaccatgctggtgtataactcgacgaggagacgaccttaacaatgtgtatggacattacaagctagtcgcaagcacctgtgtggactaccagaagccaatattctactctagacaaactgaaccatcgtcatcactctcattcaggtcagatgccagactggaacatcaagggaccaaatgagcatcaataacgaaacaataaacggactacacaaaaaggcaatacaaaaggaccgaccggaaacgactgcacaacccacccgtgaaaacgaaaacaaagcacaaagaggacagaacagcaagaacacagaacaaagacgaaagaagaacaagagagaagagacagaagaaaaaaaaacaacaaaaaacacgaacaactata

SEQ ID NO: 496898 - DNA, 926 bp, Homo sapiens
taaaaccccggtgcctggggggggggggggtttaaacccaagtggaaatgatttccttacgggggaaaggcccttgggaaaaaaggcctaatttctctggttcctttccgacagggaagaaattggaattaaataaaacccgccgcgggatctatacccccggggtgcggaacctcacaactcacggcaggacttcaaaatcgcgtgtgcaccaaacaccaacaccccttaaaataggggggcgaccccagtggggaagtgtccgtgaatccaaacactgcgaggggcgataaccccccaagtgggtgcgcctagggccctcccaaaaactagagaccgcgggccgtgattactccccagaggggaacccgtggttccgcgcgcggcctccacgtacagtggagcacccaagtggagcataatagaacagctcgcgacttgaacgggggggacagtcctaccagcaccaatggtcccgtggcccggccaggggtggggcctatcgtggcccgaaagggtcgcccacaagcgcgtaactttcatcaccgcgccggctggcggccaacatacaggcaaccgggggagactttaggaccaacggacacgcgaggggcagctaacactcatcaataacaaggcgtccaaaaggagcaccaacagtcgacatggagaaggagacacacagcccagcccactcttccacggggcaacgtcacaactttcacgggggtccaaacggtaccacagaaccgggtcagaaccccccccggggaaccaccaaccacaacggggcccttacttacagggaccacagggactatatgacacccttgggcagagatacgcacaccgggggcgttaaacattgttgtctgtggacacgcgacgcgcccacaccagggagacgacagggacagatcgggcaa

SEQ ID NO: 496899 - DNA, 720 bp, Homo sapiens
  misc_feature (148)..(148): n is a, c, g, or t
  misc_feature (227)..(227): n is a, c, g, or t
  misc_feature (285)..(285): n is a, c, g, or t
  misc_feature (304)..(304): n is a, c, g, or t
  misc_feature (344)..(344): n is a, c, g, or t
  misc_feature (373)..(373): n is a, c, g, or t
  misc_feature (402)..(405): n is a, c, g, or t
  misc_feature (411)..(411): n is a, c, g, or t
  misc_feature (413)..(414): n is a, c, g, or t
  misc_feature (416)..(416): n is a, c, g, or t
  misc_feature (460)..(460): n is a, c, g, or t
  misc_feature (470)..(470): n is a, c, g, or t
  misc_feature (492)..(492): n is a, c, g, or t
  misc_feature (509)..(509): n is a, c, g, or t
  misc_feature (516)..(516): n is a, c, g, or t
  misc_feature (522)..(524): n is a, c, g, or t
  misc_feature (560)..(560): n is a, c, g, or t
  misc_feature (588)..(588): n is a, c, g, or t
  misc_feature (606)..(607): n is a, c, g, or t
ggtccggcggcgctgcagtgtgtcagccggtcacggggcggctatggcggccacgtcttcggagaggtggtgaaggcgccgtgccgagctgggactgaggacgaagaggaggaggaggaggggcggagggagacgcccgaggacaggnaggtgcgtctgcagctggcgcggaagagggaagtgcggctccttcgaagacaaacaaaaacatctttggaagtttcttngctagaaaaatatccggtgctccaagtttataattgctataggaaataatgcagtagnatttctgtcatcatttgtnatgaattcaggagtctgggaggaagttggttgtgctaaantctggaatgaatggtgtagaacaacaganactacacatctgtcctccacagaggcttnnnngtgtgntnntnatcatctaaaatccaatccctcggtttttctctgtcagtgcagnttgctatgtngcagaagatcaacagtatcagntggctggaaaaggtttnggctctntgtccnnngaagaacatgcagataactattctcacatgtcgacntgttaccgattataaacctcagaatcancggagcttccttctcctnncctgagagcctaaaacagcagaatttcaaagacctcggcgtgtgtccattgctagaacaaccgaatatagtacagcgacttcctgcagcaagttctaggctactgtccagttt

SEQ ID NO: 496900 - DNA, 132 bp, Homo sapiens
ctctgacagcatcctcttatcctgcactgcaggctccctcggtgtgtctgagacagctgcagccctcaggaggagacagagtgcctgggcatccacctcctcccagggacgtgcgctgtcggctagtcgggg

SEQ ID NO: 496901 - DNA, 119 bp, Homo sapiens
tggtggtgccggaggacatcgaactcattggtcagaccgtgcgcatctcccagtggccctacaagaggctacatcggtgtggtgaaagatgccacatgagtccactggccctgtgtgga

SEQ ID NO: 496902 - DNA, 405 bp, Homo sapiens
tcggtccgcgggggacgaaaggaaaataaatattgggacccagaatcactaagctaaaaggaaaagtcgagctgggaactgcttaagggaaacctgcctcccagtctattcaaagtctcatccctctgctcactgagataaatgcgtatctgattggctcctttggaaaagctaatcagaaactcaaaacaatgcaacagtttgtctctcgcctatctgtgacctggaagccccctcccaacttcgagtggtcctgcctttccagactgaaccagtgttcgtcttacatatattgattggtgtctcatgtctccctaaaatgtataaaatcaagctgtgccctgaccaccttgggcacatgtcgtcacgactttctgggactgtgtcatggtgcacatccttgac

SEQ ID NO: 496903 - DNA, 179 bp, Homo sapiens
ttgacgcacacaaaagggatcgctgcagactcagggcaaagggaatgccatcggtgctgggaactgtgagcactacaggaggaaacgcgagacgtggtgagactggactccaggaacacagtgcgaagggcaacgagggttggacacgacacccacaacagctcacttgggttccatcc

SEQ ID NO: 496904 - DNA, 206 bp, Homo sapiens
tgggggacagtagactcgatccatagtcgtccacgttatcatgttcatccgcaccatgttgcagcaacaaggatgcatgttattcatgactcatgttcagggctgtgtacgatgtttcctggccgccagaagatccacatctcaaagaagtgtggcttcactcgaagtctcagtgctcattaatatgaagacgtcctgctctgagt

SEQ ID NO: 496905 - DNA, 360 bp, Homo sapiens
  misc_feature (213)..(213): n is a, c, g, or t
ctatacaggtacaccgctttccctttggttacatctagtttctctcagctttgccttcttgctttttcatatctctaaagaaaaaaattacattatcagttgtcctgttaatagaaaatatgggataatatagaagaaattgtgttataaatagaagtgtttcatcctattcaaaaccatttcagtagatatttataccaatactgtatatangtataatattacatatcaagtttaaattagtgcaatttttatacccctagttggctaggttttactgtaccttgtagatagtattgctcgagaatggataggtgcggtaggaaacctacttactaggggatacctctaagagttcga

SEQ ID NO: 496906 - DNA, 992 bp, Homo sapiens
  misc_feature (327)..(327): n is a, c, g, or t
  misc_feature (459)..(459): n is a, c, g, or t
  misc_feature (496)..(496): n is a, c, g, or t
  misc_feature (508)..(508): n is a, c, g, or t
  misc_feature (547)..(547): n is a, c, g, or t
  misc_feature (593)..(593): n is a, c, g, or t
  misc_feature (629)..(629): n is a, c, g, or t
ggtacatggggatcaggtgttcatcactgattggaaatctttctgaaaaggatatgaccctgctccaggagaggattacatgcggtcagctatagagaccctcttgtctgcaccaagtgaaacacagagtgtgatagcagtaaacctcgatgtcgatgcgacaacgaacagtagacgcttccgaattgccgatctactgtttaccgcataggcgtacctacgcttgatcgcacgatgtctttcctaaatgtcataccgatgcccggaagtcgatgaagctgggcgatccgtggaggcgagtcccgaggatgcgtccagtcctggagnacattcccagcatgcgatcttagagtgagcattcgatggatattgaccacataggttacgtagtcctgatcgtaggatacatgcacagtagaacttgtatcaggcaaactaaacataggaattgaacgagtntattgtccgaggcccaaagtcactatacattgcactngataagcgccanagagattccatgcgagcgtgttgtcattctcagcgatcngttacgagatgaccatttgccagctatgttgagaaatacgagggcnagtcgcacgagactcaaattcttgcagtttagttcntccgctaaaggtagagccaggtaggtatgaccaatcttaacatcaatggtcatccacatgcattcttgacaacagaactccgtagtagagtgtcgcttgaagcacgagtggaagacgaagagcgttgatagccgatcgtccggagcctatacttgattcaagtttccttgataagcgcacgttttagtgccagcgtaacgaccgtcatctacgagacacgacaccatggccagcactgatgaacattggcagaaaggaaccgagatcagtccaagttgatatcagcttgtacttcattgcgcaagcatcgatttgcgctgctttcaagactagagaaagccttggccccggagagagccttcc

SEQ ID NO: 496907 - DNA, 115 bp, Homo sapiens
gtctctagagtgatccccgcggcttattaaagaaggaattttcaaatgcttcaatgtagtgcttggttcattaggatactgagttgaatctggtatcttgaacaaagcgttactt

SEQ ID NO: 496908 - DNA, 324 bp, Homo sapiens
gggtcggtggccatggctgtgcttggccgcctctgtggggctctatcctaattcagtgaggtctctcgccaccttcctccagggtcttcctgagacagagaccgagacttcagcttcaaaaagaaaccctggccgggcgtggtggttcatgcctgtaatcccagcactttgggaggcaaaggcgggcggatcacctgaggtcaggtatttgagaccagcctggccaacgtgttcaaaccctgtctccactaaaaatacaaacatggcccggcatggtggctcacgcctgtaatcccactacttgggaggctgaggcaaaagaat

SEQ ID NO: 496909 - DNA, 152 bp, Homo sapiens
aatgggaacagaaatagtatatacagaataacgactatgtacacacagcagtaaatctatgcacagaaatgtctagggagaacatataacaccaaaagattaacagtggtagcatatagggtggcacaacttgattcttactaaaatttctg

SEQ ID NO: 496910 - DNA, 838 bp, Homo sapiens
ttaaagttcatatatgcattccaagcgtgactaaaaatcactaatgccatctatactttagtatgaaacagcagactatagaaagcacagggaataataggctaaatacattcttttgaagaaccagaggcatataacacatcattatgtcattcctaatacatggctagattttctaatgataaaattgactgtgtgccaatgcttatattgattctaggctttttatctgttactgagatatttaatagctttgaaaatatgctgaccagtttttggaaccataatggtttttatagcaagcaaagactttatggaacattcttcacaaatagcactcatacatacttacattttgacaagaaaatgtgaattctcacattgatgagatatttacattcccacctgccctaccctttaagaaaaggtcacttgtctaagtgtgtagtagatcatttacgccttcccttgagtcatacatgttggagcaactgtgtgactcgtcaggtagacgaaaattaatagggaagccagacgcttgaacttagagtttaaattatgaaggcagatgagaactttatactagggttggtgtggggaatctatttgtaataggatatgattacccaaataatcaagaatttaaatcatcatatatgtctattaacaagtcaaattgtagaaaggagcagaagtttattatataatgatgtacctatatggtataggggggaaaaagcgcatttacccggatagtgttcaaaaaaaacaagggggaaggtaaaaaaaaatggcaagaaagtacgtaagcacaggcaaaggaggcaagagtaaacac

SEQ ID NO: 496911 - DNA, 414 bp, Homo sapiens
  misc_feature (181)..(181): n is a, c, g, or t
aactcgagctcggtaccgattacgctcctagacgggcggcagagacgacccgtgatcggcagcctctgggaggcggaagtctctccaatgctcccatctggctgagaatttttgcttgaaccgcattccactttgtgtcttcaacacccagtatagcatcggctgtctagtggatcctcgnatatttaagtgaatggaaaaaataccacatgtcaaatgcaaaaacattacaaaaatacactcaaagataaatgtacactgggaattcagttggaagaatccactcacatcccgagactgggtgaagcagctcagtttaattttgttttttttgctgagacaagagtcccgctctatcacccaggctggggtgcagtggtgcgatcacagctcaccacagcctcgaactcctgc

SEQ ID NO: 496912 - DNA, 448 bp, Homo sapiens
  misc_feature (19)..(19): n is a, c, g, or t
  misc_feature (28)..(28): n is a, c, g, or t
  misc_feature (60)..(60): n is a, c, g, or t
  misc_feature (83)..(83): n is a, c, g, or t
  misc_feature (113)..(113): n is a, c, g, or t
  misc_feature (131)..(131): n is a, c, g, or t
  misc_feature (251)..(251): n is a, c, g, or t
  misc_feature (277)..(277): n is a, c, g, or t
  misc_feature (283)..(283): n is a, c, g, or t
gttaattaataaagccccncatgctganaaatgagtttccctcaagtgggcccagttttnagggagactggcacatgcctgtnatccctgcttctacacgagatttcttagancagtcgcagtctgccttntagattccatcctgttttgttctaactcttgggttcaattttagaaaaatcaggctgtaatcccagcacttcgggaggccgaggcaggtggatcacaagttcaggagattgagaccatcntggttaacacggtgaaaccccgtctntactanaaatacaaaaaaacaattagccaggtgtggtggcggtcacctgtagtcccagctactcgggaggctgaggcaggagaatggcgtgagcccgggaggcggagcttgcagtgagccgagatcatgccactgcactccagcctgggcaacagagcgagactccgtctc

SEQ ID NO: 496913 - DNA, 128 bp, Homo sapiens
ctgtgctatgaaatcatacgagtatatagtacgtaaatctactattacacagtacaccaggacggccagtgctatcgtgttagtgcagtctctttctgtgcaggtcgtccttccggaccagcaccacc

SEQ ID NO: 496914 - DNA, 310 bp, Homo sapiens
  misc_feature (4)..(4): n is a, c, g, or t
  misc_feature (6)..(6): n is a, c, g, or t
  misc_feature (276)..(276): n is a, c, g, or t
  misc_feature (300)..(300): n is a, c, g, or t
taantnaatggatgtgcaacaatgccctcttgggtttagtgttgttcctcacgaatccagccgaatctgcggtatacaattttaggtgcctcatcgaccattccgtggtattcgtcttttagccttagcactccagttatactttctcttgcgctggcaggtagccacattgccacagtcgacttctgaagtggtaggcttagagcacagggcggcacaacgtgtgcgtcttatgcgacgcttccaacgatgagtccctctgtcgtcttctcgcancgtatcgacgcggcggaattctgnccggggatcc

SEQ ID NO: 496915 - DNA, 153 bp, Homo sapiens
aatcacacaggtgtatattgtaatggtttaaggtgctataactgggctgggtgcagtggctcacacctgtaaccccagcactttgggaggttgaggcaggaggattgcttgaagtcaggagtttgaaaccagcctgggcaacaaagtgagacc

SEQ ID NO: 496916 - DNA, 110 bp, Homo sapiens
  misc_feature (37)..(37): n is a, c, g, or t
  misc_feature (76)..(76): n is a, c, g, or t
gccagctgcacagcattaaagaacctgcagaaaactnagaatgtctttaagctaatttgtttttgctaaaaagacngggacagaatctcacttctcctgtcccaggacct

SEQ ID NO: 496917 - DNA, 197 bp, Homo sapiens
aatcagctcggtaccgttctccgtgagactgacgagaggagggcgggaggtcggattcctgggtctagaggaggaagtgtgaaagtgtcgaccgactacccagaggcttcatatgctcctacagtgttacggctttggggccaaaaaaaatttctcagcgcccttagcgctttccatgagtctcacggagtctcacg

SEQ ID NO: 496918 - DNA, 2415 bp, Homo sapiens
  misc_feature (1883)..(1883): n is a, c, g, or t
aaaggaaatgattttttcatcgatgactctaaactagccagtgcagatgatattggtactttgatctgtaagaacaaaaaaccgctcatacaggaggaaagtgacaccattgtttcttcttccaagagtgctttacattcatcagtgcctaaaagtaccaatgacagagatgccacacctctgtcaagagcaatggactttgaaggaaaactgggatgtgactctgaatctaatagcactttggaaaatagttctgataccgtgtctattcaggatagcagtgaagaagatatgattgttcagaatagcaatgaaagcatttctgaacagttcagaactcgagaacaagatgttgaagtcttggagccgttaaagtgtgagttggtttctggtgagtccactggaaactgtgaggacaggctgccggtcaaggggactgaagcaaatggtaaaaaaccaagtcagcagaagaaattagaggagagaccagttaataaatgtagtgatcaaataaagctaaaaaataccactgacaaaaagaataatgaaaatcgagagtctgaaaagaaaggacagagaacaagtacatttcaaataaatggaaaagataataaacccaaaatatatttgaaaggtgaatgcttgaaagaaatttctgagagtagagtagtaagtggtaatgttgaaccaaaggttaataatataaataaaataatccctgagaatgatattaaatcattgactgttaaagaatctgctataaggccattcattaatggtgatgtcatcatggaagattttaatgaaagaaacagctccgaaacaaaatcgcatttgctgagttcttcagatgctgaaggtaactaccgagatagccttgagaccctgccatcaaccaaagagtctgacagtacacagacgaccacaccctcagcatcttgtccagaaagcaattcagttaatcaggtagaagatatggaaatagaaacctcagaagttaagaaagttacttcatcacctattacttctgaagaggaatctaatctcagtaatgactttattgatgaaaatggtctgcccatcaacaaaaatgaaaatgtcaatggagaatctaaaagaaaaaccgtcatcacagaagtcaccacgatgacctccacagtggccacagaatcaaaaactgtgatcaaggtagaaaaaggcgataagcaaactgtggtttcttccacagaaaattgtgcaaaatccactgtcacaaccaccactacaacagtgaccaagctttccacaccctccacaggcggcagtgtggacatcatctctgtaaaggagcagagcaaaaccgtggtcaccacgacagtgacagactccctgaccattccacgggaggcacactggttacatctatgactgtgagcaaagagtattccacacgagacaaagtgaaactgatgaaattttcaagaccaaagaagactcgttcaggtacagctctgcccatcctatagaaaatttgttaccaagagcagcaagaagagcatttttgttttgcctaatgatgacttaaaaaagttggcccgaaaaggaggaatccgagaggtcccttattttaattacaatgcaaaacctgctttggatatatggccatatccttctcctagaccgacctttggcatcacttggaggtatagacttcagacagtaaagtccttagctggagtgagcctgatgttacggttactgtgggcaagtttgagatgggatgatatggcggccaaggctcctccaggaggagggactacacggacaggtaagcggggaagggagttatttgtctaatttaagtttaaaagctaaaatcacatggccacggcgtgggcgctcangcctgtaatcccagcactttgggaggctgaggcaggtcgaatcatgaggtccggagatcctgaccatcctggctaacgcatggtgtaaaccccgtactctactaaaaatactaaaagattgcctgggcgttggtggagagagtcctgtagttcccagactaattcagtgaggctgaatgccggagaatagcttgaggctgggaagtgggacggttgcaagggagctgagatcaacaaccaatggcacgaccagtcatgggtaacacattggagaatccggcgtcaaaacaaaagaaaaaagaaaaacgacaaaaacatatagacaacacaacagaacaagcacaaaacgaaaacccagaacaagacaaagagaacaggagaagaacaaagttaaatgagacagaaacagacacgacagcaagacacaacaaagcaccaacaaaacgagcaagaggaagcaagagaacaacgaaagacaaaacacgaccaagcaccacacaaagacacaagaagaaaaacagagagcagagca

SEQ ID NO: 496919 - DNA, 1137 bp, Homo sapiens
ggcttggggaacgagggagcagtgacgcggtctcggtgtgggcccgggccgaactggctgcggacacctggtgcgccgatgagccgagcagccgccgatctcctgagcatggatcagtgcgtgacggtggagcgctgagctggagaaggtgctgcacaatgttctcaggcatacgggcagctgtgcagagcgcggcctggaggagctcatcgactacaccggcggactcaagcactgagatcctgcagagccacggccaagatgctgaattatcagggacactttacacttgtaatgacacagtgctgtaaaacgaataaaaggatactgtacaaaaattggcctccgaccacaaagacatccacagacagtgtaatctcaaggtatggaaaagccattgataagaatgtagattctgacattagcagtgtgggaatagatggcatgctggcaggcagacagccaaatggcttctcaatgaaagtgagaggatggagcacttctttcagaccaggaatagctaggatgtggcatgacggagcatctgatcaggaactctggatctatactgtaagagcccaagatcagaaggacaccataatgatggagctcacaactagaatattagacggcatacaaagtgtccagagtcacgagagaccatgactactgagagaagaccggccagcaggtcaaaacaccacgcggaaacatcggatctaatagcacctccaagcaaacgcagagcacccctacggaaacacaccaggacaaccacccgaacgtgagaacaagaacgacggcatagcgaacaaaacgcacgtcgaggacggcagcaaccaccaccaggcagcaaacggccacactgcacaaaaaacagatgagacaagagaaagatgaaagaagagacgaacagaggaccaagaacaataccatactaacaagacacgcacactacaaacgaggagttggcgacagcgcagcaaccacacgaggaaagtacccgtgcgagaaacaaacggagacaattcgcccacacagcatcaacgccaccaaatgggctacaaccagacacacataggcacagaccaccacccccaggaggcgcgaaaccaaataccacggcaggaccacaca

SEQ ID NO: 496920 - DNA, 252 bp, Homo sapiens
atagaatcttacatccaacattaaagtccgcccacagaacccatctaaatccccttgataaaatctaactgttagtccaaagaggaacagctctttggacactaggaacaataccttgtagagatgagtaaaataatttaccacccatagtcggcctaaaagcagccaccaattaagacagcgtacaagctcaacacccactacctaaaacctcccaaacatataactgaactccctaagaccctaggggca

SEQ ID NO: 496921 - DNA, 482 bp, Homo sapiens
gagagagcatcggccggcgacgttccggcggccatgtgcgaaaatcttccccaagggtactgcgtccacgtgccggtggcgtggggactccctgaaggcagagcggcagggcgcccgaaagtcgtgagtcgagtcttcccgggctaatccatgccgggtgaggagcgctgcttgaccggcaggttcgggcgccacagggtgcctgggtcgactcgggaacggcctggggtgctgcccttgggccgggacacagaacacccatctggctttaggtacagagcgtcttcatggaaagagtggtacatggtggcgatgacgcatctttctgacagcaaacgtgtcccaatcattaaaggccagtgggtctcctgatgaccgataaaggccaatttagcaggtacactgtgtccctctggaagatggacccagggctaatacatcctggggaaaccaggttcctttaagagtcggctaatggcttg

SEQ ID NO: 496922 - DNA, 160 bp, Homo sapiens
aggtactctgaggatccctgaatcgacggtttctctgctgactgagaccaggtttcggcctctcggactcctgctcagtccctatgacgggcgcacgtgggcaggtgctggaggtggtgcgctcgccgtcgccgccgctgccgctgatgctgcagcaatt

SEQ ID NO: 496923 - DNA, 564 bp, Homo sapiens
  misc_feature (439)..(439): n is a, c, g, or t
ttttttaagatggagtctcactctattgaccaggctggagtgcagtggcatgatctcgggttactggaacctttgccttccgggttcaagcgattcccctgccttagccttcagagtagctgggactatgagtgcccaccaccacgcctggctaatttttgtatttttagtagagatgaggtttcaccatgttggccaggctggtctcgaacacctgacctcaagtgatccgcctgcctcggcctcccaaagtgctgggattacaggcatgagccaccgcaactggctggctgctactttaacgggcagcgtatcagaagccaggtgctaaagaaaaagtcctgaattgaaattaaagtatctttctggctgacaagcagtagggtctaacaatgactgactcaccagtctggctaggttcttactctttgctctaagntcttgctatacaccttgctagattcttaaccaaattaatattggccccaaataatgggaactgaggtgcaccttataaaagataaaagaaggtcacgcagagacagagagtctcaaatgacaggg

SEQ ID NO: 496924 - DNA, 1336 bp, Homo sapiens
tccttagtaccggcatggaatgtatgggatctctctaaaagagacagcaaatgcttcttagatggatcgaaagacccacgagctgtgataccaatgttctatgaaaatgtggtatgtgtgcaacagagagaaataattgcgaaggactccagtggctgtctatattggggcatatgatgcgcttataatcgaggaacacgtgagactggcggaggagacgaacagcagggagggaatggcgttcttgcggaaggtaccatggagaagacagagcagtgaatggcaatgaagttgagtccatagtagagtggaagaagcaatgaacgaaaatgtagggaggaagactgggcaatatattaatggattgcatcgattatggctgtggggggatgagttaggaaaaaagatagggggatcgaactgatgaaaagggcatcaggggccatacgggtatatgtgggctgggggcaatgaagatatgtcatgtgataggggaagggagactggtgatggtggctggcaagttgggagacataggaggctaagtgtcgcaacttgatgcttatcggtgatagacgaaagagaatagagtggcaaagcaggccaaggaacgggaagggaaaggacgagagaaaaccccgaaggggcacggagactaaaatacaggaattccgaccaaacgagacctcgaagaaaaccgaggatagtaacaaaagacagaccaatcgaatccggggaacggaaaagctagaggacccacctaaggggagactaaggccctcgaaaccagcacatagacacacagtgagagaccattaacttggaagcgagtataaataagggtccggatccgaagaataaaatcctatgatggacactgacggcggagaaacgctgggaaatgacgctaccgcccttatatgcagaaccctctagaaattaatatcgatacaatcttaaatgaaactcaaaatctaaataaaaaagagagtgcggaaaccattaaggaggagatgcgaaggcaagagggcgacgggtagggagcgacgaaatgcgtagggaaaatgagcagcaaggggggagacatagaaatacgcaaagcccgagaaacaaagtaggacccacacacgaaagacgcaagggcggagtgaggtggacacctggaacggggggagttaggcggccgaggtaacgaaagcgcagagaggcggggggagtcgtgtgacgagtgctgcagcgagttagagatacaatgaggcgcgaagggggaacgcgagcggtgtggaggtgtgctggcggtacgcggtgtggtgtcgcaagagccgctgagaaagtc

SEQ ID NO: 496925 - DNA, 378 bp, Homo sapiens
gctgcgcaagagcaccgtgctagttgttcacatcaccttttacgcctggcccgctacccacatcctgccacacacaccgatgggaccgcctgcccatgatgatagaccagatcaagtctgctgctctgaggtaccgacagaggatgcgcacactatgtgaggccctggaggacgagtgcctaagactggaagcacgaatactgagctctatgaactgtcagaatccggagaacgcgagatccctgcttcaaggacctgctcatggacgctcacatggcccctagccagatgacctgtaactgctaaccaggcactggtgtggcttcggatggcaggctttcaggtctctagcgataatccgcgtggctttctttattc

SEQ ID NO: 496926 - DNA, 329 bp, Homo sapiens
  misc_feature (85)..(85): n is a, c, g, or t
  misc_feature (141)..(141): n is a, c, g, or t
cggggtggccccccttccctgggaaaatttttaaaaagggcaacgttggggggaggaaggaactggtttttcaatggccagtggntgtgggttatttcaggcctcaagctccggggaaagggcatttgaaagcccatccanaaggggcctagggggaaattaacccaaaaccttgaaatcagtggggtccaactgattttgttcccccggttccccttggccgccagttccgttttcctcccgggccgaaaggaacaagggggtcagctttgggggggccctccccagcccatttttgttgttaaacaaacaaaaccttgcaaagggga

SEQ ID NO: 496927 - DNA, 171 bp, Homo sapiens
agggcttcgtgccaatggttcagggtgcggtggccggtctcttgtaggtcttctctcctgccccaatccagcacttcccatcacaatgcactcactttgcaatcactcttggcacccagcatttccacagctcccaccatccagtaccttcctcaatcatgcactcatacc

SEQ ID NO: 496928 - DNA, 906 bp, Homo sapiens
  misc_feature (2)..(2): n is a, c, g, or t
  misc_feature (152)..(152): n is a, c, g, or t
  misc_feature (157)..(157): n is a, c, g, or t
  misc_feature (166)..(166): n is a, c, g, or t
  misc_feature (183)..(183): n is a, c, g, or t
  misc_feature (186)..(186): n is a, c, g, or t
  misc_feature (198)..(198): n is a, c, g, or t
  misc_feature (207)..(207): n is a, c, g, or t
  misc_feature (220)..(220): n is a, c, g, or t
  misc_feature (223)..(223): n is a, c, g, or t
  misc_feature (245)..(245): n is a, c, g, or t
  misc_feature (259)..(260): n is a, c, g, or t
  misc_feature (262)..(264): n is a, c, g, or t
  misc_feature (301)..(301): n is a, c, g, or t
  misc_feature (303)..(304): n is a, c, g, or t
  misc_feature (308)..(308): n is a, c, g, or t
  misc_feature (358)..(358): n is a, c, g, or t
  misc_feature (382)..(382): n is a, c, g, or t
  misc_feature (400)..(400): n is a, c, g, or t
  misc_feature (452)..(452): n is a, c, g, or t
  misc_feature (567)..(567): n is a, c, g, or t
  misc_feature (579)..(579): n is a, c, g, or t
  misc_feature (583)..(583): n is a, c, g, or t
  misc_feature (593)..(593): n is a, c, g, or t
  misc_feature (603)..(603): n is a, c, g, or t
  misc_feature (817)..(817): n is a, c, g, or t
  misc_feature (898)..(898): n is a, c, g, or t
gnaagagtgagttggctctgtgagaccatcactgataaagacacatacagttagcaccacacatttataaatgcagatagccacaatgacctttccaatatgtacaagctccatttacacatccacacatgtatttacagctaataaataanatgtnaagccagancatccttgatatatatnacngagtttttcggngccagagtncccagtgctatgngcngctttagtgaatcttttaggtnaatgcgccctgggnngnnncccaaatccagaaatttaatgaattaatagggggggngnnggcngcgggtcatacatcattttgtttttggggggggttcgttccgggcctggnggtgttaatcacaacattggtccnactatttatgggcgcggncgtctctctcagagaaagggtcgaagttctggcacatcagggacaatttctnctccgacatgttccaatacatcccttggtcgactgtgttcccttccgaattatgctgaagggcaacacacatgcggagctttctagtatgtgttcagatatcacatactttcgcngtcgggttcccngctntggcctctgngatatttganatctttgtcatttcatatttgtacgtagaagagcattctgaaaaataggagatctagtttataaatagttgttcactcactcttgattagttgttaaaaacaacaaatagcaaccctcatggtactccatctggctcattgcacgcgatggtttacaagcactgcttaggaatccaccccaggaacctctccaccctttttacttagtaaaaanggtccttgtctaaaatctgtagaagctcacacaatgcaaaatttgaactcaaacctatcttttcatgtcaaagccaggganaaaagaga

SEQ ID NO: 496929 - DNA, 267 bp, Homo sapiens
catgaaatattacacatgaagaccacttgtatatctaatgtttgccaggacaaggctcggttcagtagatgagacattatttaaaagataaatttcaacaagatggtaaatgacacacttgtctttctacgacaatatttgtttgaaacctatgtaatttctctggctaacttttcttgtagcttaacatgacttttttaccacacaacaaacacaaacaacaaccccacaacacacacaatcaacacaccaaaaacacacacaaca

SEQ ID NO: 496930 - DNA, 379 bp, Homo sapiens
ggccctctcggtgattacctgcattgtggggaccctgcaccagctcccgcctccatctgaatgatgtggctccatgtgcatctgtgtcctggtccctgctgtgttgatagcctgtggctggaagctcttctacgtcacatgtgctgcctgtttgttggctgtgcatgaacttgtgatgtgacttggggagggagagccatcttcgacaatgatgcacatgtggaaggttgttttgaagacgttcagcctctacaatgaatgcttgcttgactcttttcatgagctggccacgaccaggtggtggtcctgctccatgatgtcctgtgatgtgatgcgtggaggaggacgaaggtccggtacttcgggaaaggctacatgg

SEQ ID NO: 496931 - DNA, 1148 bp, Homo sapiens
agaggatccctctgttgagggattctgatagcatagtctataaaaataggagatgatataataaagattttaatatctaattgtctagatggactttgtgaactatctgatggtaaatatcagataaaagatagttaaggatagaacatcaaagaaccaaagctaaatctatttttttttttgtttttttagtagagacggagtttcgccaatttggccaggctggtctcgaactcctggcctcaagtgatcaccccgtctctgcctcccaaagtgccgggattagaggcgtaagccaccacgcccggccgcagctgctcttcatcatcgtcataaaggtagttccaagtacaggctctggatggggtgacaggatgtctcctatctcctaaagctgacaattgataccgctgactgaacaagcactctggaaaatgacagacaccgcattccccaggctgacagatgagctgtgagagcgatccgaatgttgtacgactccagcctcacactattcctctgtgtttcatggtaacccttatgtgaccgttcctcccagggaaaccaagagcataattctggagaagttcgcctgtgttccttgatacctgattgtgccatttcctggacactgtgcaatttcctggagacacttcccagcaggggaaaccgcgtggattgttggacccccgatgaaggagcgtggacttccatctacgcagcagtcaccccagagctggaaggagttggtggccgttacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttcca

SEQ ID NO: 496932 - DNA, 191 bp, Homo sapiens
ccgctgtacaacctcccaggttccggccagacttacgtttttgagaccgcccagtagggaatcgccgtttgcggaccgaggcggcggcattcaaggccgcgcccggctcacgcatcagttgacggtaacgcccgcctcacgcaccacatcaccccaaagcgagatctctttcacgatctggtcgcggaagt

SEQ ID NO: 496933 - DNA, 999 bp, Homo sapiens
  misc_feature (941)..(942): n is a, c, g, or t
  misc_feature (946)..(946): n is a, c, g, or t
  misc_feature (948)..(948): n is a, c, g, or t
  misc_feature (969)..(969): n is a, c, g, or t
  misc_feature (987)..(987): n is a, c, g, or t
agaggatccctctgttgagggattctgatagcatagtctataaaaataggagatgatataataaagattttaatatctaattgtctagatggactttgtgaactatctgatggtaaatatcagataaaagatagttaaggatagaacatcaaagaaccaaagctaaatctatttttttttttgtttttttagtagagacggagtttcgccaatttggccaggctggtctcgaactcctggcctcaagtgatcaccccgtctctgcctcccaaagtgccgggattagaggcgtaagccaccacgcccggccgcagctgctcttcatcatcgtcataaaggtagttccaagtacaggctctggatggggtgacaggatgtctcctatctcctaaagctgacaattgataccgctgactgaacaagcactctggaaaatgacagacaccgcattccccaggctgacagatgagctgtgagagcgatccgaatgttgtacgactccagcctcacactattcctctgtgtttcatggtaacccttatgtgaccgttcctcccagggaaaccaagagcataattctggagaagttcgcctgtgttccttgatacctgattgtgccatttcctggacactgtgcaatttcctggagacacttcccagcaggggaaaccgcgtggattgttgggtgagtagcatgtgtgccattagagctctgtacgaaccaggaggaatgagtttcttttctttggcaaaccttgattcaatacttggacctagagtgcatggatgtcccagtgaagctactcttttatgcccttccagtagccatgaataggttttattcaggtccagcaatggatgggaccatctcattcattcattcatctatccatccatccatgcatctgtccatccatccatccatccatccattcatcgannctcnancagggatcctctggaaacagnctatgaccaagatacgantcactgcctctt

SEQ ID NO: 496934 - DNA, 372 bp, Homo sapiens
gctagacattcttttttcttgattttttttaagaagagtcttactcagacagattgggggggcaaaatcacaattcactgcagcctccactgcctgggctcaaacaatcctcccacctcagcctttccagtagctgggatcagagggaggcatgtaccactacacctggctattttttaaaattattattatctgtagagactagatcttgccattttgccaaggctgatcttgaactcctgggctcaagcagtctctaacttggcctcccaaagctggaattacagccgagggccaacatgactggctaatttttgtatctttgggtggccagactgatctcgaactcctgacctaaggggaacctcccac

SEQ ID NO: 496935 - DNA, 1087 bp, Homo sapiens
  misc_feature (10)..(10): n is a, c, g, or t
aattcatctnggagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacctctacaagcacgtgttctgggccacccgtctggcgaagaagcttctcggctggttgcttttcaagacccccgatgaaggagcgtggacttccatctacgcagcagtcaccccagagctggaaggagttggtggccgttacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttcca

SEQ ID NO: 496936 - DNA, 1055 bp, Homo sapiens
tgacaactgggcactttggaatcactttttcgtcttccgtcgtgattgtcaggcctccccaaccccgtggaacttggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacctctacaagcacgtgttctgggccacccgtctggcgaagaagcttctcggctggttgcttttcaagacccccgatgaaggagcgtggacttccatctacgcagcagtcaccccagagctggaaggagttggtggccgttacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttcca

SEQ ID NO: 496937 - DNA, 1841 bp, Homo sapiens
  misc_feature (10)..(10): n is a, c, g, or t
  misc_feature (1181)..(1181): n is a, c, g, or t
  misc_feature (1207)..(1207): n is a, c, g, or t
  misc_feature (1705)..(1705): n is a, c, g, or t
  misc_feature (1716)..(1716): n is a, c, g, or t
  misc_feature (1720)..(1720): n is a, c, g, or t
  misc_feature (1736)..(1736): n is a, c, g, or t
  misc_feature (1750)..(1750): n is a, c, g, or t
  misc_feature (1755)..(1755): n is a, c, g, or t
  misc_feature (1767)..(1767): n is a, c, g, or t
  misc_feature (1782)..(1782): n is a, c, g, or t
  misc_feature (1799)..(1799): n is a, c, g, or t
aattcatctnggagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacctctacaagcacgtgttctgggccacccgtctggcgaagaagcttctcggctggttgcttttcaagacccccgatgaaggagcgtggacttccatctacgcagcagtcaccccagagctggaaggagttggtggccgttacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaataaacattttggaggataatcaccccaagtggtcttcaaccataaactttgtgattccaaagtgcccagttgtcacaggtgccataaataattacattttccaacataaatgtgccattttccttgccgcgttaatacaactgagtccaaaagttccaagagagatgctctcttttcaggggctgcaatgtcctctntgagacctagtggtggatgaggtctnctgtttgattttgttcctgcactcactcatttttccagagacccagctgtgattcacaggtgtcagacatggggaggtgtgagccttgcttgctacagcctgtaggatgagtttgacgtggccagcagcaccatctggtcaacctcattccagaatggcacagtcacaagtgaagcatgccactgtcaaatccgagaatgtaaaccgctgaacagctatggatcaaatggtagccctcaaaagatatgttcatgccctaaccctcagaacctataaatattactttatttggaaaagaatctttgcagatagaattaagaattttgagatgggtcattatggatcatcccagtgaacctaatgccatcacgagggttcttatcagagacaggtagagggagatttgagtacagaaggacaagatattcatgtgatgatgcagacagagactggagtgatgccaccacaagccaggcaatgcctggagccaccaggagntgggacaggcngganggattctcccttatanccctcagagcaatnttggnccctctgacgtnttgactttagacttntggtccccagaacgganagagaataaatctttcttgttttaaggctccaccaacttcta

SEQ ID NO: 496938 - DNA, 298 bp, Homo sapiens
cattgacggccagtgtatagagcgctgagcagtagtagagacagctgagctagtgtatggagacagggacagtctatacccctgacgtccagtcggctctatccgctgagtcaagccatctctcttccaaagtccagctgctctctgaagtcaagtttaccctctccagtcaaaccacgttactctcttctactgactgagtctggggtctttatcggcagaggatggggtacaggacgggccatcggtagttttgaaaaaggcaacatttgatgggcgaaaacggcatcttcatcgg

SEQ ID NO: 496939 - DNA, 1075 bp, Homo sapiens
  misc_feature (10)..(10): n is a, c, g, or t
aattcatctnggagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacctctacaagcacgtgttctgggccacccgtctggcgaagaagcttctcggctggttgcttttcaagacccccgatgaaggagcgtggacttccatctacgcagcagtcaccccagagctggaaggagttggtggccgttacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctcacacccacctgcccacagggctctgtcctctagttttgagacagctgcctcaacctctgcagaacttcaagaagccaaacctccccctaccaatatccttcccgtgagtggttgtaaaacatttgttttttggggttttatttttcagaataaaaaagattcaacaaaca

SEQ ID NO: 496940 - DNA, 105 bp, Homo sapiens
cagagtgataggatgtttcatggttgtggtatgggtcaaaacctagtccggagtaacgtcggggcattccggataggccgagaaagtgttgttaggtctacctgg

SEQ ID NO: 496941 - DNA, 1079 bp, Homo sapiens
  misc_feature (10)..(10): n is a, c, g, or t
aattcatctnggagacttggcatgcatgttatcatagctggaaataatgacagcaaagccaaacaagttgtaagcaaaataaaagaagaaaccttgaacgacaaagtggaatttttatactgtgacttggcttccatgacttccatccggcagtttgtgcagaagttcaagatgaagaagattcctctccatgtcctgatcaacaatgctggggtgatgatggtccctcagaggaaaaccagagatggattcgaagaacatttcggcctgaactacctagggcacttcctgctgaccaaccttctcttggatacgctgaaagagtctgggtcccctggccacagtgcgagggtggtcaccgtctcctctgccacccattacgtcgctgagctgaacatggatgaccttcagagcagtgcctgctactcaccccacgcagcctacgcccagagcaagctggcccttgtcctgttcacctaccacctccagcggctgctggcggctgagggaagccacgtgaccgccaacgtggtggaccccggggtggtcaacacggacctctacaagcacgtgttctgggccacccgtctggcgaagaagcttctcggctggttgcttttcaagacccccgatgaaggagcgtggacttccatctacgcagcagtcaccccagagctggaaggagttggtggccgttacctatacaacgagaaagagaccaagtccctccacgtcacctacaaccagaaactgcagcagcagctgtggtctaagagttgtgagatgactggggtccttgatgtgaccctgtgatatcctgtctcaggatagctgctgccccaagaaacacattgcacctgccaatagcttgtgggtctgtgaagactgcggtgtttgagtttctaaaccactgccaaggttgtcctctattgagaagtgctcacttgagatttagagcaataattggggaaataccaggtttacatattgggatcagggcgtgtgcgggctaattatatttcctaaaaaaaaatggtctttggggaaggaaaggagtaattcgccttaaggaaggccag

SEQ ID NO: 496942 - DNA, 1820 bp, Homo sapiens
  misc_feature (169)..(169): n is a, c, g, or t
  misc_feature (247)..(247): n is a, c, g, or t
  misc_feature (479)..(479): n is a, c, g, or t
gcgagaactgtacacgactattcgtcagccttcagactgtcgacattcctaggaaacattgtctagcattcacttcgtgcgaaggagtatcagcgagcagcttatctgtgaagggtctcgctccagacgcgaacgcctggcggcgcaggaggacttcgatctctagcantcacagtgatacgaagctgctagacgcgtatcatttgagaagagacgcaacagagatagaatgcagggcctaccgcgnggtatgaccacatgtgggctcggggagctcaaacgaggagagaaggataccatgggcatactcgatatccgggcactgaatttctcgataaggtgccattggatcagcgacgcagaacagtttggagtacgaaagtgggctcgtctgatcgaccctaggagaaccttccccagattcatcgagaagagtcgcaggcggtctgtggttgcctagtgtcctcgaacgtttcgcnccggaagtctgacacggactggggtctcatcccagagtgcagtgacactcgggggcttggtccatgtggcttgtggcacacgattcccgtggaggaaagtgtgtcggttctcgcgtgtgtctgacagaaacagaggtcactaaatgccgaggcggaagcggagtggtcacgcggtagtctggaattggaaccctccaaaggggggttgatgtttgaccctttatggtgctcccgagggtctggaacttctgctcacaaattggccccaccaagcggaattaggagggcactttggagggagttctaaaattctcgccaatttgtagttaaaggcgccggcaaccacaaattgcaacaagggttcttgcaccggctttgtctttgttgtgtatccgaagaagaaatgatcgaagcagacgcggaggggattggtggcggaatattttccgcatcgacaaaaggggcgacattctaagaggccgaggcggttttgatacaggaaaatgccggatcacctggggagttgatcttcacaagggagacgcaaatcctcttctatgtggggcggaattgaggggtgaatcttcccgttaagtttaggttccggtgcagttcgagaccccatacatatgggcggggatccggttcggtttgccgcacttccacaccgggcgctcggacttcgaagaccttatacagggaaatccttagatacgataggttaaagcccggtgtggccgttaaacgacacgaaaacacagcggcacaacggaacttgtccgcacaggaatgtgggaacacgaccatttttcagaagggcacctccggttaagctttttgcggtgcggacacttagttctgtagcacaccctttcgcgatcttgggcagaacatttcacaaaaaccgtgtaaggcccttgagatttggagagcagtggtcttgggccgccataagaaacgagagcacacgtatggtggaggcactaacactctagggtaggaagcactatcaattcaagccacttcccgcagttgagaaggcatcgctttgagttagaataggtatgtgacgggaggcacaatacaaagcaagtgcgtcacgtgccacacacattgtggttgcagagcagcgatcgcgtacgcacaaagctaagctgcagatgattccccaaatagagacccccccaaagatgatcgtattttgttaataccaagagcacgccggtgtaacaacttgaccatgtgggagggaccacacactcacaatgtatgcaagagagcggacactgagtaaccactggtgtgaatacagacggaacgttaactgtgcctaaagaggta

SEQ ID NO: 496943 - DNA, 283 bp, Homo sapiens
tgagctactccagcctgggcagtaagagctactccagcctgggcaataagagctactccagcctgggcaataagagctgggggtttcgccatgtcggccaggctggtctcgagctcctgacctcaggcgatccgcccgcctcggcctcccaaagtgctgggattacaggtgtgagccaccgcgcccggctttagaattctttctggagggaaatgcattgtaatttcctggctaccttttagtattggaaaacttttggaacatagctcttattgcccaggct

SEQ ID NO: 496944 - DNA, 1283 bp, Homo sapiens
gctcttgtgctccctgccttagtcatgctggcctgggacatctggtgaacatggcctctgtctactgcgtgcagcagcaacgactgtgtggcctcggcctgggctctcccgtcgtccgtctggcgtggcctacacagaccgagacggggctgtttactgtgctacctggcctgatggaatgcccgatgagcctgtgagccccagggctgcccgtgtgagccgccacacccatgttgcatcatgtgccttgcccaggcttggtgacacgtatatatgtgacgcatggtcataaaaggctagccaaacatcaatcccgcctcttacacccggacaagcccctggctggagcaatgtagcctgcaaatccagtgcccctgcgctgcatgaccactgccagtgtaccacttaccagcacgtgcagcgattatctgacacatggcgcgacacggcacagagcgccatcactctgacgcgcacgctgctcagtactatactacgaatcaaacatcttcacttgtgcgcgcacgactcttcctactctgaaaacgcgtcccaaacctctcaggacgacatgtgatgacgcaacagacgtggctctcgcccaacgcggctcacgacggaacctgacaaaccaggaccaccggtcacacccacagcaagcaggcgaaagccaccatcgtgctccgaacacctacatgcctggcaatcttcagcgagctttgaccacctattctggccagccaacgttcctcgaccagtgcacatccgatatgcgcggcgactcgcgcctgacacgcctgcattgggcattcctacccaagaccctggctgaacacagttccggcctacaccgcgcactcactgcctgccactacttgcgcaatgccagcataaagggtcatgtctgcaacaactcagacagggccacacagagatctactttcacgaaccaatgttccgacacactgcacggcataagagtgagaatcaaacaccaaaacacttcaaagcacagaacgaacgtccgatgtaacagcagtcaccctattcgttgtagttacactggaaataaggaacgctataacaaacgccacaccaggtaaccatgtatgctctaactaccccacaaagatcgacgccgcaacccgagggactggggaacaacaccgcgaacgtaacaacctaccacacgacaaaactttcagacacaacatcagagtagtataatctaaagacgacagatcaccgtagagcactaacaaccgaccacaaagcagccataa

SEQ ID NO: 496945 - DNA, 125 bp, Homo sapiens
aatttagtcattgaaaagttgatctaaatctcttctaattcgtttaagaacattacttctttggactgtgagtcttggccagtatttgagaagtgccatcaccacggttccgtgagggtgctgtc

SEQ ID NO: 496946 - DNA, 676 bp, Homo sapiens
  misc_feature (252)..(252): n is a, c, g, or t
gtgctttggcggctccgccctgttcccgcgggcgtttggggtttgcccggggctgcacgcttccagccctttcgctcgccctttgtttgggtggggggcgggccttgccggcctcctttgaccttgccgggcctgggggaattggtctcccccctccccgccggttcaagaaaaagccttctggttcctggcgcagaggccggcgctggtctccccaccctctctttggccgtcaagccaaagtgggggacnccgcggttcaagggttggttgggaattgccaagaatcacccactttgccctcccgggttgcctccgggtcggaagcgcgggtgtcgggcctttggccgggttttgccccgttttgggttccttgggggtggggccctccccccttgtgggggggtccccctttcacccctttgggaggccgggggtggcctttaaggtgggcccccccttgcccccggccctggtgtttttgcgggttttggggggctttgccccttttgtcaacccgcgggtttgacccccctccccttgggggccccgttggattgtggggttggggcctgccctttgcctgtggggaaatttacctgtggggccctttggtggggggccggggccctgcccccccctggggtttcaatttaggggctttttccccccttta

SEQ ID NO: 496947 - DNA, 2199 bp, Homo sapiens
ctgggcccaggacactgaaggcccggtgaggctccagcagcagcagcagcaagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagccactatataccggcggcgccgtctcgacccagcaggagtaggcggacgggacggaggggggaggaggagggcgcgcccgtcagtacgtccgctcggtaggcgcgggcggcggagatcgtcgtaagtccgacgaagaaggaagagcgaggtacaagagagacgatcggacgtagtaggcagacagcaggaggacggacgaacgcacctcgccactcgtgactagcccctgcgatctcctagaccgccgcccggttcgtacatccatactcacgtccctacctgagcaggagagagagaagagagtgcatccctccctccctcgcctccctccctccgtccggccggctgcatgcatgcgagccggcgcgcccagcatgtcgtaccctcgactccgcccgccacgcacctcaatcagtaacaggctgcagctggctgccctcccgacctcccgacctacctgactaaacgtagctaacttactacgctaggaacggtcggttgcctcagctacgcataccacgctacgcacggagacgacacgcaccaactcacctagccaaccgatgcaagcatgtcgccctgcctcgttcgttggattggattgatggtggcgaggaaggacgcaaagaacgccggcaggcgcaaggggagcccgtaccgcccggcgaccgagcgacagagaagcgagacgtagcaggaccacgcgcagagcgaagaggcaaggagagatgggcaggggaagccgcgccaagcgaagcagggaaggaaaggagcagcgccaggccacagcagccagcaaccaagaagagacacgagcggcgagaggaagacgagagggagagaggagaggcaagccgagagaggggaccaggcagacgacgcgggacggccggccgagcaggcagaggcaccgcccgcgcgcagccaggctagacgagcacaggcgaggcaagaagtaagtcagataccaggcaagagaccggacagacggccgcccgccgtgccagcacgcacagcacgacggaggcagcccggcacgcgaacggactcgctcccctccgcctcctcacggcccacgacgccaccgagcggcgggcacggagcaggaacgctacgtccgccaccgacggagacgagcgagcagagcgaccgcaccgcacagaggctcagcgccacggcacgaggagaaagcagagagcgtcaggcaggcagcccagctcaactagctagcgacgaggcggcggcgcagagccagcacaaacacagtcagtcagtacagtagtaacggacgggcaaggacaccaaacgaccgcacgactcgcgagagagtgcagtgagaaggaaggacaccacgacacgaacgacgacacacacaagagtcccaaggcgaggagaggagaggacgggcagaccgacccgccgacgaaccgcacgacaggcatgcgacagaagaagaatgcgatcagacggacgagaccagaagagaagagaagcgagatagcgacgagcgagaacgacgcgccgcgacgggcggaacatcagcgcgggagcggacgcgaacgaccaccgagaagagaggacgacggatcaccagacgggcagcacagtggcagcacgtagagagcaggcaaggaggcggcgcgactgcaaacgtagccagtagcgagggagccgcccgcgacgtacaggcagccgaagggccgacgagcgagaggagagtaaggcaggaacggcagacaagtcacagcggcaaggagcagagagagaggaggaaggagcagtagggcgctcggcaggacggcggacggcgagagagagaggcaggagagagagcagaggagaagagctgcagaggcgggcgcgaaaagagcgagcaggcagtagaacaagcagcatagactgagaggagcagcgaaaagcagagggaggagcgcgactcgtgcagccccagccagcgctctgctctctcccctcacgcggaggagg

SEQ ID NO: 496948 - DNA, 108 bp, Homo sapiens
  misc_feature (77)..(77): n is a, c, g, or t
ccgtgtcgcggatctaccagagaaggcggagatgagtagcagcacggggtgagtaatatacgtggtatgggtagtgncatgtagagtagaagagatataggatgggtc

SEQ ID NO: 496949 - DNA, 856 bp, Homo sapiens
tctggtcctcgcgcgctcgcgtccctcgtgcgggctccagccgcagcttatcttcggctcccgagcttgggtggcgcggtcgtgccctcgtaattggcctccgaacgcggctcgaatggcaagccaaaattccttcacggaatagaatatgatacatttggtgaactaaaggtgccaaatgataagtattatggcgcccagaccgtgagtatcctacgatgaactttataccaattgtgaggtgtgacaggaacgcattgccaaccctctagattattatacacgctttttggccatctttgaagcgagtcggtgcgctgatagtcaaccaggatttatggttcttgcattccaaagaattgctatctgcaataattgaaggccgcatgattgacggtagctgtaagggtataatttaaactgattcattttcctctcttggtatggtcagactggatcagggaactcagactacaatatccaatagtatacactgaacgtctattacgccaattaggagacaacttgaaattgttaggatgtgaacttggcagcagagatacctgtgcatcccaacgatcatgttaataaaagccagagctcaaatgatacttttcccacagcaatgcacattgctgctgcaatagaagttcatgaagtactgttaccaggactacagaagttacatgatgctcttgatgcaaaatccaaagagtttgcacagatcatcacagattgggacgtactcatactcaagggatgctgttccacttactcttgggcggaatttagtggttatgttcaacaagtcaaatttgccatgaccagaattaaagctgccatgccaaaatctctg

SEQ ID NO: 496950 - DNA, 594 bp, Homo sapiens
gcacgagggattaatgaaatcatcgctctttaggctgatgggggaaatacctgtgtctcacgagacattgacatgaagggcttttgacaggaaaggccatgacaaagtttttatacaactgaaggagcggggatataggatacaactgagcttgacatgtagttaaggcctgagccgtgaatcgttgacagggaagttctgaacagcccagaacagggcaaactctgcattatactcatggctgagccaatgctcaattaatgcatgcattctcatgagacacgagctttgtcgtaacaccgtgctcgagtccactggaacactctgcgggctgcacagactggagcctgaggcatcctcgttgatacaactgtactgtcgcacgctactgaagacctgggactacaggcatgtgcctcagaggacggtgtaggcaagcatggcccccaggtaccaggtttaacgatgcttgcacggatggccctaagggctaaaacgagttaaccgagtggccttgactgatcaaagtggatgggtatgccattggttaaacaacaatggtcactcgggactcattccttgtcgcaacaaaaa

SEQ ID NO: 496951 - DNA, 518 bp, Homo sapiens
  misc_feature (44)..(44): n is a, c, g, or t
  misc_feature (52)..(52): n is a, c, g, or t
  misc_feature (145)..(145): n is a, c, g, or t
  misc_feature (362)..(362): n is a, c, g, or t
  misc_feature (375)..(375): n is a, c, g, or t
  misc_feature (431)..(432): n is a, c, g, or t
  misc_feature (440)..(440): n is a, c, g, or t
  misc_feature (499)..(500): n is a, c, g, or t
gttaaagaaatatttggatgttaaattaactcactatggttttncacctggnaaggaaacaaattacgtactagagggcattgactggttaaaaacttgtgtatcccgggaaggacctgcggtacaggagtcagccatgtctgtnctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggaagcttcatgtgtccctggggctgtgcttagcttttccttttacagctgtttacagacaaggccaggcctntaggcagatgggncattggttctttgtgatgttttgctcagagggattattgaacattttaattttttnnaaaagggnttgatgttggtttttttttcccaggtgttttataaattaaatcccttttaattatttanngggttatttaaacctctt

SEQ ID NO: 496952 - DNA, 770 bp, Homo sapiens
tatttataccgcggattatgtagaggtgagtggcgccaagcgtgggctcggccgctgaaattgcttaccgctggcgctccttacaagcgggagggatccgcgtgtggacccatggaagcgggaggagcctggcggcaccccctcttcctcacttccctgtactctcatcgctctcggctccgacacgaacaaggaagcaaatgagctgatggaagatctgtttgaaactttccaacgatgacgatgggattctccaacatggaagatgatggcccagaagaggacggagcgtgtggctgagcctccaagctaactttaacaccccgtcaagctctacggcttgaggaactactgtgcccaacccttacctacattgaacaacatcacgactagcgaagggaccctactctgaacagcgctgactcactgaccgaaacccttcaggcccaaacaggcactgacacggaggctacgacacacggtcgagaatgcccgcaagccagctcccggacgctccccctcacgtaagccctgatttcctggtatccccagcaccgcaacacagggcacaggatccaactcccaagcaacagtgagacatgggcacaaaagcgcacatgctctcaggcgctctcgtggtcaccagtatgccgcgcgtaccgttgggccagcccggcgcacgcgcgaagtgctcaaacgtacccgcatggcccaggttaacccacccacggaagtaatgccgtgtaacagacacctgcggacccgttagc

SEQ ID NO: 496953 - DNA, 541 bp, Homo sapiens
aaccgtgtgctgaggcgactctagcggatccttgtgctactccacaaacagataaacctcagtgtacaatttgaaagaagtttgcctgtaatgagtataatttagaaagtagacagtggtgtgttggctctcgtcttattccttttacatttgtgcttctgggatttaaaaaattactaaattcataagatagttaggtattacacacttcagaatatcaatgtaaaatgggaaaataaggaactgggggcatttgtttaggccatgacttctacaagcagatttcttttcttttagtttagaagacaaaaaatttcaaatacagatacttcttttagaagtaaatttatagatttcatcgtcagtagaaaaaagttaaactccttactaatttaaaactaagcacagtttaaacaaggaagcctgaaaaagactcatactacaaataatttaatggatggcatataagactatgcagtttgcaaaagccaaactcttctctccacttagcttttgatccccactgattgtggcggtagca

SEQ ID NO: 496954 - DNA, 340 bp, Homo sapiens
agatcctaacagacatttccacaagaacacacgcaatagcctgcaggtatatgaaaaaatgctcagcatcactgatcatcaggaaaataccaaataaagccagagtgagatatcacctcacatctgttagaatgactattatcaaaaagatgaaaaagaccagccatggtggctcatacctgtaaatccgagcacaatgggaggctgaagcaggaggatagcttgagcccatgagttgaagaccagtctgggcaacacagtgagacctcatctagttctggaggcgagaagtccaagatcaaggtgctagcagagctggttttcagtgagacttcttttc

SEQ ID NO: 496955 - DNA, 784 bp, Homo sapiens
gagtctctgataaatctagctttttaaggaccttaggtttggggtttcttgtgttttgttgtttttcatgttattcttctatgagacaggttctggctctgtcgcccaggctgggagtgcacgcgggtgcgatctatagattactgcaagcctcaaatctcctggacctcaagtgatcatcctgcctcagtcctcccaagtaggctatggtctacaggcatgcaccaccatgtccagctaattttttgagttgttatttgatttgtattttaggtttggctagacgagagggtcttgctatgttgcccaggctggtcttgaactccctggtctcaagcaatctctctgcattcagccttcccaaaatgttgggattacaggcatgagccacgcagaacctgggcttcatttacttagttgatttttttaaatgtcattagcagatatatcttagaacttgtcttaggtatttcaaaggagaattacttattttgttactcgctctacgaaggtgaagattgactttaatgttgagaatgttatgcatcaagtatatatagacggcgaagacatgtttagttcttgtgatgaaataactagcttatgttgctgtgcgaaatcagtatggtttatattcagttttaatgatgtactaatctttatcaaggtgtagacaaatgtgtttaagattgtaggcatattgtttggtgatgtggaacgtaaattacggatttattatttatttgcagagagaaaggacattggtattactttagaggatgaa

SEQ ID NO: 496956 - DNA, 121 bp, Homo sapiens
tacgggtgaggtacagctacgggtgaggtacagctacgggtgaggtacagctacgggtgaggtacagctacgggtgaggtacagctacgggtgaggtacagctgcaacgtgaaggctcgat

SEQ ID NO: 496957 - DNA, 344 bp, Homo sapiens
tgatgagagttacctggcgttggctttaaagagagtagaagtttaggaatcgttagggggccatctggtgtgtgaaagtagaggacctcagaggtttacgaagagaacaggtggttttaaggggttatcgttagatgtttcacaccggaaaggttttgaaacactaaaatatataatttatagttaaggctaaaaagtatatttattgcagaggatgttcataaggccagtatgatttataaatgcaagtgctccccttgatttaaacacacagatacacacacacacacacacacacacacacaaaccttctgcctttgatgttacagatctaatacagttta

SEQ ID NO: 496958 - DNA, 170 bp, Homo sapiens
tgacgctgtctctggacccatgtgaccagcctgcttctgtctgcagttccagacttgcagtggtatcagatacttgaagttaggtggagccagagggatgctgtttccctggctccctccagacccagcaggccctgctgctgctttctcattgctgttagtccagcaga

SEQ ID NO: 496959 - DNA, 525 bp, Homo sapiens
cttggtggcgtgtgcctgtagtgccagctacttggaatgaaggcaggaagatcatctgagatcaggcattggagactgcagtgggctataatcatggcactgcactctagcctgggcaacagagaaataccttgtatttaaaaaaaaaattttttttaaaggttaaaaacatctgggttgtcgcttgaaacactcataggcagtgccccaggtccgcaggcaacaaagggacaagtataatttggcttctaaaacttggataatctgcgaattttgactgtcagagaaagatgtgtcatgtgttaacacagagaagggagaactaggtcattctgaggcaccctaaagggaagaagtagaagtacatgaaacaaattgatcaaacctcctgtttcctagaggctctttttaagcaaaaattacctgttatcccatttgtaatcaaggttgaatccttttatacttcacagcaatttattttctgagttttgagaaaggtactagtctagtgtacctggattaaat

SEQ ID NO: 496960 - DNA, 137 bp, Homo sapiens
ttttgagaccagccttgggcaacattggtgaaacatttgtctctaattaaaaattacacaaatttagccagtgtttggtggcaggcaccttgtgctcccaggttacttgggacggctgagcgtgggaggagagcgaa

SEQ ID NO: 496961 - DNA, 206 bp, Homo sapiens
gggggggggggggggtgggccctttttttaaccccccctttttttccctggggggcccggggcctttttcctgagggtttcccctcccctggggggtttttgggggggtttttttggggggttgccccctccctccccccggggcttttttggtttgggttttccagggttttttgagatttaacgttttttttcccccccccaga

SEQ ID NO: 496962 - DNA, 1238 bp, Homo sapiens
  misc_feature (252)..(252): n is a, c, g, or t
  misc_feature (377)..(377): n is a, c, g, or t
  misc_feature (547)..(547): n is a, c, g, or t
agcggctcttgctcagtgaccgtgtggtttgcttaggcgcaaactcgcgtgaacgcgcgagccaacatgccactggccggaatctgggttagtcgcagaacttatgtgcaaccccgctggaggacccttcggagcaacatctcgtctcggacctaaaggatctgcagacgctgagtcgaggcgcagtatgtggctccttgataagcatagacgtgtagtgtctggcatgggtcatgacttctacccatggcncaacgatccgcagacgtcgcccgttgaactgcctcgacggccttgcattgaggaacgcgacccacttggccgccccttgttcggcataggccttactcccgtgctcgctgcgcgctttcgtcccngcattcgttgcgtcgctcggaatcggagttggcgaagcattgaatccttggatttacttcccttgggcctggcttagcataggaccgcatttctttcagtatgatgacagcctgtaggaacccagagtcgtttcccccgcgtagcgcgttgagttcagcagtcgctagtncgcacgcaacgctcagcgttgctcgatccccgccatgcaggccagtattcgaatggggtccggctaaccgcaggagttgtgttgaaacatttccgctgtaccttcaatttgtccaggcctggatttcccatgaagctacatcgactttcgtctctggcgcatctcccctaccggtggctttgtccgtcccgtggccgcggtgaaacgaggaacgaaattgccacagcaatgggccaaggggttggaggacttggcgagcctggaggaacggattaggaaggaacggatttaaagtcccagcgcctttgctgccccttcccgttggcagtcttgtctttgtgaatttggtcgttcagtgtttctacccgttgccctaaaacttaatagccaggggaatccaagactgtccttatttaccgatgagcatgatgaaaggatctacttctctagaaaagtcgttgggcaactccccggagcgaattaacgggggcgatgaaaccccgttgcgaagggggaggggcccccggtgtacccccacgtctttttggttgtctcccctttatctcgaccggcggtttaaccttccggagcccgtgtgggggctataacccgatatgggtcgaaaagcgttggttgctccctgcttgtgttcaaaaattgtgttcatctcgcgattcaagaacttcccgaa

SEQ ID NO: 496963 - DNA, 602 bp, Homo sapiens
  misc_feature (474)..(474): n is a, c, g, or t
ttaatctcatccagtgcttttgtcacctcgtgttgtaattcaattttttttattttttatgagatgggggtctcactatgtggtccaggctggtcttgaactcctgggctcaagcgatcctcctgcctcagcctcccaaagtgctgcgatgacacgcgtgagccaccaagcccagccaacatgttataattctctagaggcttgcttggggtcccctttacgtcttccatgtctctactaaacttttgcagattgggattcagttgtaagaactgctgagtgcccatgtctgctggttctgatatcagggtcggtttcaggaggctgcttttcctccttgtttggggtcctattatgctgccttcctgtgggcctggtactctcgggttgatgcctgaggcattgcgaattttaccatgttgcgtgctgggtgttttagcatttttataaatcatcttaatctttgttctggangcagttgagtttcttagaaacagttttagctgctcacttttctggagaacctggtcctttttgtggaggcctcggctgtcgtctttacgagtttctgcaggtcccccacaggcctgccctccgataag

SEQ ID NO: 496964 - DNA, 643 bp, Homo sapiens
tgaggtgactagaggatcccgctgctccctgacagccatattagatgaaagccactaagtgagctctataagtgtacataaaacatatccgattatctggtgccctttagcgaggtatactgaagatgcaggtttggcatcgtggagtcctgcctgaccaagaattagagcctataaatctatcttgccattcagagcagagagcactgcgacaaactgaagcacaaaaacaaatgagcaacacttatacaaacagcatggaggttgggggtgagggacttaaaagtagacatgctacacctaatgtcaagaagcagcttggtttcctttgccagatatccttgtgacgacatggattgtagattcaatggtcctacacagggtatctaaaatgtcatgttgctgcatatgactaaagagtcctctgcaatggccacaactgagagataaagcaacctcagggtcctgggagggcaaacgcttggccatcacagcttctcaagtcagctaagtcagacagaactgcagagatagaagtagaagggaactcagattcttcctcagctagggtagaatccttggaacagtggaggtctttaaattctttacaatcgtcatatctccatttgtgggactgttcttc

SEQ ID NO: 496965 - DNA, 139 bp, Homo sapiens
cgtcagcatcgtctattcgacccacattcacccctcccactcagggggataaacgagggtgaggtaaagttcactggaactgagttttatggactttggcatttccctctcttacccccgcaggggaggggttaatgca

SEQ ID NO: 496966 - DNA, 335 bp, Homo sapiens
cttttttcccggggggggggggggggcctttgggggacccccccggggattttttttatttccctttccggaggggcggggaaggggggtggccgtggaaaggtttccccccccccggggtttcggggggggggttttgggccctttttgggcccaaaattatttagcgcccctttttggcccaaaaattagggtttggggggggggggcccggccctggcaggggggccccccggggggggggtggggtccggggccccggtccccggggcccccggggggtttttcaggggggggggaagggggtttttttttttttaagtttttttcgggga

SEQ ID NO: 496967 - DNA, 546 bp, Homo sapiens
ttggaacaaatgctgttttttttaatagctgttttggaatacaattttagagcagcgctacctattcaatgatggttataaaggtgcacgaccaaacatctgattcaccgatgcggggtatgtttcttacaacagggatgtatatcccggcttgatcttttgaaagagagtgcataccactttatctgagattatgatcaccaacgctgacctaagaatccatcctatacttcggggagaccctgcgaattgcataatacagatgataaacacgagcgactaatacgtgcttaatctgatcatccttaaggaccatacgcactacgtgtgctccagagttgcataggaaggtgagcgctgaaagatacatctcttctcatatccttcaaataggtctatgcatactactgatgcaaaagcggcgtacgaggcactatagctctgagaagaaggctctgaccatcgtacatatattgctcattgagtactatgactgccctacgtttaggcatactcctacactggtctgtgccatgcatttgcatg

SEQ ID NO: 496968 - DNA, 126 bp, Homo sapiens
gatagacacttagcaaaagaatgaaatctcacccgcgaaatcctaccaacctctaggggccacagccctagcccataccagtatccttggcagttctcccccaaaccaggtctgtacagatcatct

SEQ ID NO: 496969 - DNA, 109 bp, Homo sapiens
gtggtgtctagcagtcctatacctatcgcatgaccgcggagttcgggaacaagtcttgggtcggggagtatggtgcaagctgaacttaaggattgaggagggacaccag

SEQ ID NO: 496970 - DNA, 327 bp, Homo sapiens
tgaaaagaccactgactgctagtcaagagaacagacatgttgagcacaagagtgacagcaacgacatcagcacatagatcagaaatgacagatgatcatggcctggtgcagaaaaatgaagacatacaagagatgtaaacctgtaaaatgaactacaggcatagctacagataggaaacaaccagtggtggttataaaaatatagctacaaatactataacactcctctgtaaagaggtgggatccttgtaccctctctgaatcatggatgagctgatgactgcttcaaccaatggagtacggtggaagtaacactctgactactaa

SEQ ID NO: 496971 - DNA, 348 bp, Homo sapiens
  misc_feature (348)..(348): n is a, c, g, or t
ctttgcacaggtaaggacgctggcagcaggtaacactcagtctggcctttccctcttcaaggccctctccctagcaagcactcagtgaagatgaatgcaaatagaatgatggcatcttcctgacaacgaagctctgagccaatttgaccgctgtgttgccatagccttgctcagtgaccttgagcagatcaaggtcccctctgctggccctcattgatgggtggagtgtaggaaattcgcctctgcctctgcctcacaaagagttcatgaaaacaaaggagttgtcagtgccctggtactctggcatactttaagctctttgcaaagaaaagaccacttgaagttctn

SEQ ID NO: 496972 - DNA, 157 bp, Homo sapiens
  misc_feature (56)..(56): n is a, c, g, or t
  misc_feature (122)..(122): n is a, c, g, or t
  misc_feature (140)..(140): n is a, c, g, or t
cagccccttacttaaagatctggaaagcatgaagactgggctttttttcctatgtntcttgggaactgcagctgcaatcccgacaaatgcaagattattatctgatcattccaaaccaactnctgaaacggtagcacccnacaacactgcaatcccc

SEQ ID NO: 496973 - DNA, 139 bp, Homo sapiens
  misc_feature (9)..(9): n is a, c, g, or t
  misc_feature (118)..(118): n is a, c, g, or t
aaggaacgnatgactttccatcccttgaaccaaggcatgttagcacttgctccagcatgttgtcaccatttcaacagaaatcgcacaaatgctactgtgcaaggtgcagccaattttnttgtaagtgtgatttcttacg

SEQ ID NO: 496974 - DNA, 181 bp, Homo sapiens
gtttttttattttttgattttatgggcccccccccggccctttggcatgggctcctgtataaaggggagttcctgggcctgtaaagttagtggcacctccaaagtagttataggctgccaagtccccttttggcttcccatggagatttgctcccacccatgttggtggttggggcaccca

SEQ ID NO: 496975 - DNA, 649 bp, Homo sapiens
  misc_feature (351)..(351): n is a, c, g, or t
  misc_feature (390)..(390): n is a, c, g, or t
  misc_feature (441)..(441): n is a, c, g, or t
  misc_feature (446)..(446): n is a, c, g, or t
  misc_feature (459)..(460): n is a, c, g, or t
  misc_feature (471)..(471): n is a, c, g, or t
  misc_feature (490)..(490): n is a, c, g, or t
  misc_feature (492)..(492): n is a, c, g, or t
  misc_feature (512)..(512): n is a, c, g, or t
cgcataaaaacaacttttaatttgattgaaaataaaataacagtcgtctctgacagtggagaaattatgctcaaatgattattaatttgaaatagacctctgaattatgtacttttagatctgacatttcatactgactctcagatagaacataacggagaactctccatcttctaaatgtgtctttctctgaaatctgtacaagtcctttgataacactgtattattgaagtctctggagtgaaacactatacactaatttacagttataaatacaaagtattgtagacgagatgaagaaagagttctgattgacttgctggctggtttctcatctcatgtttgcccagnttgtttcagttgttatagtctgttctcagtttttatgcnttgcctttttaaatgttaggattacttttttaattgacaagtaaaaattgnatagnatatttatattgnncagcatgaagntttgatatatggctatagngnggaatgtctaaatccagctntttaacatatgcattacctcacgcactcatgacatatacctgaaaatcattattctattgggaaataatcttccctttttcttttcattttttgcctttggagccaaatggaccagatgatatttaacttcatcttt

SEQ ID NO: 496976 - DNA, 323 bp, Homo sapiens
ataccctcgggggggggaactgatcactgtagctacaacccaaacaatccagttctccctatggcttcatactagatataattctccatagtattcatcgctgttgcatggttcgttacatggtccatcataggaattctcactggtgatatataagactcagacccaaagtattaatctagttcttcaaactatctactcatcattccgtaattaccagtactaagtcttacgttaccagctaacaacgctattccaaccggttcatcggtctgagatgggcgtaggacatgatactccttcttgctgcatcagttgatgat

SEQ ID NO: 496977 - DNA, 322 bp, Homo sapiens
  misc_feature (119)..(119): n is a, c, g, or t
tttgcaagagagacaaagcggagggacttacaggttccatgacatgcaaaaccagcaggcagttattcaaactacagctcgcaaatcatcctttttaagtccttgtaccatatacaggncacaagagcgtgagggctcggctcccaagggcttgggcagctctggggctgtagctttgcagtgttcagctcccgcagctgtcctcatgggctgggctactgttgagcaccttgtagcttttccacaatgaagatacaagatgttagtgagtctatagaatctgacgtttcagaaaggtgctccctgtgtagtggttcccacc

SEQ ID NO: 496978 - DNA, 181 bp, Homo sapiens
agtgaggccccggtcttcctcctccgtcctgcccgcaggcccaagaaccccctgacgggtattcaagcttgcgcgtaaagtctcgcccggtgccatcttgtcttcgcaatgctcccccaagaaacaggctcaggccgcgggcagcaaaaaggcggacgaaaaaaaagaaggagaagattat

SEQ ID NO: 496979 - DNA, 500 bp, Homo sapiens
tcgtgcactctgaaaagcccttgaccattggatatacctactgtgtacaccagcaagctgccaaggctatggcccgcaccagcccccagaactaaatctactctccctacaaggcaccatagcagaatcggcagcagtggaccagaaatgtgcaagcaccctgatcttactcccagctctgaccaaatacagaattttagagaacatctgaagacattagactgcactgcgaatacatgatgaattatagattactgccatctttaactgccatcactgtgacagagaagtcctgttacagaagtaccaagctgtagatatgataagctagatgcactaaaccgaagccatgcaaaacctgaacagcttcttcctgcattgtaggagagtgagacaaacaggagagccacccattgtctccagtacatagctcagttttatcatccaagctgtacatttggatcccaagccgcatttaaagagaatatgttctttttaag

SEQ ID NO: 496980 - DNA, 107 bp, Homo sapiens
gtgacatcgtctttaaaccctgcgtggcaatcctggacggcacgccgtgatggcccagggaggacaaggcggacctggaagtccaacttacttccttaagatcatcc

SEQ ID NO: 496981 - DNA, 762 bp, Homo sapiens
tcacaataatctcgcatattgtaaataactactccggaagatgccgaaccttttggatacatatgtatgcgtctgacctatgatatcgattcgtgttcctaaggttgatcgtgtgagacacgagcatatattcacatggcgtgaatagacgtctaatacacaagcatatgtacagcctcagactaccgaataaatcatcgtctatccccctacacggagatcaagagatatgctagcatgaattgtctgccatgttccacgagtaggcaatatgaagtgatctgctgctacgtgcacttgaacccgtcggagttcatctttccttttcaccgaatgtgggctggactgcgcgaattggtagtatagcgaaaactccagttcacgtagaacggtcgttactacacgttcccagtaactaacggtagacacacgtcgcttttggccactaatattcctgaatccattgagggaacgtgtgattgacatcagtaagaggctgtagatcacaaatgaatttccaccttgttactgatggcttaataagctctagaatcaaggtcctatctggcacacatagtcctatttgcataatcaatatgtcacttcggaggtaattattgtaatcgttttggtgactcgacaaaaaaaatattgcggacaatgtacggaatatgcctcgacggttgcttggtataaaccctgtggacgtgaaacgctacattgtcacattctctatcatgggataggctcgatcgaacccca

SEQ ID NO: 496982 - DNA, 134 bp, Homo sapiens
gtgctatgggaacaattcaatggctggagagaaaaggcacctttgacccagcagaaggcagaggcttggagaggagggtgaggatgtacaatggagcatctgcaggcgaggaaacaatggccagtgatcttaac

SEQ ID NO: 496983 - DNA, 895 bp, Homo sapiens
acaggtgacctttaacatatgaaagtcacaggcttcctgaagaaaagaaaatgctgaaatagcgatgaatggtatggagagaggcgagatgcagtgactctgggtaaatctaactaattttgaatatctatcgtaaatttgagtgcatgcatgtacttactatagtcctggtgtgtcgctctgagatgttagagtgtaagtaaattgtgatacgcatttattttttgacatgaaggattctactttctaattttacttttctgatctcaagaaaattaaattgaaaaacggggtaaaattcttcaatattgcctcaagttcagttttgtcctattgtcctgagaaaggagatttagacttgtctggcctaacacaggtattttttagggcatcgtactatcccagagaaagtgttgagataccatgggcagaaatataaaacctaagctttgaaccccagtagacttcttcttctgcattaagtctctctttatctgatattctaaggatttcttcaaactacttaataatttgtcaccattaactttaatatccagtttttaatctgcactgtaatatcctggtttgagaagaaagaatgctcaataaattaggagaagtaccagaacaacaatgttttggaaaggtgatcctggctcctgtgctctcaattaatggtgttattaggtgaaaataaaaggtcaggaaatgggccgtgcggtggtcatgctgtaattccagaattgggaggttgggtggtggtgtaccttaagtagggagttgagacagctggcaaatggtgaacctgtttttaaattcaaaaaaaagaaaaaattgggggcgccaaattttaacatgtgggggccaaaaaatatatattaaaaagggaggggcc

SEQ ID NO: 496984 - DNA, 208 bp, Homo sapiens
ctgaggatccccgtccgatggccatggtggcccatggttgtgctttctcgtgttacatcgcgccatcattggtctatggttcgtgtgttggttagtatggcctcgtatgacggagcgttatggcagtgcaatgtgaaatcacatgagctaggccgggaggtccttatggtgggctagagagggcccctgattaggggtcatgggatca

SEQ ID NO: 496985 - DNA, 221 bp, Homo sapiens
catggcttgacggtgtacaatgtgcggattacaaggtctcacggaccattaatcacaccgacacagatgggacgagggtgtccaacatctggtggtaggcttctcacagggctggtctgtgcaccaaattacttctgctctggtcttcgtgctgatgctgggcctggagctgatccgttgaaggacatggctctggtacctttgtgtcgccagccaacagg

SEQ ID NO: 496986 - DNA, 602 bp, Homo sapiens
  misc_feature (13)..(13): n is a, c, g, or t
  misc_feature (179)..(179): n is a, c, g, or t
  misc_feature (234)..(234): n is a, c, g, or t
  misc_feature (243)..(244): n is a, c, g, or t
  misc_feature (246)..(246): n is a, c, g, or t
  misc_feature (249)..(250): n is a, c, g, or t
  misc_feature (301)..(301): n is a, c, g, or t
  misc_feature (319)..(320): n is a, c, g, or t
  misc_feature (322)..(322): n is a, c, g, or t
  misc_feature (331)..(332): n is a, c, g, or t
  misc_feature (336)..(337): n is a, c, g, or t
  misc_feature (347)..(347): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (387)..(390): n is a, c, g, or t
  misc_feature (442)..(442): n is a, c, g, or t
  misc_feature (449)..(449): n is a, c, g, or t
  misc_feature (469)..(469): n is a, c, g, or t
  misc_feature (482)..(482): n is a, c, g, or t
  misc_feature (488)..(488): n is a, c, g, or t
  misc_feature (498)..(498): n is a, c, g, or t
  misc_feature (505)..(506): n is a, c, g, or t
  misc_feature (508)..(508): n is a, c, g, or t
  misc_feature (513)..(513): n is a, c, g, or t
  misc_feature (523)..(523): n is a, c, g, or t
  misc_feature (527)..(527): n is a, c, g, or t
  misc_feature (538)..(538): n is a, c, g, or t
  misc_feature (568)..(568): n is a, c, g, or t
gtatgggtgttcntgataaagaagggttaccaagacgtcgacacctccctgcagagtgctgtcatcaccaaagtcaagggggtgggcttcaccaacacctcggatcttggggaggggatctgggatgtcgccgactacgtcattccagcccagaatgaaggcattcctgatggcgcgtnctccaaggacagcgactgccacgctggggaagcggttacagctggaaacggagtnaagaccggnngntgnntgcggagagagaacttggccaggggcacctgtgagatctttgcctggtgcncgttggagacaagctccnngncggaggagnnattnntgaaggaggncgaagacttnacnattttnataaagaaccacatccgtttnnnnaaattcaacttctccaaaagcaatgtgatggacgtcaaggacagatctttcntgaaatnatgccactttggcccaagancactactgccccntcttcngactggggtncgtgatnngntgggnggggaggganttcnaggatatagcncgggagggtggggtgataggattaatattnaatggactgtgatgttgataagctgctctgagtg

SEQ ID NO: 496987 - DNA, 920 bp, Homo sapiens
gagcggagagggagtgcggacagccgagagggcggctcggtggagtgccccgtggctgacgggacggccggggcggcgggccgcgtagcactggctggagtgagtgtgctctggccagtcgtggtcctgtctttggccctgggtattgtcggggcgctgggtgctggcgtggtacctgtgcgcaggctgggctgggtcacagctgcacatccgcgcctccgtgtgttgcctgcctgactcctccagctcccgcacgtggccccggacctacttctggggaacctactcgccctcacgtctacttcgtgcatgaagacccggaagcccagaagccaccatcctcaacggactgatgtgggcgcaggcagggtcagcacccctggggacatcctaatgctcagagcacactgttgtgagcatcggaggacggtagtgggagtcccctaattggacttggtgagttccgacgaaccaggacgtctcacttacgagagctgccaagacacatccatggatggggcggccttaaagagcttcagcagatgaagttcgtcaacagagtgccatgggaggtcagcaacgtgagggggactggagctggagagtgactgtagagcctcaggactcagtgtactttctgccctccctttggttctcccatgtgcttctatgtgggtgacgagatggcacaggaagtcctagtaccagaaggtagggggccaagggggcacgctgaaggttatcagttggagaacaccagtgaaactttgggtgacttcgcgctttacaattattggcaagaaccagtccaggggactacaggccccaacgtattggcaggtacaagtactatgggacttcagaccaagactgccctgtgccaagatggtcagagtcgctaaaagtgacaggatgacccg

SEQ ID NO: 496988 - DNA, 382 bp, Homo sapiens
cagcttcctgccagcctaccccttggctcgggattgtctttgttgcaaggtctcggcaatttacagaactctcactccttccctcgcctgccatcttctctgcttctgagataagaaccatttgtgtaacaccaatacctaacttaagacagacatgcattgcgtggttgtaatcaaagctgatgctttcagatgatgtaatccatctccaatgcggaaaagacaggcccgtccatccacattgctgggcacccagctgactgtaagaatggaattccaaacacttaacacattcagttctatgacagaaagtgagtctatggatatggtattttgtgaatgatcttttaaataaaagagacccttacataaaaaaaaaaaa

SEQ ID NO: 496989 - DNA, 139 bp, Homo sapiens
  misc_feature (63)..(63): n is a, c, g, or t
tcagctcggaccagtagcacacttcttttcctaaacaggacggaggtgacatgtagctctgtnttctttcagctcatagatggtggcatacatctttgcgggtcttgtcttctctgagaattgcattccctgtggccga

SEQ ID NO: 496990 - DNA, 354 bp, Homo sapiens
ccgagtcgtaagtacttaaacgacctacctaaacgactcgccaaaccgctaaaaataaatactaccccctactcttattcaaacgacttactcggacggagaaataaaccgagttctaattcgtcgataaaccagttaagacataatcctgcaacagataagaccccacgcctaagaataaatttaaaaaaacttctaatcaacccccccccggacgcccaacatttaaccacccccggccggaaggcaaacatatgaagcaacaaaactccgtaacccaacataaaaataaccaaccgccgccacccctacatctatgaccctataacgaaaacaaaaccttaaccccatttc

SEQ ID NO: 496991 - DNA, 967 bp, Homo sapiens
aggtagaccactggagtaggtactacgcctcatatgtgcgcattgtacctcggcatctcgtaccggttcctgtgtggcttaccagaacgtacagaattgctaaggcgtatatgcgatctacagcagaggagcgcccaaccggtatggtgtggccccgtgagctgcgactggactatgaaactccgttacgacatgagggcgcatagagattatctgtcaacacaccaagtaggacccacattagaatctcacgaccaccactttaggcaatacataacttctaacttcaacacggtcgctgaaacctatagtcttcatacaccaatcgggtcagtcgatataatggaagtcctctctttaaccgaattaatggaatgcactttcctggggacggaaccgtcgagagggaatgcgggtcccgcacctcaatggaatttgcttagacacggacgtacgtcttggcccgaaagtgagaacccaacctcaatttttattcctgactctccaggaaggatgccttctcaggggcgtgcgtgtcatatcttccaccttcccaatcttttcaatctcgatgaagctcccaagaaacccgagtattggtctatctttcaatgtgtgttattaccctttggaagaaatacgctagcatttttctagtacgaacggttaacatgtatttcttacgcaccaacgtgttaccgaactacgtcacgataaacgttaggttaaatgaccagaaggtaacaaagactctagggtctgtctctcgcaaatttttccgggggttgcgagaatataagaatgccttcattgggtggttcaacctaacagggtaaagcagagtcggtctggttaaaggcaatgacaagtattttaaggacgctggggagagaatcccaagaaaattggtctagtttggtgggtaagccacttccgcggaatttttaacgggggattttttccccct

SEQ ID NO: 496992 - DNA, 175 bp, Homo sapiens
ggtgaccactgttggtcccagtagggatggcacaatcagcgaggacaccatccgagcctctctcatctctgcggtcagtgacacctgagatgcggatgaaggaggacatgatcgtgcccaggcagagctcaatgacttaacgcacagaagaagaccttacaacgggtcacagacc

SEQ ID NO: 496993 - DNA, 271 bp, Homo sapiens
ccgaaataaagcattcattgtgtactaaaggtttttttgtttttatctgatttcagttatttgtgtaaacaccaccttttgaaccagcaattatcaagtctaggaaaagcaattgatgttcccatataatcttttcttggggggaaacccttagttctaaggatttaacatcctgtaattgaattttaacataacggtatcccataagcagcctttttattgtcagaccattgcctgatttataattatattaaaacaaagcaacaaaggg

SEQ ID NO: 496994 - DNA, 407 bp, Homo sapiens
agcaccggcctgacctgagctatgaccatcgctattttactatgagcccccgataccagacccaaccaactgggctagcttagcctaagcctactatatattctagccagcgatagacgagccgttcactcacactttcgagcagggagagcataacaactcacactacactctgcacggttgacgagcagctgtgacccactccatacactatgaagcctcgctagaccttctactatcatcagtactaatgagtgcatcctagagcctgagcaccgttgtcacaacacgagcacacctctgatttctgatgtcataatgagcgttgcacataccatgagttagatacgcactagctgagaccagccgacaccactgcgacctagccgaaggggagctcgctagct

SEQ ID NO: 496995 - DNA, 363 bp, Homo sapiens
  misc_feature (1)..(1): n is a, c, g, or t
ngctctctcgtgctgctctcttctgaagacccttcagacctctccatgacagcctgttatagtctacagcttctgtcgattcttgtgcatctacagctcagatttgcccatttccgcaaaatactcagtggctcgcttggtagggcctttaagctatatgaagccggggtaagcctgcaagctctgcggcttgggcttgccaatagaaattcctctctcgttgaaagttgtcttgtggatcacacagctttgtggtccttgttctgaggtgctggcgcctcagatcccgctatctgcgtgtagcggacacagtgtcacatagagcctttcaacacattacagatcgcgcgtgtctcgcgtgcc

SEQ ID NO: 496996 - DNA, 611 bp, Homo sapiens
  misc_feature (23)..(23): n is a, c, g, or t
  misc_feature (257)..(257): n is a, c, g, or t
  misc_feature (301)..(301): n is a, c, g, or t
  misc_feature (314)..(314): n is a, c, g, or t
  misc_feature (328)..(329): n is a, c, g, or t
  misc_feature (331)..(336): n is a, c, g, or t
  misc_feature (342)..(342): n is a, c, g, or t
  misc_feature (344)..(344): n is a, c, g, or t
  misc_feature (346)..(346): n is a, c, g, or t
  misc_feature (361)..(361): n is a, c, g, or t
  misc_feature (368)..(369): n is a, c, g, or t
  misc_feature (374)..(375): n is a, c, g, or t
  misc_feature (378)..(379): n is a, c, g, or t
  misc_feature (393)..(393): n is a, c, g, or t
  misc_feature (396)..(396): n is a, c, g, or t
  misc_feature (398)..(398): n is a, c, g, or t
  misc_feature (402)..(402): n is a, c, g, or t
  misc_feature (406)..(406): n is a, c, g, or t
  misc_feature (525)..(525): n is a, c, g, or t
  misc_feature (528)..(528): n is a, c, g, or t
  misc_feature (538)..(538): n is a, c, g, or t
  misc_feature (544)..(544): n is a, c, g, or t
  misc_feature (608)..(608): n is a, c, g, or t
tttctatttcattattagttatngttcatatcttactctgcctaacttataaactttaacatgcatatgtatgggaaaaaaaacatagtatatataaggtttggtactatctgcagtttcaggcatccactaaggatatcagaacatattctctgcatatttaggagcaattaccgtatgatatttttttctttctgtgtaaacacatggtgtcatagtccattttgtgctactgtaacagaatatcacagactaanaacaaataacagaaatttattggcttatagttctgtaggctganaagtccaaaatcnagacgctggcatcnngnnnnnncttttntntngcatcgtcccacagnggcaggnnggggnntgnnagagagagccaganggngntgancttncccattttataacatcaccaatcccaccctaatcacctacttaaatattccacctattaaaactgatatcaatggcaattacaattaaaaatgagatttgcaaaaagaaaacattcaanaanaacacaaagnataagngagaaatgaaaagtaaggaaaaaagagcaaaaaaaccataaaatatacaatccagctgtattgntgt

SEQ ID NO: 496997 - DNA, 308 bp, Homo sapiens
  misc_feature (66)..(66): n is a, c, g, or t
  misc_feature (83)..(83): n is a, c, g, or t
  misc_feature (99)..(99): n is a, c, g, or t
  misc_feature (102)..(102): n is a, c, g, or t
  misc_feature (172)..(172): n is a, c, g, or t
  misc_feature (209)..(209): n is a, c, g, or t
aaaggccccgggccggggagagctcggggaccactccgaccgctcctctgtcatatcatgtccgcngaaagccccgggcccanctcccttggagtcagngcngcaactcgtggaaattgattccctgtctttgaacagggagtttgggtccccgagcttgatgtgaaaggcntcgatgatgaagatgtggatgaaacgaagatgacgtntatggaaactcatcaggacggaagcacaggggcccactcagagtcgcccgagatcacgtcactgcactccaggaagggcaacagagcaagactccttct

SEQ ID NO: 496998 - DNA, 229 bp, Homo sapiens
acttatcccagaccaccatttccatcctcccccaaaaccccctgggtttccctgggtaccctttagccccggggcacgtgtgcatgggggcatgcctgcatatatagctatcccccctgtatttccccaagccccacataatggttcagtttggtaaggaaaaaatgttaattactgcaaatgggttttaaactgtaaaaggacatttaaccaactttgtaaagtgtga

SEQ ID NO: 496999 - DNA, 128 bp, Homo sapiens
ccgggccgtgtgctgctcatggtggggtagagaaccaagtgggctcttcgggtttccactttcaggccttggctcttagacgcactcactgggaccgagcctgatggcagcgcgcgtggatcataccg

SEQ ID NO: 497000 - DNA, 709 bp, Homo sapiens
ctccgtgctgtgcggacttcaccagacggttggagattggcaccagacattggaggtgcttgtagatggtccaacctcagtctggccccatagcgactttatgccccatgattctgcttcactgcttggcaactcctctttgaagttcccccgtctctttgctaacagcagtgacaggaagagaacagagacaaactctttggcactgtgaacgagaacggtacgagaattccaggcaacacctctgaccaagggtgtaaacccagtcttattatatatatatttcttcctcttgaagttaaaacctagcacgtgttgtacttcttatcctcttcctcttcattacttaccacttatctttcttctactattaacccctcttatatactccccttataggccacacagcctatgagcacctatatctctctatacatctattacacaaacacacacaaacacaactatacacacagacggatatagcgcggacttatccgccgtggtccaacgagtcgtctctgtcgcacatgtcgagcaagacaccccagtgtactatccccctcacgtgacacagaccccgcgagcaagcgaatcaaacgtgtctgcactatcgcctcggtgccacaaaagaactctcctactcaatttcccgccgctgcgctgcatctcgggccccccattctcccacagagacacaaacaacgac

SEQ ID NO: 497001 - DNA, 203 bp, Homo sapiens
ctgagagatgggcgcttgcttttcttcttggtttgcatgtgcggaataagcagaaggcatctgcgtccacgagccgcagcgggacagtgatggcctcgccaagccaagacatggaaatgcccctcattaaccaccacacccagtaaattttcatatttttagaagagatggggttacaccatgttgaccgacggctcaggaaa

SEQ ID NO: 497002 - DNA, 124 bp, Homo sapiens
gaagaatatctgaaagcgggctgtttactaaagacaagaggtaaaagttggctcagagtttctgcaggctgtacaagaaagctcagtaggatctgcttctagaggagacctgagcaatccaggc

SEQ ID NO: 497003 - DNA, 252 bp, Homo sapiens
atgcatgtagtgaggacatggatgtccccagaatacccacatctctccggagcacagcgaagaccttggttaggccgcgctgtcttgctcatcctgtcaagaagcaggtgcagctgccagctctggaaggaaagccttcttttgcagagaggtagagtagagaggggaagggagaagtgagagtcagcaatacagcgtatgaatcagacagctgagcttccagggttgttttgtgtcctcactacatgccat

SEQ ID NO: 497004 - DNA, 939 bp, Homo sapiens
ggcccgatgcgtcgtggatgcccgcgggtctgccagatgtggaagactgaggctgttgaaagtgcagagctcagccctggcgaccctctgttcccaagagctccatgcaggtgccacaggatggagaagaccttgctgtgcaaccttgtgtaccactggctcctgtcccgccagaaaagtagccaggcatggtggcgtgctgcctgtaatcccagctactcgggagtgctgagacagcagaatcgcttgaacccagggaggcagaggttgcagtgagccgagattgtgccattgcactccaagcctgagcaacaatggagtgaaactccgtcccaaatgaacaacaacaaaaaaagaaggctgaagctcttcttcagcaaaatggcgacttcctggttcgcgcctctggtggtcccgtgggggcaaccccgtgatctcctgccgctggcggggctcagccctccattttgacggtgtacctgttgtggccctgctgtccccggcaatgtgcctgaccacaggcctctttcaacttggaggattgagcaattccccagcatacctggctctggttcacagttatattgacatggcaggcgcccactgtcccaggcacaaggggcttgtggtctccaggcctgttgacttggcaggggctctgctgaaacgcagctttaagccgatggacaacccttgatgggatgcgcccagctcggagtacgaagccttctccagggcactggacacgtgggaggcaaccacgccacgcccgccagaatttggcacctatttggggcggccaacgagaaaaccggttgggatgtgcctcaaccaaggccaaattttgcttgccccgaacgaacagtgacccgggtctgaagccctgtccctggacttggtgcgacagccaggcccaggcgagttcacccagccaagaaa

SEQ ID NO: 497005 - DNA, 1201 bp, Homo sapiens
aagtaggagaccgctgtcaatcttgcctggacagcaggaaacaggtaacacgcgcttcggaatagacagccaccgtatcagattgaccctgacgcctgcttctcggctaaagtagaacaactccagcctgataggttcaggactacactcagactctaacagccagcgtattaaacctgacacctgtcagcctcttctggatggcaaggaaccgtcaactgctggctggccacaagcttgagtctagtgacatggaagtcctcaagcatatagctgaatactgtacagacttgtgtaatttgaatacttattcttgcatgcatagctaccttcagaatttcagtgtattcttatataactgttgtaatgatctgggactgcagagatatgcgctaagatatgttagccctccagggtttaagaagttcgagttcacgcatttagaggactgttagcccttccagagcgtaccagaacgaagacctattgtccagaaaaaaaggtcctttacagtggtgagacctcggagggagcaactctgtgctggccccttgttgtagtatgccagggtcttgcttgtgtatgtactctgagaaggatggtctgtcaaggtcggaaggcggcatcacaatatgtagcgcaactttgtcaacattacactatctgatgtcacatactgacattgacaatctgtgcacttgtccgtgacgaattcgaagacgcttggttaccccgtagacccgtaattgagtgagcaggctcgctgccttgatggtagtgtacaaaactcaccctgaatgggacctttgtaagacagatcttccatgaccatgtgacccaccccagttcatcatcaatctcttgtaacaccaaaaaggtctcgcaggggtggtggcgcaaactgtcgtcttatagtgcccaattttgggggttgaaagaaccggtgcactgtgcattggaaggcccagatacaatgccagagaactttgactccctttcgtggccgctaggatggtactgagttatagtggccccttggccaccaagaagttattggacaaatacgctttcacagggagacctcccagcgtcaagatagcctggaaaggacgttctgggcggtatgggttacatcccatgggtgacaaacccactacgacatgcctaaggtggccatccaggatgactactacagccgtca

SEQ ID NO: 497006 - DNA, 392 bp, Homo sapiens
tcactgcctacgacggctaggactactagtactatgttgaataaaaatggtgaaaatcggcatccttgtcttattccttatcgtatgatgttagctatggatttgtcatatatggcttttattgtgttgacgtacatatcttctatacctaatttgttaagagtttttattatgaagggatgttttgaattttgtcaaatgccttttctgtatctatcaaaagatcatatggtttttgttttcctgttaatgctatttatctcatttattgatttgcatatattgcactatccttgcattccctggataaatcccccttgatcttattgaatgacatttttaatgtgcttttgaatttggtttgctagtatcttgttgagaatttttggatt

SEQ ID NO: 497007 - DNA, 375 bp, Homo sapiens
aataaattctttttttttcagagacaggatctcactcgtgtcacccaaggtagagtgcaatgacacaaccatagctcgactgtaaccttaaattcctgggctcaagcaatcctcccacctcagcctcccaagtagctaggactacaggtgtgtaccaccacacccagctaatttttttttttttggaaatgtggtctcccatatttttgcccaggcgggtctcaaactccggggctcaagcaatcctcctgcctcggtttcccaaagttgagggattacaggcttgagccatggcaccaggccaatatttatttcttatcctttttagaaattgcagaaaatcctaattgaccagaatatagtcggctacttgac

SEQ ID NO: 497008 - DNA, 118 bp, Homo sapiens
gtgactctgtaaaaacccatttcaggttaaaatgcgcatgttttattgaatctcatgttaaagggtgggttaaacttcaccaattggggattgcctggggttaaccaagttccaacaa

SEQ ID NO: 497009 - DNA, 250 bp, Homo sapiens
gactctagacgactccctgagacgaccgtgttagcatgcctatcgaagggcttcacgcggccaggagtttcttattgttgcggcaggttgatgagcacttgggtattgtcttgactgactgtgtgagcacggagagtggaccggtgttaaattcctcctcctctcgcttctcgagctcctctgaggtcatctcactcatgggcttgtagaggaggctcatgatggtcactcattgcaacacggtctctca

SEQ ID NO: 497010 - DNA, 121 bp, Homo sapiens
cccccccccccggggggagaaaaaaaaaaagaatttaaaagaataatttaaaaagaattaaaaaaaaaatttttaaaggaatataacagggatttatatcgtaaggtaccggaaaaatttt

SEQ ID NO: 497011 - DNA, 169 bp, Homo sapiens
agattaaaagcacaagcgtgtttttagagaacagttgagaaagaatctcaacatctctctctggtggtttgcttgttttccgttacaggtggggcatgtcctcatcctttcctgccataaaagctatgacacgagaatcagaatattaataaacctttatgtgctgcta

SEQ ID NO: 497012 - DNA, 437 bp, Homo sapiens
  misc_feature (58)..(58): n is a, c, g, or t
  misc_feature (117)..(117): n is a, c, g, or t
cagcgtattgatttggcgtaaacaaggtttggctcacatgcatattgcctctgaattnacgtttggcagtccactgtggcgggcacaccacacttaaatccgttaaacaggtctttncaggtgaccccgtggaaacagttattaggagaacagtcatcaatgtttgtagagcatgtggggccggtccagcctggggaacactcacactcataagcccagggaggtctccttacatttgactctgttggtgacagggatcagagaggcaggcgtgctcaggcaaatttcacaggtggggttccttgaataccccctcagggcagggaacactgaatatttgtcaggggcctgtgttgctacaagtttcccccggttgaagacacggcttgatgagttcccacagtaattggaaatctttgtcacagaagcttggcagc

SEQ ID NO: 497013 - DNA, 232 bp, Homo sapiens
ctgctgctacccttcactgcaatctcacctattcctcatccactgtctcccatccagcagcctcccctatcctggtcataccaccccccagacactacctactatactcgcatcccggactccccagcccaagccgcccacttcacagatctcaccgcatcagagacctcctcacccccggaccgcctcttcacaaactcctccgaccctccctcccgggacactcccacga

SEQ ID NO: 497014 - DNA, 267 bp, Homo sapiens
ctgagaggggggacagagcgagatcatcccaaaaaaaaaaagagttctggtctttttctagtaaagaaaagggtcattctggtgggcatattacagtcggcattcgtttcttttcaacggagtagcatagtctcagtagataagaaacaggtgcattcttacctcaccttcttccggccggtgttacagaattatgtgaatatggaatggcgttggcagttcccatttccttcctccagcagcggtgcccacccggtgggtgggcgc

SEQ ID NO: 497015 - DNA, 685 bp, Homo sapiens
agcggagacgtgcttcgccgagagtcgtcggggtttccgtgcttacagcagtgcttggacggaacccgggcgctcgtgcccgcactcccgtggcgtgcgctaccagcgtccgacctcgtccttagtgcgctcgcatgactgaccgcagtcgaccttcgcaaggtgcgccagaatgtaccactcatggacttcagaggcgcgactagtcaacgcgatcagatcaacctggagctctacgcctccgtacgtttacctgtccatggtgagcgcgggcgggcctaagcggtggctgggtggccgggcgcgggttcccggggcgcgcgctgtgggcgggccgggggtgtggccacccgcggggtctcccgcctccctgcgcccttctggaagaatggaggctgctcgacggtttccgaggacttctctggcgcaagaaagtcggggccagctgggttcttctcggctgtaccctgagaatgctccctcctaggccaggccgcctctgcacacccgttcttttccacaaggacgaccttggtgtcctgaaatcctggggttgcaagactgccagcctgtgtgatcaatcctgccggttaggaaggtggagtaatgctttcccatcttttcctctgactccggcatttggccctacatgccagcgtatcatagcttaggtatccagctcccg

SEQ ID NO: 497016 - DNA, 296 bp, Homo sapiens
tgtcttcccatttcttagctatgacttagcactcccatcagtttattgcttgtcatgattttatttattcaagtgtggagtaggactaagtccctgcagtgtgacctcactgggtggtagatgttataaaattagccacaaactttctggaacagctgtaaagcttgggttatttttcactttgcttagaagtctgcttagttttgacttttaaccttagcctcttctcaaagataagattatttaggaaaaaaatctgggtttaaaaactatagcagtacataagttggtgtgga

SEQ ID NO: 497017 - DNA, 206 bp, Homo sapiens
ggtgcagcattcttctggcatatgccgccctagacccttgtgagccaagatgtcaaaagagaccagagtcatccgcacagtagaccatatgtcaaattagcgtaactggcggaacccagaggcatttacaacaggttcgtagaagattcaagggccagtcttgatgcccaacattggtaatggagcacaaaaaacaaggcctgctg

SEQ ID NO: 497018 - DNA, 369 bp, Homo sapiens
aaaaggggaatttcccttaatgaaagggactctgcttttattcatcaaattgctttgaaggtggaaatattttctggtgggagggtatttattttaaattggaggattaatgacccttgccccatctgtttcttgattggggttggtaaagttttgaggtggggattttatggtcattggtttttctctgggaagcaattttttttccctttattagatctaacctgcaggggattttttaggctggaaaggggaaaatgaaaaatattataatcttagggtacaaaaagtttttaaagtttcaaaaagtcttgaaacaaaatccgtttatattctgaaaatatttataataaaggattttaatttcta

SEQ ID NO: 497019 - DNA, 299 bp, Homo sapiens
  misc_feature (26)..(27): n is a, c, g, or t
  misc_feature (167)..(167): n is a, c, g, or t
  misc_feature (228)..(228): n is a, c, g, or t
  misc_feature (236)..(236): n is a, c, g, or t
  misc_feature (280)..(280): n is a, c, g, or t
gaaagtaaaacaattttaaaaatttnntcaatagaatattaaataaatgtgggctgggcacggtggctcacgcctgtaatcccagcactttgggaggctgaggcgggcagatcacctgaggtcaggagttcgagaccagcctggccaacatgatgaaaccccatctntactgaaaatacaaaaaaattagccaggcgtggtggcgcatgctgtagtcccagctacttnggaggctnaggcaggagaatcgctttaactccggaggtgggaggctgcactnagccaagatcacaccactt

SEQ ID NO: 497020 - DNA, 724 bp, Homo sapiens
ttaggctaggtacgaggccgggggtgaatcggccgaggctctgcaggaaaggagacacttgctccaggaagccaggagcccagacccagagatagtgcctgcaggaggcgcctgttggaaactcactttccgagctaagcgaagaaaattttagatggaaaatttgctaatctgaccccctcgaggacggtgccatgactctgtgagtgcccccccagggtgggatcgtgcctgactcgggtcccacgcagccacctctgtctctctcaccctgctccctgaaacaaatgagaccctgtgacatgtgcatgccaatgaaatgaaactgcaaggaacctaagaatggtgtgaatcctgtgttctttctgttgtgctacctggacaatgaaaaatgacagaagcttattttgccagatgacaatgaacaaatcgatttgttttgtggatgaaaagaaacaaccagttgtggtgcactttacaatgatgccatgaatgaggatgaaggaaatgccccgcccccacctccaacctcgatgcccaaagactgtgcaagctgccccgcctgccctcccagtggcctcctggagcccccgtgaacatgtactctagaagagcagcaggaaccagagctctgctactgttagacgtcctgaacccaatgcgggacccagctggagcagagcctggtcacgctcctgcggactttgtcgctccactcgcgcca

SEQ ID NO: 497021 - DNA, 198 bp, Homo sapiens
agatggcgagtatggtagtggaccctcggtgtgtgccttgcatacgcggaggcaccataccgaattcgccgttctgcactgaggtccgatatcgccgatcttcacgatcggcgatatcgattcacacgccgaacatccaaactgcacacgccgaaagaccagacgccgcgagcccgtaatcgccgatcttcacggggt

SEQ ID NO: 497022 - DNA, 465 bp, Homo sapiens
ctgttttaaaaatgtactcctggccaggtgtggtggctcacacttgtcatcccagcgctttgggaggctgaggcaggtggatcacttgaggtcaggagtttgaggccagcctgggcaacatggtgaaaccccatctctaccaaaaaaacaaaaattacacaggcgtggtggcatacatttgtaatcccagctactcaggaggccggggcatgagaatcgcttgaacccaggagggggaggttgcagtgagccgagatcatgccactgtgctccagcctgggtgccagagcaagactctgtctcaaaaaaaaaaaaagagcactctgcctatacacctgttacacacatacacacacacacacacacacacacacacacacacacacacaaaccactctacattcttgccaatttataaccaactgaatgtaatgggcaagattctttaactttccctcaattaag

SEQ ID NO: 497023 - DNA, 143 bp, Homo sapiens
cagaaactggctgctgagaacaggctttgcagagcctgatgggagtcctcccagatctcgtagtagaaattcttgggggtgaaccaaatgccgcctgagctggggcctagtctggagtaactcaacaaccccttataacaagg

SEQ ID NO: 497024 - DNA, 1131 bp, Homo sapiens
ggatccggagctctgctgctgctcagtgggcctgcgcaccatgtctggctgaccctgggaggcgtctgagccccggcagcgcccggtgccacgcaaaaacaatggggtgagatgcgatccacaccctctgggctgcttccgtgcggattccctgtccattgaagaaacgctggattggtagttgaggatgacaatttaaatagcaagattccgttcgcgctacatgtaaaacagacgacctcggaaccacgtgagacacccgagacgctcgagcactggcacctcgctcatttgggtgttctgcacgcgctgtagaccttcagcctacgtaggctccagtattctgatgctcaacttggctcgttgggttcaatctagtccatctcctggtcttttgagacccccatagtgttctctgtctctgtgcaggtccgcgtacgcggagagtgacggagcgcggtccctaccatgggccctgttacatgggctgtaacagtgcacatgcatgtgttctcttgcgcaggttggttccccgtttcagagtaggtgccctgcgccgtgctggtaggctcttatgcgccgggtgaccccgtgttacatgctttgttgtgctcggaaccagtgtaggtcctgtgcttggtttcccaggcttctctagtgccttttctcactcgggtagcctatgtggggagcgttgcatcacgtcgtggttggcgatgccggcaccgatatcctgaaagcctgaaggctgtcgtgcttcttcccgtctagagtcgggcactcgtgccttggacgtcttcgtgtccccagtcactggtgcttggtctgcgtgatctccatgctgtgtcgctttgtcttcggtgtaccgtgagagtgaaagaggcttgtagctggagaacctggatgattcctgcgtgctgacttgagcctgatatccctgtggcacaggcacgagtgccagctagtgagctgcgatctcggacaaggccacaatctcgggaaacgagcgaattggagcgtggcttggcgcatcatgtaggcgcataacactcagcatggcggcgcgcacgagacacacggctaacattcgaagcactcctcgcgttggtctcctttcggcacgaggtccct

SEQ ID NO: 497025 - DNA, 110 bp, Homo sapiens
cctgggagccgttgatgtcttcgcctgcataggtccatgctcgaccccgccaggcccgtagtgcttcagtcttaagcttctcctcggggatagctcaccgcaacttaaat

SEQ ID NO: 497026 - DNA, 550 bp, Homo sapiens
accaggggggcggggaaccaccccccttggtggaccaaaggcgccccccctgggggccccaatggcaagggcggcccgtgccgttcccccgagaacaccccggtgggtattgggcaccgaacaaacccagccataccacagagaagccttgtacgggcgaccaagctctcgttgccacggagggccagaaaatttctggcgccccaccacaaagactccaaactggggtgaaaagagatgaggaccctgcccccaccccccctcgccggcccgcgcacccgtttctgccccgcgcttgcgagtcccccgcagcccaccttcttcgcgccgcaggtgctcgccggtcggtttcgcccgtttgcccaccaggccacccccggcccccctccgcttcccctgttctagcaggccgtgagcatgatctgtcttcactgcgcccttttcgccccccgcgcccttgtcccctctttctgtgtggtgtggttctgtgccattcgtcgttgtggggggggaaaaaaagagaaccgttcctaaattcccccacaaaaca

SEQ ID NO: 497027 - DNA, 828 bp, Homo sapiens
taattattggagacggagccttgcgctgtcaccgaggctggagtgcacttggcacctgtcttggctcactgcaacctccgcctcccgggttcaagcgattctcctgcctcagcctcccaagtagctgggattacaggcatgtgccaccatgcccagctaatatatggtatttttacgtaggaggtgaggtttcagcactgttggccaggctggatcccgcaactcccgaccttgtcatcctcaccaccgtatggcctcccaaagatgctggcgaccacagcgcgctgaccccaccaacggaccggacctgctataagccctccactcagtggccacattaagacacatgcatctaacaacaccctctatccataccaactgctcaccctcaaatttacacagagcctctaattcagactcataccatactggcatcccataaacatactgcacgctccaccaactccaacggacagcgccacaaacatagcgacactagccttcctcggcagaaaaagaaagcctaagcccccactaagtaccaccaatcttctccaagcctcgcgagaacaagagcgagaagatacacaccgcacgggctgcgtaccccctttactgaccaccagggcaccaccgccagaaacaacagcactaggacacctcgagcacacctctacatcatcaaaatgacggcatccaattaaatcaccaacagcaccacagccgccaccatacaccagatagatcaccaaaacaaccacacacaacggacctaactagcaaaatcgcgacaccccacgaccttccccacggacccccagaccacac

SEQ ID NO: 497028 - DNA, 300 bp, Homo sapiens
  misc_feature (140)..(140): n is a, c, g, or t
  misc_feature (283)..(283): n is a, c, g, or t
agcattttagggcggaagcgatatccgagcaggatgcggttcgtggttgccttggtccttctgaacgtcgtagtggtgggagccgtgcttgtattggtcaccgaaagcgttaagtaagaagaagctggagtacggtcttntgcaggaaacgttttcacccaccctagtttgagtcaacggtctggaggctttaccaagttgtattcggagccgtagactccaaaagacagtcctagcaagttgagtgcggaggcgcagaccccataagacacctttaacaagnttggttgcggaggcaaa

SEQ ID NO: 497029 - DNA, 300 bp, Homo sapiens
  misc_feature (257)..(257): n is a, c, g, or t
gtggtgggatcatggcttgctgcagcctcgacctctcgggctcaagtgatcctcccacctcagcctcctgagtacctaggactgcaggtgggcaccacactgcatggctgatttctttattttaattcttgtagagatgaggtcttgctgtgttgctcagactggtcttgaactcctggcctcaagcgatcctcctgccttgacctccctaagtgctggagtgctgagattacaggcctgagctgcggtgccaagtncacttctgccataatgcatttggtgtgcagtataaggctatcc

SEQ ID NO: 497030 - DNA, 248 bp, Homo sapiens
  misc_feature (91)..(91): n is a, c, g, or t
  misc_feature (180)..(180): n is a, c, g, or t
tgggcaattcgggaaaggaaattctgtttagaaccaacttatctcaaaattggaaccgggggcctaactaaaagggaaggcttaaaaaaanaaatgtcggttttccctcggggaggccaaaataattttggcttaatggaaattaaaaaggttctttttaaaaaacttggtagatgactnaatgttgaaactcttaatttgggaagggatgtatctctgcttaatttttcagattaaaattctctttg

SEQ ID NO: 497031 - DNA, 1293 bp, Homo sapiens
  misc_feature (348)..(348): n is a, c, g, or t
  misc_feature (620)..(620): n is a, c, g, or t
tcacactacaatagttaattttattggtatcaagagctcagatggcaagctttaaaccaagcaataggcttggattcgtggtgagcccaaatttcacattatgtgaagaagatcaaagcaaacgtggtgatccagtgtacatgtggagtgaaaactaaaggcctcgagtttaactcacattgggtagttttaaaattttctacaggcctaagagtctcatctaagtcaacagggtctttaagggtgcctttctgggatgtgtcgccaacaggggttatctggcatcttttcttggagctggggcaacctacatcatccttatagcttctgggttggataaacggctgnggttaaatcccccgggggctattggaggagaaactatgggaagggctcaggagaaagatcttccattgctcgcaatgggcgctataactatcccctctttaaccattggttggacacggggatggatatcctgggtataagaattttttcaacacaatggggtattcaaataagaatatcagagccaacacacttaatatccaaaataagccccaagttgggtaatttatcctgtttagagcttggtaattgacttccataagggcccactnttacaaaccgaccgatctttttagttgcacttttcctttcccaaatttttcacactactccagtgggtccaggttcccccaatgttcgaggaatttcaaatttcccgtggaggaaggaaaacagcgtgggcaacattttccaaacccgaagttcccaaaacagggccacatattttggagttcggccaagggtttccccccccaaaaattccattccagtgggcaagccgtgctggggggaattgaattggcccaagtttttattacagcccaataaggggtcaggcgaaaaatctctaacagaaattcccaggaattaatctttcccctttcgcaattccacggcgggtgtgtgtggggggaaaatccccacgctaaggttctcccggcggaaccaatacagcgatacaaaaggtggtcccggcgggttggtgggaacccacaacttttgtatgcgctcacagagagcggccttgaacaaccttggaggggaaaacgaaaacatgagaaacaacaaaaaagtctggcacaagagagaggagtcccccatcttagaggacacccccggaacacaaaacctacaagggggagaaaacaaacatcgcccgaagggtgggaaacaaaacacccgagagaaacaaactatacagagtcacgacacacaaggaacgaa

SEQ ID NO: 497032 - DNA, 143 bp, Homo sapiens
tgactagtaacatcagcacttaggtcatcagcgtatagtatgtggttctaaccaggtccagaacagaagaataagccgttagcaattacatctgggcaagtcagggagataatacattatggcctgagattggaagactataa

SEQ ID NO: 497033 - DNA, 342 bp, Homo sapiens
gggggggcccacccccccccccccccccccccggggggggttttggggggggtctttcccccccccccccaagagaggggccccctttttttttggggcccccccggggggtccgggggggggggtttttttttttttaaaatcccccccccccccccccccggggggggggggggggggggcccccccccggggggggggggcgcccccccccctttggggggggggggtttttttttttttttttgggttcccccccccaaaaaaaaaaaccgggttttttttttttatattttttgaaaaaaaaaaaaaaagggcccccaaaaaaaaaaggggggggga

SEQ ID NO: 497034 - DNA, 737 bp, Homo sapiens
gtttttttttgtttttcttcattaaaaccatttaacaaaatgatgtggggaaagcaaataaccctgaatgacttggaatctgtggatagtgaatattacaactctttgaaatggatcctggaaaatgaccctactgaagctggaacctcatgttctggcatagaacgaaagaaaaatcttgtggacagactatatcaagtggtatttgaaagccccaagtgggtcagaaaataatggtcacaaatgaaaaacaaagagggaaattattatcgatcttagtcatccaggtggagaattgtgtgaacagggtctccaaaagcaaataaacgccttctgggagggattcacagaaactactttcctattgtgattgggattaaaattttggatgaaaagtgagcgtggaggtgtgctcattgtgcggccgtccggtgatgtgcgattgtgaactgacgtggagacagcatttctatttacaaaaacggttacgtgcccaaaccaccccgtacattcaggggtctctggaaggctgtgctactcatggacgccgaaaagcgtatccggtatacggcttttggtcacgggacatcgcgagtacctatgaatggatttgccgactttttggtcccaagggtccccagttgtttaccataagagcatggggcagcctgaaaaatgccagagttcacaatgtttaatcggctgaattactcctttgaccttggaaattcggaaaa

SEQ ID NO: 497035 - DNA, 182 bp, Homo sapiens
gggtactagaggatccatcgcagacagagccttatagtcacaatgatgcgtttgtcacactacttgcgtacttttatgtaacagtaaattctgaatcacttttatagtaaagaaagaccagaggaccatatttccctgtcaatgaactttcatacactatatgaagatttcccacatctgtc

SEQ ID NO: 497036 - DNA, 732 bp, Homo sapiens
gcttgtgtgccagtctactggtaccgtgacccgtcctgcaccagcagactctgccaggctcaagggacccacctgtccagctacagggcagcccaaatctggtccctctgaacggccaggacctccgcagaattgggccctggcatgaggcacgaggcactaagcatgtgaccccaggagggcacaagggcagtggtgctcagaatgggccttccgtaggcccaggtcactcatgttagaagggctggtgagcagtcaccacagccctagagcccgtctgacttggatgatggcgagtgtgttgcacacctcactcgcccactcgctcgaccaccttggatgcaccatgcattaagcgtgtattgcactaagcaacctccacttgccctgaggccccctgatggctccgcctcacgtggagcagcatgaggccgaatacgaatgacgcgactcatgcaaactcgtcagtgcctttcgcgacgttcctcgccatcggtgatagcccggagtatctcgccaccggttcccttgctactctctatccacaagctagcgcgtctaacgtcggggtccctccaacaattatgcgcggaggacgcaagaccgaccattgtcccaagtggacgacgcactggctcactttacctagaaatctacactgaccgagcccataacaaagaacatccatcggggctcatgagtcactcggagccacatagcgggacacagcac

SEQ ID NO: 497037 - DNA, 1475 bp, Homo sapiens
gatcgacggtgcactgcgctcagcaatggatcaagtacggtgacaccactacctcagagggcgtcctcttcgcccatctactccgccctgcattgggcgagagccagtgccggacggacagacaccgcactcgcctccgtgcagatccatgtgactggatgtggggtgaaggccattcagagtgtgctgtcgatacgatgtcagcagcgagttgtcagcaacgccgaagcaatgcctggctcccaacaaagactggtgcaaggcttgtgctaggaccatgcaagaacagaagcatggccccatgtgcgcctgcgtgggtctacgacacagcgcacacaaggtgaccatcatgaaaccatcgggacaccatgcatctaacattgaagcccgcctatggaggtaatcataggagagctgacggggaaacaacactataccagggaacagataggagacgaagtaaccatgcagacgacgcaatacagagaccagcggggagacgtaagagaagacccaagtgggaaaagaaaccggaagagacccaaatggaggaaccacatggaaaaggggataccaagaacgagacaaaatagaaacaacgttcaggaccaacaggacacaagcgacagtcaaaagaacaaatatacatacacaggaggacaggataagaacacataacacccgaaaagatcagacagaggaacaggaaattcacaccagcatatgagaacacacacgacgacaccataatacgaaaggatagcaagatacataaacaaaagcaccagacaagacagagacaccaataggaaatgaatgaggggccccagaaaggagcacccaaagtgagacaacagcgactatggatacccaaaagcaaaagaggaatgggacataggaacgatgcgacaagtacagggcgacctaatgcagaagagtcaggagagcccaaaaggataaccacgatggagaagagaggaggacccacaagcaagacatagggctagcagggaagagacaaacaccaacagagaggacgatgaaccatgtcacaaggagaacacatacagtgagatgacaaatacgggagcaagcacgaacagggaaatacaagcccaggagaatgtagatcgggtacaccaagggacagccagacagaaaaggcaagacattgaaagacagaagaaccaaaagaatgacagaaagagcaacaaatccgagagaggcaatgagcaaagagacacacaacagcaacagaaagacgagagacaacaaacagacaggaaaaacagaaaaaaaaaggagagacagaaaacgagaaagagcgcaccacacacaacacatatcaaacagacacacaaaggacagcaaagaaaagggacgataaaaacacagaacacgcagaaacatgcaagaaaagccaagtagatacagaaacaccaacacagagacacacaagcagaggacaacacaaa

SEQ ID NO: 497038 - DNA, 107 bp, Homo sapiens
ggaagcaagatgggacatatattgcatatgcacaaaaggttaattcagacactggccaggcatggtggctcatgcctgtagtcccagcatttgggaagcccaggtga

SEQ ID NO: 497039 - DNA, 481 bp, Homo sapiens
acgttattctccttcctaaaaacctcccgagtagctggcactatagggacacgacaccatgcccggttaatttttgtactttttgtagagacagggttcaccatgttgtccaggctcttctttagctcctgggcaaacgatctgcccactttggccttccaaagtgcttggattacaggtgtgagctaccacgcccggccatgtaaactcacttttttggttttttttttttgaaatggagtctccctctgttgcccaggctgaattgcagtggcgcaatctcgtctcacccaaacttccgcctcccgggttcagccaattctcttgcctcagcctccagattacctgaaataataggcttgcaccaccatgcccggctaattttggtattttaagtaaaaacggggtttcaccatttgggccaggctggtcttgagctcttgacctcagttgatccaccccccctcatcctcccaaagtg

SEQ ID NO: 497040 - DNA, 545 bp, Homo sapiens
  misc_feature (8)..(8): n is a, c, g, or t
  misc_feature (543)..(543): n is a, c, g, or t
agtgagtnagaagtgtcatataaaacccaatagcaacgagttgattctgcaccgaggtttgcagaatgggaatgcgacttccctggctccatgacttgattctgcactgacgttcacagaatgggaatgcaacttccctggctccatggcatgttgacgagagtcagagctgaagaccagggagcctgggggtggtatctattggaatttttcagcctcactgatcaaagtagcttggatgagatggaaaagggccagagttcaggcggggggaaatatagctgggtcagaaggagtttcattgacaacttaaggaatagcaactcctctggtattcaatatgtaggtgaagctaaagaggatattgggaatgtgtgcaggaagcctcatgcaagaattttcacagtggcactgcttgtaataacaaaaacattggaattaactcaaatgtccatcaagcagagactggataaatgtacgggggtgacttgcttaatggaataatagacagtaatgagagtggaataaacaagagctacatgnat

SEQ ID NO: 497041 - DNA, 112 bp, Homo sapiens
atacgaatctagctcgttacccaaaaaacactgtccttcaaagaaaggtagtggcagtcagacatcaatgcaaaacttggaatgattagatataaacatggcacttacaggt

SEQ ID NO: 497042 - DNA, 177 bp, Homo sapiens
gaaaaccccccccccggatttgggcgggaacccggaaagccctttccccccaatggtttcccccctttttaaaaaaggcccaatttttaaaaaacccaagccccggggggggggtcttttccaaaacccttccccaggcccccattatttttttaacccaaaaaaaaaggggtttta

SEQ ID NO: 497043 - DNA, 184 bp, Homo sapiens
ttcgagctgctcgaaggggagtcagatgtagtctgcaggctgcgatcatcgaagtacgccgcagggtcccttcgaccgtatgcttcatagccgaagtacgacaaacattattataataaacgccctcaccactacaatcttcctaggaacaacatatgacgcactctcccctggactagagtgg

SEQ ID NO: 497044 - DNA, 102 bp, Homo sapiens
accgtgcacttccttctgagagagaactgtgccagtggagggctgagctccaccctctccctcagtctctaagacactgaagccatgctgtgctctcaccat

SEQ ID NO: 497045 - DNA, 491 bp, Homo sapiens
agcatgagactgtagacccgggaggacggtcactcaaaggcagttaagttggggcagcagaacgggtggaaactccaccgagtagagaaacaagtgccagggagtctgcgaggagaggcgcttggaggtttggtgaaagaagcagtaggacagggggtcgctggccaaaaacccctaaacatgtagaagaagataacgaaaggctcagagtaattaacaatttttatgttagtgaagcaacatgtgggttatataaaaggtcccgggttaactgaacagacaaagggagcaaccaactaggcagagaaagctgtgaaacaactatagcataaaacagagtctatctatgccaagtttaggtaaaaaatttgatcagtgacagtattgagtgatgaaagatctaggagggaaatgcagcagcacctaacctctgcttggtatcacaactaaaacttaagtttacacccccttccaagtggaaagggaactat

SEQ ID NO: 497046 - DNA, 500 bp, Homo sapiens
  misc_feature (31)..(31): n is a, c, g, or t
  misc_feature (104)..(104): n is a, c, g, or t
  misc_feature (130)..(130): n is a, c, g, or t
  misc_feature (186)..(186): n is a, c, g, or t
  misc_feature (189)..(189): n is a, c, g, or t
  misc_feature (214)..(214): n is a, c, g, or t
ccccagtctccccccttttttttaatgagtngatttgagctggaaagcagccgtttttccttggtctaagtgtgctgcatggagtgagcagtaaaagcctcaancggcacaaatgcccctccacgtttgntgggtttattttaaagaatgggggtggggaggcaaaaaccagtgtttagcgcgggnctnctgttccaaaaagaattcccaccgnccagcttgtttgtgaaacaaaaaagggttcccttttcaagttgagaacaaaaattgggttttaaaattaaaggaaacctttttgccttgccttcggtttgtatttagtgtcttgaatgtaagaacatgccccccgggtagggtttgtaaacccttagttttttccccaaatgcttgtgatttttgaccaaaacgtgaaaaatgcaagcccctgaatttttgtttgaatggggaacaaaagctggttttttttcccttgtgttagtaataaacgtcttgcccccata

SEQ ID NO: 497047 - DNA, 1398 bp, Homo sapiens
cgacgcgggcacgaggggtgtccgctggaccgaggcgtgcaaagacttccgaggaatcgggaggcatgtactagagaggactctgctgctgttatgtggtggctgctggctgaccctgggacggagtgggacagggtccatgggggatccagaacggctcatcagacaagatgagctccaggaaactgtccagagtcaggggaaagtagagttagcgtcgaagtagatgggaaggttcaagagtgctgtcaacggggctgagaagagatagaagactcgtcataggagaaaaaccacacgaagagcgcaagacactgcatcagtcaaccgtagcaagaagccgaggaaagcacgaagagaggatgcccgtaatacttgaggaccaaggggcaatcagtagtaataacacgcgggaagagagctcccagggagtcgtgctagagtgagaacccatgcattggcccatcatgtgcgcatagcagtgttaggcgccttggccttgtggaccaagagctctgcatcgagggttgcatgagcggccacgcagtacgtgctacggagatgtgggctcagggcgctgggtctgggcccgcacacgcctttgcagggagtttccctgaacacgaggagcttccgccgcgttctgagcttcgtggactgaaatcgggtggagccggcagtacgaacgtgccccatggcgtggcagacacggaccggggaggcgagaacgccaacgataggctggaaatgtgcactgcagggaccagcttaccaggcgcggcgtcggtccaaggccatcaatagtacggaagcatcgttccagggacaggtatctacagcgcggggaagccccgcgagggatgtaggcattaccgcaagttaaccgtggcccttatccagcacgtggcgccccaagcgggaggggcccttcaggttacttgactgttacccaaggtcccggggatcggtccgggaggctttgattggccgtgtctctacggtaagaggcccctgaaacttccagggccatgttccagcacctttccttgcggactagaaccagcggagggtccacagcagggcgcatggggcagtccaggttccaataggaccgggggcatccaaggagcccgggcgaacgaaactcgtacgagaaggggggaactaacggaacgggggggacgggcgaacccggacaaacacaaggggagacaggcgatgaggaacaggtggaagtgcagcggaaatcagggcggagaagcacacacaaaccctcaggacaaggggcgcaggcacaccaggcgaaaggatgcaaaagaggagcaaagcagcgagagcaccagggaggaagagagacaacagacaaacgagcaccggaagcacgagacagcacacgcg

SEQ ID NO: 497048 - DNA, 334 bp, Homo sapiens
tccctaaagaactaaaaatagaactaccattagacccatctatcctactactgtgtatctactcaaaggaaaagaaattattgtatcaaaaagatacaatattgtatcaaaaaatacccatgcttgtatatttattacagcactattcacaatagcagagtcatggaatcaacctaagtgtccatcaatggatgcctggaagaagacaatgcggtatctatacaccatggatactatgcagccgtaaggaagaatgaaactgtcttttgcagcaacattttgcttgtcttatcattacctggaggccattaacctaagtgaaataactcaaata

SEQ ID NO: 497049 - DNA, 109 bp, Homo sapiens
ctgtagtggcgccgcctggtgtggtggttagtcgggctaacaagcgcagctggcgcggggccgggaggcagcggtggcggggtgagccagaggggcggaggaggaacct

SEQ ID NO: 497050 - DNA, 311 bp, Homo sapiens
cgatcctcctccttcctctccagtcacagtctcctcatcatcttcctcctcctcagtcctcgacctcctcgtcttccactacctaagcatcttcatcatactcctcctcatcctcctcctcctcctcatcatccatggcctccacgtcgccctcagcatccgaatcacgggcctccttgtctgtcccggtcatatctcgttgcctgatgtgagtcgcgagcggagcttgaacacattacctcgcaaatcgttcaggttggttacctcgcaattgaaacggtctaagctcttgaggttaactcactttttca

SEQ ID NO: 497051 - DNA, 993 bp, Homo sapiens
  misc_feature (196)..(197): n is a, c, g, or t
  misc_feature (208)..(208): n is a, c, g, or t
aactcccgattttcaaaatggaacaccactttggtaacacaggttagtggggttcaaagggccctgaagttcttccaaaaattaaggattaaaaaagccccgaagtggcccaaatttttaggatgtatcaaaaaattgtccactgattccaagccagtgttcaaatgaaaggattaaaacggccacttgttatgtnnaaatgccctgngcaggaaaaaccacaggagaagttgtgtcaggtgttgtaattaaggtgttcaatcaacctaaagctaaagccaaggagctgggcatagagatctgtcttatgtacatagagattgagaaaggagaggctgttcaagaagagctcctgaaaggcttggacaataagaatcccaagatcatagtggcctgtatagagacactgaggaaagccttaagtgaatttggttccaaaatcatcttgcttaagccaattatcaaagtgttgccaaaactctttgagtctcgagagaaggctgttcgagatgaagccaaactaattgctgtggagatttacagatggattcgggatgctctgagacccccattacaaaatataaactctgttcagttgaaagaactagaagaagaatgggtcaaactgccaacaagtgctcctagacctactcgatttcttcgttcccaacaagaactagaagctaaattggaacaacaacagtctgctggtggagatgctgaaggaggtggtgatgatggtgatgaggtgccacaaatagatgcttatgagcttttagaagctgtagaaatcctttccaaacttcccaaagacttttatgacaaaattgaggcaaaaaaatggcaagagagaaaagaggccctggagtctgtagaagtactaataataaaccccatactggaagctggcgattatgcagatttagtaaaagcattaaagaaggttgttggaaaggacacctatgtcttgttggagcttgggatcctctagaa

SEQ ID NO: 497052 - DNA, 613 bp, Homo sapiens
gagcgaggggggatatggataaactaccaagattggtttataggaaagtaaattttggttctttaatacaaagcttgattgtcctttaaaatttttatctctgaaaatgaattatttctctgtgtgtgtgtacattttctagtttcggggggggtggttcctgttgggctcatttcttatgttttccaggcagtagcagagacagtagttcagactccacatgttctgtcatagagaaacgctctggataagttcttgcctagagagtggtagcttcttacattctctaacagaagctttggcttttccataagcccatgggcctttcatttgaggcaatgctgcacagtcccatgttcattacctaacgaatacatgttggattcctcagtagaacaaagcatgtgatgatttgctgcaagccccatttcatgggcttccagttaatccataattgtttaagagacaatcagggctcttagcttactgtctgagaaccaatggaaggagagattccatgctctatgccacatggagactcatgtcaccgcgcagccagtaagtgtataacagaatatgctcatgctcattcagggttatgaccccatcgaac

SEQ ID NO: 497053 - DNA, 339 bp, Homo sapiens
cagagaaatgacccaggtccaactgtccaattaaagccctgcaatgctgtgttggagctcaggtacaagttcagagaggggttttgtgctgtggagaagttcatgtgttatgtctcgcattctcttgaggaccttttctatgtttaaatgggaatgattctgtgctcaggtcaaatgcatgatttgtgtctggtacctctgcgaaatccagatatttcaataatttgttgatatcttctactacctccctccgataatttctgatttctgtccggccgcacacatctagggcatccaggtcagcgatcagccccgagagcacacaggataagtgcctgc

SEQ ID NO: 497054 - DNA, 683 bp, Homo sapiens
  misc_feature (401)..(401): n is a, c, g, or t
  misc_feature (428)..(428): n is a, c, g, or t
  misc_feature (452)..(452): n is a, c, g, or t
  misc_feature (484)..(484): n is a, c, g, or t
  misc_feature (503)..(503): n is a, c, g, or t
  misc_feature (543)..(543): n is a, c, g, or t
gggctgcaggaattggcacgaggaaaacgataaggatattccttagcgaactaaaagtaaatctaccattccatccagcaatctcactactaggtatccacccaaaggaaaagtgattatatgaaaaagacacatgcacatgcatgcttatagtagcacaattcacaattgtaaaggtacggaaccaacctaactgcccattgaccaatgagtggataaagaaaatgtggcatatatacacaatggaatactactcagtcataaaaaggaatgaaataatgtcttttgccgcaacttggatggagctggaggccattattctaagtgaagtaactcaagaatagaaaaccaaataccatatattttcacctataagtgggagctaagctgtgaggacacanatacatacagagtgatataatgagctntggagactcggagagcaaggttgngagccgggtaagggagaaaaagactgcatatngggacagtatacactgcantggtgatgggtgcactaaaacctcagaattcaccactatngaaaatcatcatgtacccaaccacttatatcccaatgctaattgaataaaggaagtaaagagaaacagatctgacataaccatatatctttggagcttttcttttctaatatgagtttgataagtcgttttattttttgc

SEQ ID NO: 497055 - DNA, 329 bp, Homo sapiens
  misc_feature (63)..(63): n is a, c, g, or t
  misc_feature (262)..(262): n is a, c, g, or t
  misc_feature (327)..(328): n is a, c, g, or t
aaggagttgggtctaccagagtataaacccaggaagtaggcatttgtattcatatttatgttntttcgcattctcccttggagatggaattgtttctgtccaatcaggaacttgtcacaatttcctttcatagaggacttcataagagatttttttctatttctatcatgcctaatgttccaaatagattttaaaaactggttgagtgcatattacttttagcttcagaagatatcatgtatatttaagaggcatttaactnttataaattattttgatgacttaatattgtctgtctacattaaataaaggatctttttgatcatnna

SEQ ID NO: 497056 - DNA, 417 bp, Homo sapiens
taaatcccaccaattttaaggattatcccggggtccaaatttcacattcatattcaatttcctcaaaaatatttattgccatgaaaaagaattaaataatggcatttgcagttaccctggatggaattggagaccattattcctaagtaaagtaactcaggaatggaaaatcaaacattgtatgctctcactcataagtgggagctaagctacaaggatgcaaagtcgtaagaatgatgcaatggactttggaaactcggtgggaaagggtgggaggggggtgagggataaaggactacaaactgggtacagtgtatactactcaggtgatggatgcaccaaaatctaagaaatcaacactaaagaatttattcatgtaatcaaacaccacctgttccccaaaaacctatgggaata

SEQ ID NO: 497057 - DNA, 118 bp, Homo sapiens
  misc_feature (13)..(13): n is a, c, g, or t
  misc_feature (38)..(38): n is a, c, g, or t
  misc_feature (42)..(42): n is a, c, g, or t
ctgactggagtgnccagtgccctgtcctccagataccnctgngctcactgcccatgatgcagggctttcaaggataggctttattctgcaagcaatcaaataataaatctattctgct

SEQ ID NO: 497058 - DNA, 183 bp, Homo sapiens
acctagctgtgcttcatggtgtttaagaggaactccttggggggaatattttccggccgactgaccaatcccatatccaatctgagtttttcttcaagatgctttcaacttctttccttctttcaatatcatcttcctcagactgtgagctgtttttctctccaatgctatgggtatctgttt

SEQ ID NO: 497059 - DNA, 154 bp, Homo sapiens
cacaatattcaggtcaccaaaaatcttcaggagctagtccacatgatcctctgggaaggcctggatacacgcttatgcttgttatgacgatctcaagcgcaggagtctgcgagattcatcccctactccccggaaggattgcttggctgggtgt

SEQ ID NO: 497060 - DNA, 3188 bp, Homo sapiens
tgaatgtaagatggcgcccaggagctgtgaggagaaaaccctgtcggtcttggagcgacgacggcagaaccaggtccctggcggtgcggcggggccggcgggtgcagcggaggcggcggcggcggcggcagtgacgtcgccgggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctctta

SEQ ID NO: 497061 - DNA, 220 bp, Homo sapiens
caatttgggtgttattgttctgtaatttctgtatatttaaatatattagaggctgggcgtggtggcccatgcctgtaatcccagcacttgggagtcaaggtgggtggatcacttgaggtcaggagttcgagaccagtctggccaacatggcgaaaccttgtctcaaccaaaaatacaaaaataaatggagcatggtggcatgcacctgttaagtcccagc

SEQ ID NO: 497062 - DNA, 3248 bp, Homo sapiens
tgaatgtaagatggcgcccaggagctgtgaggagaaaaccctgtcggtcttggagcgacgacggcagaaccaggtccctggcggtgcggcggggccggcgggtgcagcggaggcggcggcggcggcggcagtgacgtcgccggaatattagaagtcttaagaactcaggacaagcagcagaaatacatgcaacatggtgactggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctctta

SEQ ID NO: 497063 - DNA, 3380 bp, Homo sapiens
  misc_feature (119)..(119): n is a, c, g, or t
agcggagttttggggcgcgcgctctgatatcgggtggcggtgctgcctcgagagcgcgcaggaggcttctgctgagcagagggccggccgcggctcgttgcgctgggaaggttgaggantgggtcctttctggtctggtgacgttcccgggcatccgtggcctcggcctggagagaaaccaaccagctttgctgtctggcttgcggttccgctcctctgtgaggggggcgagattgcccgttctcctcgaagaatgccgttacttgaggcccaagaatattagaagtcttaagaactcaggacaagcagcagaaatacatgcaacatggtgactggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctctta

SEQ ID NO: 497064 - DNA, 480 bp, Homo sapiens
gctggactcgagcgacggtgggcagtgtggggggtgcgatacacagtgacctcaggatggggaccccgatggatccagtgaagctggacctggaaagaccaaagggagctaaacaaggagggacctactgggcccattttcccatgtcgctgtgggtcagccctgggcctgggggaaccactctgccagttcctgccgctgcacctctgaagccacacccagcccgccacaggcccaccatgggggcttcaggttcaggatgctgaagatccagcgttggcccaggattggggtgcggggcatgtatccaaaatggctacttccttgtctcggcttctgctctaagggtacttgccttcttgtgatattggattggtggcatctttaaacactctcccgggatgtgtgtggctgtggctgaattctcactgaagccccctgggtggcatcctcttgagccacatcgacgggtaccgagct

SEQ ID NO: 497065 - DNA, 3073 bp, Homo sapiens
gaaaggaggctctggcgggcgacggaaggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctctta

SEQ ID NO: 497066 - DNA, 413 bp, Homo sapiens
tcggtctacctgttattaattaattaattaattagacaagtatgaaaacaaaggctgagcaatatgtatatttctccttgaaataaaattatcagtgaatccatttttgataggtgcaggaccagatggagttgaagaaattaaaagacattcatttttctcaacgatagactggaatgtaagtatagaatgaaaacttgcttgaaatatttctttataattaaaatatgtctaagtctcttttttttttcccctccaggaaactgtatagaagagaaattcatccgccatttaaacctgcaacgggcaggcctgaagatacattctattttgatcctgagtttactgcaaaaactcccaagggtagggaggaaaatgtggaaaatccaaatataagacaaggtagagccgag

SEQ ID NO: 497067 - DNA, 110 bp, Homo sapiens
ggcactggtggtgcctcagccatgggctggaacgttcttctcctcggctctcttctttcacatgcacagaggtcttgtgaacctcctatagctctgactcgagacaccac

SEQ ID NO: 497068 - DNA, 3351 bp, Homo sapiens
  misc_feature (119)..(119): n is a, c, g, or t
agcggagttttggggcgcgcgctctgatatcgggtggcggtgctgcctcgagagcgcgcaggaggcttctgctgagcagagggccggccgcggctcgttgcgctgggaaggttgaggantgggtcctttctggtctggtgacgttcccgggcatccgtggcctcggcctggagagaaaccaaccagctttgctgtctggcttgcggttccgctcctctgtgaggggggcgagattgcccgttctcctcgaagaatgccgttacttgaggcccaagaatattagaagtcttaagaactcaggacaagcagcagaaatacatgcaacatggtgactggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatcccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctctta

SEQ ID NO: 497069 - DNA, 337 bp, Homo sapiens
  misc_feature (7)..(7): n is a, c, g, or t
  misc_feature (275)..(275): n is a, c, g, or t
  misc_feature (329)..(329): n is a, c, g, or t
gaggggnaccttaaaaattaccggccacaaaaagaaaataaatttaggaaaaattattggtttattttagggtgatgttcacagaagaagatgtcaaattctacttggctgaacttgcacttgctttagaccatctacatagcctgggaataatttatagagacttaaaaccagaaaagtaaggaatcatgctactaagttgaatacaatgtaatatgattgtttaggagattataaaaaatcaagtggcttcatgaaactcccacagtaatgtntagcgtgcctgtgcttcacatctctgctaacactgtagtttcatactttaaatnactcagtt

SEQ ID NO: 497070 - DNA, 3045 bp, Homo sapiens
tgaatgtaagatggcgcccaggagctgtgaggagaaaaccctgtcggtcttggagcgacgacggcagaaccaggtccctggcggtgcggcggggccggcgggtgcagcggaggcggcggcggcggcggcagtgacgtcgccgggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctctta

SEQ ID NO: 497071 - DNA, 3990 bp, Homo sapiens
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcattttgggaggccgaggcaggtggatcacctgaggtcaggagtttgagaccagcctggccaacatggtgaaaccccgtctctactaaaaaatacaaaaattagctgggcatggtggcgtgcacctgtaatcctagctactcaggaggctgaggcaggagaatcgcttgaacctgggaggtggtggttgcagtgagccaagatcacaccattgcactccagcctgggtgacagagtgagactctgtctcaagaagg

SEQ ID NO: 497072 - DNA, 273 bp, Homo sapiens
gggctacttagaggatccgtcttaacacaggctgtaaactcgtagggggtcaggtaaggagggggaaaagccaacaaatatattacaaacttgacatcttccttttttgtgttttaaataacctccacaaactagaatgtcttggaggggaaagagggaagaaagagaggggggccaggaaggaggagaatttcatatatacacttgtgggatcattaaacttcgcaggaaaaaaataggtttggggttgtactttgtagtaatatacacaat

SEQ ID NO: 497073 - DNA, 129 bp, Homo sapiens
aatccggcttaccttgttccttcctgtgaaatgactccctgggaaaacccttcgcagagataggtgtctagggttatcagtttttacgaaatactttccacatataatattattcccttatgttggcta

SEQ ID NO: 497074 - DNA, 3247 bp, Homo sapiens
tgaatgtaagatggcgcccaggagctgtgaggagaaaaccctgtcggtcttggagcgacgacggcagaaccaggtccctggcggtgcggcggggccggcgggtgcagcggaggcggcggcggcggcggcagtgacgtcgccgggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacaaaaaaaa

SEQ ID NO: 497075 - DNA, 3838 bp, Homo sapiens
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcatttttggaggccgagcagttgattaacttaaggcaagaatttgagaccaccctggcaacatggtgcccggctttatatacagagagtccttggacctggggg

SEQ ID NO: 497076 - DNA, 200 bp, Homo sapiens
tgcttcttggcggtcagcgcgggccggagctcctcagcctcggaacacagctcggtttctgcctggagctgctcctgcggctgtagtttctctgccatgacgctgacgactgcagcgtctccgctctccggtgagcctgttctcgcgcagccagcgtgcttctctgctgacgcttcaccatgctcctccttccttgggag

SEQ ID NO: 497077 - DNA, 3202 bp, Homo sapiens
tgaatgtaagatggcgcccaggagctgtgaggagaaaaccctgtcggtcttggagcgacgacggcagaaccaggtccctggcggtgcggcggggccggcgggtgcagcggaggcggcggcggcggcggcagtgacgtcgccgggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacaaaaaaaa

SEQ ID NO: 497078 - DNA, 3852 bp, Homo sapiens
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcctcaggaggctgaggcaggagaatcgcttgaacctgggaggtggtggttgcagtgagccaagatcacaccattgcactccagcctgggtgacagagtgagactctgtctcaagaagg

SEQ ID NO: 497079 - DNA, 1016 bp, Homo sapiens
tcacatgtccatttgaaccacccaaaccaaaaacaaagtgctaagctggatgtgacctctgtcgaagattataaagcccttcagaaatacgaaaaggagaaatttgaacgagatgattcaacaaattaaagagactggtgctaacctagcaatttgtcagtggggctttgatgatgaagcaaatcacttacttcttcagaacaacttgcctgcggttcgctgggtacgcgaggacctgaaccttgagctgattgccatcgcaacaggagggcggactcgtccccaggttctcagagctcacagcccgagaagctgggcttagctggtctcgtacaggcagcatctcatttgggacaactaaggatacaatgctggtcatcgagcagctgtacagaactccagagctgtaaccactccttattagaggacgcgacctccgcactgactcattgacgacggcgacacgatcccttcacgatgctttgtgtgtcatccggaacctcatccgcgataatcgtgtaggtgtatggaggaggggctagcctgacgatatcctgatagcccatgtcagttagccaagaggcggaataagttgccccaacttagaacagtaatagccatgagagcgtatgccgccgcacctgcaggtcatccccaaggcctctctgaagaacagtcggccatcaagtccccatccaagaattatgaccgaaatccgaaaccagacaggtcacggacgataacagctgatctagaaatcgactagtagcacacgggccaccgcactgaacccccccctgtccacaaacttgatcgcaatccaccgcaattccagcacccaacacgatttcaaccacctcacacttcctcaacccctacccccaccacctccacccacaacacatccacattcacaacccacccacaaaacaaacatagaccacaccacccactccaaactaccacaacctcacaaccacccaccacaccaccgtacacgaaccaaaccacccacc

SEQ ID NO: 497080 - DNA, 144 bp, Homo sapiens
gactggcatgttcgtgcacttatagatcatcttcttgtcagcctgggttaggagcacatggcaactgaagagttcatcatcctgcatccccccactaccactcatatcatgtgctaggaccagaacagcaactgtgtccctgtg

SEQ ID NO: 497081 - DNA, 3249 bp, Homo sapiens
tgaatgtaagatggcgcccaggagctgtgaggagaaaaccctgtcggtcttggagcgacgacggcagaaccaggtccctggcggtgcggcggggccggcgggtgcagcggaggcggcggcggcggcggcagtgacgtcgccgggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggaggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaagtatctttttgaaaatggaagggtagatgacattttctccgatctttattatgttcggttcacggagtggctacatgaagttctgaaggatgttcagccccgggtcactccacttggctatgtcttgcccagccacgtgactgaggagatgctatgggagtgcaagcagcttggggctcactccccctccaccttgctgaccaccctcatgttctttaataccaagtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgcctttttttttggtggcaaatgggctaaacctgagccggccggagggatttgtgaaacgggtttataaagaacacgggtagtgttttcacacaggttaaaaaagagtttaaacaagggggcaaatcacggcgaggacatttaggaaataataaaaagggaaaggaaagtggtggtgaaa

SEQ ID NO: 497082 - DNA, 3936 bp, Homo sapiens
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaaccttcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcattttgggaggccgaggcaggtggatcacctgaggtcaggagtttgagaccagcctggccaacatggtgaaaccccgtctctactaaaaaatacaaaaattagctgggcatggtggcgtgcacctgtaatcctagctactcaggaggctgaggcaggagaatcgcttgaacctgggaggtggtggttgcagtgagccaagatcacaccattgcactccagcctgggtgacagagtgagactctgtctcaagaagg

SEQ ID NO: 497083 - DNA, 1039 bp, Homo sapiens
catggtggcaggcgcctgtaatcgcagccacccgggaggctgaggcaggagaatcatttgaacctgggaggcagaggttgcagtgagccaagaccgcgccacatgcactccagtctgggtaacagagcgagtctccatttcaaaaaatatatataaaaataaagtgaagccgggcacggtggctcacacctgtaatcccagcactttgagaggttgatgtgggtggatcatctgaggtcaggagttcaagaccagcctggcaacatggtgaaactccatctttactaacaaatcatacaaattagctgggtgtggatggtgggcacctgtagtcccagctactcaggaagctgaggcaggagaatcacctgaacccgggagccagaggttgcagtgagccctgcatcagtgccatgtgcactccagcctgggcaacagagcgagactcagtctcaaaaaaaacaaagcaacaaacaaacaagaacaacaaaaccgaaaagtccaggtccagtgggctcatgcctgtaatctcagcacttgggaggccagacaggcggatcatctgagggtcagagagtcgagaacagacctggacaacaaggtgaacactcaatctttactcataactacaacaaatcagccaggtgtggtgataggacacctgtaaatcgtcagagaatcagggacgccctgaagaccatgaagacatcacgtggagcccaaggtcggaacgacggctgccggcaaagcagacgatacggcccaatggaccaccaggcgcgggatgacaaaagaagtgaaaacctcccgtctcacacacaagaagaccacgaacggagccagaagacatcggcaggccggcgaacagcgcccgcgacgaagaaagcagggccacgacgacatccccaccgccatatcgataagcacacaccagtgcacaggataacaacggcgaccccccacggcccagcaccgccggacaaagacctacagcgacaaccactagcaatgtacaccaacacgtacagcagacaggacg

SEQ ID NO: 497084 - DNA, 1182 bp, Homo sapiens
cctagtcagctgtcatgcctcataccttccctcccccgacctgtataacctagttgggctggctgaaagcctaagtatcctgatctgggcctgaggtaaggcagtctgatgccaggtctgtggtggtggggatgtgtgttttatagttacagatgacatgtatgcagaacagacggaaaatccagagaatccattgagatgtcccatcaagctctatgatttctacctcttcaaatgcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacaaaaaaaa

SEQ ID NO: 497085 - DNA, 2800 bp, Homo sapiens
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttca

SEQ ID NO: 497086 - DNA, 3939 bp, Homo sapiens
cagaaattcttttatcaccatcatggtttcgtagccatgtttaaatttttgtcttttcgtgttcgctctatacaggaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcattttgggaggccgaggcaggtggatcacctgaggtcaggagtttgagaccagcctggccaacatggtgaaaccccgtctctactaaaaaatacaaaaattagctgggcatggtggcgtgcacctgtaatcctagctactcaggaggctgaggcaggagaatcgcttgaacctgggaggtggtggttgcagtgagccaagatcacaccattgcactccagcctgggtgacagagtgagactctgtctcaagaagg

SEQ ID NO: 497087 - DNA, 983 bp, Homo sapiens
aggaaaaggaacaaaaacaataaagaaatacctttgtttttttttcttttttgagacggagtctcgctctgttgcccaggctggagtgcagtggtgcgatctcggctcactgcaacctccgcctcccaggttcaagcgattcttcttcctcagcctcccgagtagctggaactataggcacgcaccaccacacccagctaattttgtgtttttagtagagatggggtttcatcatgttggcagggctggtttcgaactcctgacctcgtgatctgcctacctcagcctcccaaagtgctgggattacaggtatgggccatgggcccagcctatttttatttctttgatgtaggtgatctaaaatagtagatgacggacacggaacactggggtcgacaggtactcactagctattcattacgaacaaacgtctttccactgacacattgcaggcacacttaccatattaaatccgtggaacaaacgatacggtgtgacccccatgtgtcacctttccgtacaccatttattttgttccaggcaccattcttgcacggtcggtgagtcccgataccttgcatcaactgtccattcttcgtacgtcatttgacgtacaaactgggccattgttacagaacttcactcactgtaatttggtcttgcctattatggaacctccataatgaatcgtggggaccttaacttcctaacttcgcatccttaacaccgtgacgtctgacaaaggattcctacgacgtactctgaggctgattcggcgcctctgaaccttgcgtcaatgtagccacacctgatgtctactacatggattccatggtaagcacacataacaacactgtctgcccgccctaagtacacctggtgcgatcccacaatgacagcatgtcttaagactgctaggtgtctccaaccggcaccgtaaactattttactaacgcatactcgtcaaacggcatactcatcca

SEQ ID NO: 497088 - DNA, 550 bp, Homo sapiens
  misc_feature (2)..(2): n is a, c, g, or t
  misc_feature (92)..(92): n is a, c, g, or t
  misc_feature (96)..(96): n is a, c, g, or t
  misc_feature (106)..(106): n is a, c, g, or t
  misc_feature (108)..(108): n is a, c, g, or t
  misc_feature (110)..(111): n is a, c, g, or t
  misc_feature (129)..(129): n is a, c, g, or t
  misc_feature (139)..(140): n is a, c, g, or t
  misc_feature (144)..(144): n is a, c, g, or t
  misc_feature (151)..(151): n is a, c, g, or t
  misc_feature (189)..(189): n is a, c, g, or t
  misc_feature (192)..(192): n is a, c, g, or t
  misc_feature (244)..(244): n is a, c, g, or t
  misc_feature (272)..(272): n is a, c, g, or t
  misc_feature (547)..(547): n is a, c, g, or t
angcacacaacaaagcaagcaagacaaggagtaggcctggacccaatgtgaagcgcaggtggggtgtgaatcctaggcagctggcctctcangcanaggtggtgananannggaggccccatgttcccnaagaaagaannatcncacacantcatgagctcaaagtgtacaggacggcgacagaaattncangcaaccacagacacatcctggaggggcagccccaccgcagtccaagccagcngcagcttctccacaaaatcttccatcanctgagggctgtggtggggggagggtgccaagcgcaggagctcttcaccccgggggaaagcttcgcggtagttgatggcctgcacatagatgccatgcttggagagcaggagatcacagagcttgctgttgagtgctgcattgcccacccggatggggatgatatggctggggcaggggatgacaggcaggcgcgcctgtccataagtagctggcgcatgtgcttgacattgcgctggtgggctcgcgctcagggcttgggccctcctctcccttnagc

SEQ ID NO: 497089 - DNA, 452 bp, Homo sapiens
  misc_feature (223)..(223): n is a, c, g, or t
ttgggggtgatgggtttcatggggggtataccatatggtcaagaccttatcagattgtacactgtaaatatgtgcacttgattaaatggttaaaccctcaattaaaaaagaaaagaggctgagtgtgttagctcatgcctgtaatcccccagcactttgaggggccatggcagggtggatcgccgaggccaagtttgagaccagtctgggcaacatagtaagnccttgtctctacaaaaaaagtaaaaacaaaattagcccgatgccctggcaagaacctgtagtcccagctatttgggagactgagttgggaggatcacttgagcctgggaggtcaaggctgcaatgagctgagatcacaccactgcactccatgcactccagcctgggtgacagtgagatcctgtctaaaacacacacatgcacacatataagcacacacacttttttaa

SEQ ID NO: 497090 - DNA, 3840 bp, Homo sapiens
cagaaattcttttatcaccatcatggtttcgtagccatgtttaaatttttgtcttttcgtgttcgctctatacaggaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaagggctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggtattaaaaaaatcacctcaacagccctgtgaagtgacctcagtgagatatttggtaccatggtgtaagctgatagcacaagttctggcgacaggtagcacgtatctgagagacacctgcaagcacacactgtcccagctggtacccataatgctgctgttcctgctgctgctcctgctttcctctcttctcgctttaaatgattgttagcaagttagattttcctggagcttcggaagaaatgaaaatggaaacatgatgaagatatagtcactgaatcaatgagaaaaataatgaacatatgaataccacctaaaaatacactgaataaagtacaccatatagcattatttttataggaaatatttcatgtcccttaaatattctttgttagttatagggatggacagtttatgttaagcacttagcttaaacaatccgtttatattagcactgtatcccttgtgccatccaacattttgtatgtttttgtaaacagttcatatacagtacatttctgtactgctttctttaatgtatacatgccttgtttaacttggaatctattattattaatcaattgactattaaatctggttaaatagttcacctggattaacagtattgttggacagtcctaaaaatggccagattgtggaacagctgttgaatgtaatacttccaaaatgtacatatctttccccacgtctgtttcactggttcgttcatttgtttgtttcttaaagtcaggtgctctgtcagactaacctagagagctgttatggtagagaaagttatcatatgtgtgtggcatgaaatcaagaatacacctatgaagttagtccatatactttgcaactccttagagtacttttttccttaattaaggaagtagtccttgcacttctaatcttacatagcatccatacttagaatttggcatatcatctgggattttgccaatatacgtcaaagccctttaagagtcatggtaaggagatgggtgaaggaaaatttagcaacaggtaattgaagtcctattggatatttcatgtttaaatagatattctatattaaacactaatttaaatgtaataaaggccaaaggcctctgtatgaaattggatttaaactttcttattttagggaataaaacattattgatcaaacagtatctgttctaacctaaaattataggtagggcaggctaagtgaacagcattgagtattttctgaatccctcatgataatttatagccacatactgcttcctttgacttcaggaatgatcagttttcataatggccactgggcctgcttagattgcagtattcattatctgcatctaatttggtagtttccacaatcgtatttgatgaaagaaacttcagtccccattattacctgtgtctttgccaagctgcctagcatacatcagtatgtaatgtaaaagacatatgagcaagaaaaaagtgatttaacttacctcatcaagaatgtgcccctacaggccgggcgcagtggctcacgcctgtaatcccagcattttgggaggccgaggcaggtggatcacctgaggtcaggagtttgagaccagcctggccaacatggtgaaaccccgtctctactaaaaaatacaaaaattagctgggcatggtggcgtgcacctgtaatcctagctactcaggaggctgaggcaggagaatcgcttgaacctgggaggtggtggttgcagtgagccaagatcacaccattgcactccagcctgggtgacagagtgagactctgtctcaagaagg

SEQ ID NO: 497091 - DNA, 459 bp, Homo sapiens
  misc_feature (344)..(344): n is a, c, g, or t
ctggatgattacttgctagcaccattacttccagagtcccatggtgaacggaaagggcactctgcctaaaaaccacagtattctgtgacaattcagttgtacatttagcctcattagacgtcttctacctacctgacggacatagaatgtggtgtccgctgtgcacaagctattggttcaacatacggggattatgccctagaatgacgcacgggacaattccgtagatacgccttattgcgagccaaatactgctgatagtgctcttagatctaacctgactaggctgaaccataatgggcataggtaagctttactgcctctgtttgtgatggccactctgnagttggagatctccagtgatatcgacctgttggtcgcctaggcccatgaccttctagactcgaccaagcatatgcatgaggccgacatataggcctactcgctgactaaagccag

SEQ ID NO: 497092 - DNA, 2713 bp, Homo sapiens
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagttaaaaaaatctcaggctctgatgctaggcagctttatgccatgaaggtattgaagaaggccacactgaaagttcgagaccgagttcggacaaaaatggaacgtgatatcttggtagaggttaatcatccttttattgtcaagttgcattatgcttttcaaactgaagggaagttgtatcttattttggattttctcaggggaggagatttgtttacacgcttatccaaagaggtgatgttcacagaagaagatgtcaaattctacttggctgaacttgcacttgctttagaccatctacatagcctgggaataatttatagagacttaaaaccagaaaatatacttcttgatgaagaaggtcacatcaagttaacagatttcggcctaagtaaagagtctattgaccatgaaaagaaggcatattctttttgtggaactgtggagtatatggctccagaagtagttaatcgtcgaggtcatactcagagtgctgactggtggtcttttggtgtgttaatgtttgaaatgcttactggtacactccctttccaaggaaaagatcgaaaagaaacaatgactatgattcttaaagccaaacttggaatgccacagtttttgagtcctgaagcgcagagtcttttacgaatgcttttcaagcgaaatcctgcaaacagattaggtgcaggaccagatggagttgaagaaattaaaagacattcatttttctcaacgatagactggaataaactgtatagaagagaaattcatccgccatttaaacctgcaacgggcaggcctgaagatacattctattttgatcctgagtttactgcaaaaactcccaaagattcacctggcattccacctagtgctaatgcacatcagctttttcgggggtttagttttgttgctattacctcagatgatgaaagccaagctatgcagacagttggtgtacattcaattgttcagcagttacacaggaacagtattcagtttactgatggatatgaagtaaaagaagatattggagttggctcctactctgtttgcaagagatgtatacataaagctacaaacatggagtttgcagtgaagattattgataaaagcaagagagacccaacagaagaaattgaaattcttcttcgttatggacagcatccaaacattatcactctaaaggatgtatatgatgatggaaagtatgtgtatgtagtaacagaacttatgaaaggaggtgaattgctggataaaattcttagacaaaaatttttctctgaacgagaggccagtgctgtcctgttcactataactaaaaccgttgaatatcttcacgcacaaggggtggttcatagagacttgaaacctagcaacattctttatgtggatgaatctggtaatccggaatctattcgaatttgtgattttggctttgcaaaacagctgagagcggaaaatggtcttctcatgactccttgttacactgcaaattttgttgcaccagaggttttaaaaagacaaggctatgatgctgcttgtgatatatggagtcttggtgtcctactctatacaatgcttaccggttacactccatttgcaaatggtcctgatgatacaccagaggaaatattggcacgaataggtagcggaaaattctcactcagtggtggttactggaattctgtttcagacacagcaaaggacctggtgtcaaagatgcttcatgtagaccctcatcagagactgactgctgctcttgtgctcagacatccttggatcgtccactgggaccaactgccacaataccaactaaacagacaggatgcaccacatctagtaaagggtgccatggcagctacatattctgctttgaaccgtaatcagtcaccagttttggaaccagtaggccgctctactcttgctcagcggagaggttgcttacattttgctggtctccccaagtgaccatggtggagaccaattaatgaaggaactgacaattcactttattgggactgtggttattcaaccagagccacacttaaccacctttttccaatgaagaatctccaggaatgataatgcccaaatatggatggccacgaagatattgtatctacgggtgccttatgtgttttgacactgctggattctgtgtgatcacgtgatttgcgcgtggtttcaatgttgacgagtgttctccaagaattctaataacttaaggtccaccttatatttcttaagccgtggattactcataggcttcaatatacccttgggaatcctacttctttaacgggtcctaacaaggggactaccgaagggtgttgacataagaccactctataccttaaggcagctcctcctaatattggcgcatatactataacgggcggatgacgcgtaaaagtgctctgacactccacagaacattcaactatatcatctgtgtaga

SEQ ID NO: 497093 - DNA, 126 bp, Homo sapiens
atcaaaattaattaaaaaccagtcttcagtttatactagacatatctcacgtactcagtcgctacatgtggctagtggctgctgcattggacagcattgttgaaagagaacatattcatcactgca

SEQ ID NO: 497094 - DNA, 708 bp, Homo sapiens
  misc_feature (79)..(79): n is a, c, g, or t
ggcagacactgaccttcagcgcctcggctccagcgccatggcgccctccaggaagttcttcggtgtggggggaaacctngcgaaagggatggaacaccggggcggggaaagggcaaggaagcttcgtagcggaggggaaggccttcaactcgggggataaccttccgtggaaaagccgccggggcccaaaaaagggggtttggccccggggggcccgggaaacaaaccccggaaaagaggcggtggcggatatgttggattggcccttcccaccaccaccttattaacctgttttggcccccttattaatattatattccgaggaaaacttttttcccggggcccccccggggggggcccacacgggcacacaacgacgggccttattaaggggaattattcccccccccaaaaaaagcgggcaatattttgtgggcccccttggggcttgggcggggctttttggggcctcgggcacaagaggggaaaaaacaacacctggttgggccctttattaaagcaccaaagaaaaccacagcggggcgtgtggggagaccacccttttttacaaccaaccttgtggggacggaggggagggaccccatttttatttcactactaataacaccacccttttgtggggcgcgacgcgacgcggcacaaccgggaaaccattttccacaaaaggggtccacccccccccctgtg

SEQ ID NO: 497095 - DNA, 407 bp, Homo sapiens
aaattggactacccccacgtggggtaagcagaggaggaatcggttcacttaagctcccagcgaacatcctcctgccaatgtaggaggaaacacctccctatgttaccatttatgtttctcagaaccagcagagtcagtgcctagtgtgggcccggaaaatagttggcactcaataaagattggcagaatttaatacagatcttttcagcggttcttagggcattagtaaagggaaatcataacgtgattctaggttatcaaaccatggagtgatgtggagctaggattgtgagtgacctgcaggccattatcagtgcctcatctgtgcagaagtcgcagcagagagggaccatccaaatacctaagaaaacagacctagtcaggatatgaatttgtttcttcaattc

SEQ ID NO: 497096 - DNA, 346 bp, Homo sapiens
  misc_feature (51)..(51): n is a, c, g, or t
  misc_feature (57)..(57): n is a, c, g, or t
  misc_feature (88)..(88): n is a, c, g, or t
  misc_feature (95)..(95): n is a, c, g, or t
  misc_feature (110)..(110): n is a, c, g, or t
  misc_feature (171)..(171): n is a, c, g, or t
  misc_feature (189)..(189): n is a, c, g, or t
  misc_feature (230)..(230): n is a, c, g, or t
ttttttttttaagacggagcttgctctgttgcccaggctggagtgccactncgtgancttggctcactgcaacctctgcctcctgggntcaagtnatttgcatgcctcancctcctgagtagctgggaatacaggtgcatgccaccactctctgctaatttttgtattttnagtagagatagggttttnctgtgttggctaggctggtctcgaactcctgaactcaagtnatctgcccgcctcagcctcccagagtgctgggattataggcatgagccactgtgcctggccaatttagtaggatttctcctaagaatgcaagaatagatcatcatcgggggaaaat

SEQ ID NO: 497097 - DNA, 339 bp, Homo sapiens
cttgcccctccgggaaactgtggcgtgatggccgcgggactcgtccagaacatcatcccgtgcctctactggcgctgccatggactgtaggcagggtcatctctgaagcagaacgcggaagctcactgggcatggccattcgcgtgtccccacttgccaacgttgtacagtggtgcacctgatctggccgtctagcgaaaacctgcgaatatatgatgacatcaagaaggtggtgaagcaggcgtcggaggggccccacaagggcatcctgggctacacctgagcaccagggtggtctcctctgacttcaacacagtcaccacacacacacagtcacca

SEQ ID NO: 497098 - DNA, 98 bp, Homo sapiens
gcttaccagtaaaaaaattttgttttaaattcaacccttcgtttaaatgtattttagttcccccattgggaagaaaataaaatattactatgtccgga

SEQ ID NO: 497099 - DNA, 298 bp, Homo sapiens
ccctcttcagccacagtggctaactaagcgcctcacatttggtatctattcattctctagccagtgcactcagaatgcctggaattcagctgggcatggtggcccattcctgtaattccagcactttgtgaggccaaggtgcgtggatcactcgaggtcaggagttccgagacagcctagacaacatgggggaacccccggtctctaccgaaaaataccaaaaattagtttgggcattagtgggttgcgtgcctgttaactcccaagccacctctggaagggccgagggtaggaggaa

SEQ ID NO: 497100 - DNA, 288 bp, Homo sapiens
aaggggcctcaatgagtgataggaaaatccagttcttttaaaatttcttcaagaaaatccaggctatccccatagtctttctgtgtgcacttatcaggagcatcaggacagagcattgggaaacttgcacagttagctatgcatctccacattcgggttggggggtaagttatggcaattggtcttaaaataggatgtgttcaataacttcacataaacttcctgtttctccaaaaactcaaagagataggagtttaatgagtctgtattacctgcttggggtaccgg

SEQ ID NO: 497101 - DNA, 319 bp, Homo sapiens
aataatatattgcatacctgatatttaccaagagagtagatcctaaatattctcaccacaaacgaaaggtaagtatgtgaggtaacaggtatattagttagcttgattgtggtagtcatttcaccatgtgcacctagatccaaacatcacggtggacatcctggatataattaattttaattggcaggtaaggatccattaagctggaggaaagggtagtacctgattgcatggactggaccatccggccctgttaataatttaatattgtttgtgctagtagttgtggttacctcaatatatattgtgcacagtaaac

SEQ ID NO: 497102 - DNA, 237 bp, Homo sapiens
gctcgacggatggctcacgcctgtagtcccagcaatttgggaggccaaggtgggcggatcaccaggtcaggagatagagacccgcctggccagcagcgaagaccctgtctctgctgaaaatacaaaaaattagccgggcgtggtggcgggtgtctgtgatcccagccctgggctcaaacaatcctcacacctttcataccttaggcccctgagtagctgggtgggactacgggcatg

SEQ ID NO: 497103 - DNA, 343 bp, Homo sapiens
tactctgaggactccccggtcacctgcttcggactgacgacgatagtgacggaacacgttacgccaataactgacgtgacagtccgtggaagcctgtggctacaaaaaactgttgacgccgtagactgccgtcggaaactggtgacagggagacctcgacagtactctgacggcttgtaggacgggtaaaatagacgacccagtacacattgtactaacgcacgtgcttgaccttactttggtttcggattgttttctattacacctactggtgacgctcacggtgacttgactacctcctgactgcgacgtacatacggactgtgttcacggacgctggcga

SEQ ID NO: 497104 - DNA, 803 bp, Homo sapiens
  misc_feature (623)..(623): n is a, c, g, or t
atctcaatttgaatgtatctcccagaattcccacgtatgtgggagggcaccagagggaggtaattgaatcatgggggccggtctttcccatgctattctcgtggtggtgaataagtctcactagatctgacgggtttatcaggggtttccgcttttgcttcttcctcatttttctcttgccccttgccacgcaagaagtgccttttgcctcccaccataattctgaggcctccccaaccatgtggaactgtaagtccaattaaacctctttttcttcccagtctcaggtatgtctttatcagcagtgtgaaaacggactaatacacatggtaattccatgtttaactttttgaggaacagccaaactgttctccacagtggctgcaccattttacattcctgccagccgctcatgaagcttccaatttttccatatctttgccaagatttattattgtctgtctttttgattgtagcctttctagtgggtgtggagtggtatttcattgtggtttgatttgcatttccctagtaattaacggtattgataatcactttcatgaacttatttgccacttgtatgttttctttggataaatgtcttttccggtcctttgcctatnttaaaatggtaccatttgtcttttccatcgacttatcactaactattatgtattctggatactagatccttattatatatatcatttccaaatattttctctcattcctgtgtattgtctcttcactttcttgacagtgtctttaataaacaaaagttttaatttccaaagaaacaacaa

SEQ ID NO: 497105 - DNA, 189 bp, Homo sapiens
gctgaggcaggagaatcacttgaatccaggagggggtgctttgcagtaagcagagaccatgccactgcactccagcctgggcaatagagccagactgtgtctcaaaaaaaaaaaaggaaaggggcccactcatttgggtcggattcttaagttctaagggccctttaacatgggccatttaatggcatt

SEQ ID NO: 497106 - DNA, 102 bp, Homo sapiens
ctcttgaggatccccgtcattttctacaccgtctatctctagttcagccatcatcacacggaagaaaacaacaaaagtatgcctggtcggtgtagggaatgt

SEQ ID NO: 497107 - DNA, 183 bp, Homo sapiens
ttcagatgagcacttcactatcaaaaatactaacatcacactggtcttgaaagagccatcagagctagaatcatccaagtaagaacaacgtaccattgttgattgataagtagagatacattttttatgatgttcatcacagtgtggtaagcttacatatcaaaaggtgtgtctgcgtgtttg

SEQ ID NO: 497108 - DNA, 802 bp, Homo sapiens
  misc_feature (546)..(546): n is a, c, g, or t
  misc_feature (553)..(553): n is a, c, g, or t
  misc_feature (555)..(556): n is a, c, g, or t
  misc_feature (558)..(559): n is a, c, g, or t
  misc_feature (578)..(578): n is a, c, g, or t
  misc_feature (597)..(598): n is a, c, g, or t
  misc_feature (634)..(634): n is a, c, g, or t
  misc_feature (642)..(642): n is a, c, g, or t
  misc_feature (644)..(644): n is a, c, g, or t
  misc_feature (650)..(651): n is a, c, g, or t
  misc_feature (701)..(701): n is a, c, g, or t
  misc_feature (738)..(738): n is a, c, g, or t
ggaggaccgtgtccggagggcgccaagccaagccctagatcgcccagatcagggcgcgggggatccaccaaccccagcactgtcagccttctcgctgcaagaagtgcccctgccacctggcacaagcgacgtaggcgcaggcacgaacagagtagggagaaaccccagtgtaccagacgtgcatcctcccaggcgggatgcaccgagcatctttagggacagcttgagcccctaaccggggccttggcccccgtcattaaccagcagcttctttgtactggggagctcacgaacatcccccaatctcgtacagctccgtccccaatacttggggtacccagcaaccctggcccctcaaccgcctagcgaaatctctaacacactcttagatggtccaaggcttagaacaggcatctcgtagccagccccactgtctcgtaaccactcctgggctaaggagtaacctcccgtcatctcgaagctgccccccatcggggccagggctaccccagaacgttgttaactcttctcaggacagggagcttngggcccncnntnntgtctcctgccccgggggncctgtggctaagtaaaccnnatcctaactacccagtgtgggtgtgggcctctgaanataacccncncccacnnagggggagtctgagccgggagggctcccgagtctctgccttcagctcccnaagtgggtggtgggcccccttcacgtgggacccactntcccatgctggatgggcagaagacattgcttattggagacaaattaaaaacaaaaacaactaac

SEQ ID NO: 497109 - DNA, 357 bp, Homo sapiens
cgtgaacccaccgtgccccagttgagaatgtcttttataaatacccatatgtttactatttctagttctattaactcttttgtgtagaattgcatttctatctcacatcatgttttcttagctcaaagagcttctcttttttttttttttttttttgagacggagtcttgctctgtcgcccaggctggagtgcagtggcatgatctcggctcagtgcaagttctgcttcccgggttcacaccattctcctgcctcagcctcccgagtagctgggcctacaggcacatgctcccaagcctggctaattttttgtatttttagtagagacggtgtttcactgtgttagccaggatggtc

SEQ ID NO: 497110 - DNA, 525 bp, Homo sapiens
cagtgctgtacggccggaagttcgggctagaccgagtcgccccgggagctaagagcctcgcctttgccgatccagcgtccgtccacaggacgacgacaggtcaccatggatgatgatatctgccgcgctcgtcgtcgacaaccggctccggcatgtgcaatggccggcttcgcgggcgacgatgcccccctgggccgtcttcccctccatcgtggaggcgccccaggcaccagggacgtgatggtgggcatgggtcagaaggattccatatgtgggcagacgagtgccagaagcaagagaggcatcctcagccctgaagtaccccatcgagcacggacatcgatcaccaactgggacgacatggagaaaatctggacaccacaccgttctacaatgagctgcgctgtggaatcccgaggagcaaccccgatgactgcatgacacgaggaaccacactgaaaacccaaggccaacacgcgagaagatagaaccagactcatgataagagaccattcaaacaaccca

SEQ ID NO: 497111 - DNA, 474 bp, Homo sapiens
caaagcgccaaccaaggttggcacctacctgagcgtcacctcatccagcacccacatcgccgggcgcgtgtcgccggtgaagttgatgcacagatcaccggtgccctgcgtgcccttcggcagcgtggccttcagggtcacgaagccatcggcatccggcttggccggcagcggtacttcagccagcaccttgccgctgcagtcgccgcgacgcaccagcatttcgccatgcgcccgcttggctttctcgaagcgacgcttgggttcgtcgtgggccagctggaagtagtacggaatgcggcccgcgcggacctccacgctgccgatgccgtccagctgtgcctgcggccagcgccagcacggctggaagatgtcgacattgaacaccgcacgcgttccctcgcgcgggccgtcgtcttccaggcgcagcaccaagcccttcgtgcccacgcagctgagcagctcatcgctgcg

SEQ ID NO: 497112 - DNA, 225 bp, Homo sapiens
  misc_feature (5)..(5): n is a, c, g, or t
  misc_feature (23)..(23): n is a, c, g, or t
  misc_feature (59)..(59): n is a, c, g, or t
  misc_feature (70)..(70): n is a, c, g, or t
  misc_feature (110)..(110): n is a, c, g, or t
  misc_feature (150)..(152): n is a, c, g, or t
  misc_feature (158)..(160): n is a, c, g, or t
  misc_feature (167)..(168): n is a, c, g, or t
  misc_feature (175)..(175): n is a, c, g, or t
  misc_feature (177)..(177): n is a, c, g, or t
  misc_feature (180)..(180): n is a, c, g, or t
  misc_feature (184)..(184): n is a, c, g, or t
cattngtattactcttaaatttnattaacatcttcagttcgtcgccgtcatttaaaatngacgacatgtngctttaaaaacgcattcttatacataaaccaccacacgtnttctgcttctctcttttaaagtatttataaaaatataaannntacatnnngtaaaannctatgtntnganttcnctactgtgtcatatcactaaataaacacggttttattgctg

SEQ ID NO: 497113 - DNA, 91 bp, Homo sapiens
gaagccataccacctcctcttgggcatgtgcttagagctgtgactcgctacctctgttctccaggagccgtcacaggcacaaaggtgtatg

SEQ ID NO: 497114 - DNA, 622 bp, Homo sapiens
  misc_feature (373)..(373): n is a, c, g, or t
tctacaatcacatatgacatacatgtaacataaaaataattggcataacatacttattcaattagtgattaaatatctttttttttggtttaaagagatggggcctcactatgttgaccaggctagacttgaactccttgggctcaagcaatcatcctgccccagcctccctgagcagctggtactacaggtgcaccaccgcacctagctatcattttaatccccagaatgatttataattaaaaatagaatgtttaagggaaagcgtgcatagtgttaatatttttatgtaaagaactctgttggtattggttttggtttagggtatggtttggtatttggagatggagtctcgctctgtcacccagactgnagtgcagtggtgtgatcttggctcactacgaccaccgtctcctgggttcaagcgattcttctgcctcagcctcccaagtagctgggactacagccgcacgccaccacacccagctaatttgtgtatattcagtgaagatggggtttcaccatgtgggccaggatggtctcgatctcttgacctgtgatccgcccaccttggcctcccaatgtgctgggataactggtgtgagccactgtgccacggcaa

SEQ ID NO: 497115 - DNA, 270 bp, Homo sapiens
tgaagcacggacagtgaagaggaaggtcagcctcttccatgagaagtgctgtattgtgctcaaggagatcgtttatttgccagaatgaggtgtggcattatctctgtggacccagtttctgtgaattggctgagctttgtgaggaacagattcaggaatggactttgctctgtaaaggatggggaacctcacttccgtggtggtccaactgcacaggctacatcaaggtctggtccccagacaggtgtttccctctccagtgttcagagt

SEQ ID NO: 497116 - DNA, 705 bp, Homo sapiens
ataatcccaacgtcgcatgttctttgtaacaaccaattctgttctatctttcttctttaattattttacaactgtagttgattcttctggaactcagtctaaaatgaatggaaagaaaacttcaggatatcatttaatgactattaagtattatctggtaaaaacgtgaagataagacttgtagaatcacagcttcaaattttatggaacacaattaccgcaagcaagtacctagccaatagttcatgcttaagcttccttggtgtaagtattttgttggcgattcctataaataatttttcatcacaaaggttttaaatttctgggtgctacttctgactctcaactgagagtggatagagttgtttctttctcgaggattacagtcgttacaatatgtccatcgcctggctggttataaacatttgtcaccttttgaaggtaaaatatactctggcccttcttgactcagttacaggtcattttaggtccagtaataagagtcaggtgtttggttattgctttcagagtcagacattgtcgtagcgtaatatctcaaaaactattagcaggttttcactgacaatgcttttttcaacacataaaaaatgtaatccactttctttaaggcagattgtccattatgcatatacagcttgaactatagtttgggtccatataggaaccatcaccaaaaactctggt

SEQ ID NO: 497117 - DNA, 318 bp, Homo sapiens
  misc_feature (137)..(137): n is a, c, g, or t
  misc_feature (230)..(230): n is a, c, g, or t
  misc_feature (239)..(239): n is a, c, g, or t
aggaagttagggtagccatttgaaaactaatccccgtcggggcgtggtggctcacgcctgtaagcccagcactttcggaggctcaggcgggtggttcacttgaggtcaggaattcgagaccagcctggccaacattntgaagccctgtttctgctaatagtataaaatttagccgggctttgtggtgcatgcctctagtcctggctacttgggaggctgagacaggaganttgattgancctgagaggtggaggttgcagtgagctgagatcgcgctattgcattccagcctgggcaacaagtgaaacttctgcctcc

SEQ ID NO: 497118 - DNA, 151 bp, Homo sapiens
cttggctgcacccagggttattttgcggtgctttctgcgggtcgtaggtgaggagacgggtggagccccacatgcccaggctgcacgcctctgtcccctccacctctgaggagcgtctggggaggcacactttatgcactttgtatcacac

SEQ ID NO: 497119 - DNA, 657 bp, Homo sapiens
gtcctgtttgcgtgtgttattttaaggtggctcgcgtagcgtgcctggtaggtagccggcggcggtccgaggagcgaggtgaccgactcgggagccatgcctgcgctgaggtgggtggccgcacagccgccgtcaccgccaccgccgccggtgtggggtgggaggggcgggagacgccgccgtccgcagtgctccagggtgggcgccgtttcgccgtggactccgatcgttcgggacgagggtttcatcaccttaaatggttttgaaccaatgaaggtgtattcccgttaaaaagacttggacaagcccatcgtgtgaactatagagtttgtggacagatataatattgggttcatagtggcgtcagtgcactgcagacgtcctgtcaagttcccctaagttcgttagaggactgctttgccttttgatctgagagttgcaagagttccgataaagaatggcaccttgtggataagcagcaaatgtcacagagacagcggattgtgacacgcatttgtgaacggtattgcgccgggcagcatggaatgaaaccggtggcccatgaagacacccgcggccgacatgtggattgtcgctggctgcgattggccgcgaattgatatttggagaaatgccccattccgcaaagggagatgc

SEQ ID NO: 497120 - DNA, 285 bp, Homo sapiens
ggctgttctagaggatcccactcagtttacacaacttcagctgagactacactcagaaataagtttagaaaatggcattacacaaggttgggagtgagcagtacacaaacaaccaaacccatgcagggctgtatgtgctgtgggaaatcagatgtgttcagtgccataagtcttcagtgcgtgcaaacttcacaaaacagccctccaaaaaagatgaaggccttcttggacaaatacagcaattccagggtatactatgtctcactctttatgtgtcaactgatt

SEQ ID NO: 497121 - DNA, 349 bp, Homo sapiens
ctagagatccccctgccggacagcaggcagggtttgtaatgcctcttgtgatccacttcttgctgccttcttcacttcttgagctcactcccagggatccatttgctattgtttctcctcgtacccctaaggaccagaacaaaaagtttacttcatttgttcccatagcgaaactcagcttggcttagtgtggtttagctcttacacccaccatcccactggtcctcgtgactaaggctactgttggattgattcgaaatcttgtccctgttgatcccgcaaatcatgcacctttgcgtgagcagtggtgccattccacgactagttcagttccttgtcccgctggggc

SEQ ID NO: 497122 - DNA, 458 bp, Homo sapiens
ctagccgggaaaattcatctgaacatccttcctacagccgctccccacaccaggtggccaggtgggagttccagaccagagctgtctcctgggatgttgacacagcagccacgttgattggtgttggggcagcccctgtcggtgtggctggcttcgggcctggcattggaacggcgtttggcagcttgttggctatgccgggaatctgtttcacaagcagcagctcatctccgatgccattctgggctttgctgtgtctgaggccatggggctgttctgtttggtggtcgtcttcctcatcctcgccacgtgaggctccacaggggtcacctgcctgtccctgctgcccgtccctactccacgccattcctggtgatggggtatgctaatttttaccattaaacacacgtttctctcaaaaaaagtctcccccacataaattttactacgaaaacctg

SEQ ID NO: 497123 - DNA, 452 bp, Homo sapiens
aacaaccgagccaagatgttgcggaatctgctggcccttcgtcagattgcccagaggaccatcagcaccacttcacgaaggcattttgaaaacaaggttccagagaaacaaaagctgtttcaggaggataatgggatgccagttcatctgaaaggcggggcatctgatgccctcctctacagagccacaatggctctgacgcttggtggcacagctatgccatctatctgttagctatggctgcatttcccaagaagcagaactaatgtcgtcatcccagtcttcacgtggttcagtttcatcaacgctcgatggaccaggaatctgatgagtaactgagctcttctttggggatcaatatttattgatgtgtattaactgctgccaataaagcaatccttaaccattttgtgtctcccttttcacttgagaataaattcctggtaatacca

SEQ ID NO: 497124 - DNA, 835 bp, Homo sapiens
tgggatgtgcttctgatgcctggagcattgcatgctgcctgtgatgtgccagatggccgttctgccctgcctcatgtgcctgtgtctggcctgcctgctcccctcccctgcgccctgttccctgtggcatgtggcccagatgatggccgcctgccgtcctgccctggtgtgttctctgtgtgctgaatgtgtgaagcctgcgaagcaggtcctggggaagagctcgcctgctcctgagggaagcagctgataatgatggcgctttgaagtggtgatgcctgagtgcctgagtcactcgtgttcggtcgggacgcctgcctttctaactgcctgccgtcggctcgcaccactctgggcctgctgcccacactgactgctgtgggtccgggagagcgggatgcttggcctggcctgcgcctggcttcttggaaacgagcattgaatggagctgcgagaatgcagttccgctgggcagaaacctctgtagaggagcaggatgcaaccgacatgtgctgtggccggacagctgctgacccagcacatggagcctgcaactgcgcacgggtttggccaaagaagcccccatactccctggtgaaaaagatttccagaagctgttctgtcaataacaaagtctcagagaacaaccacagaaagccagcgcaacagtaagatcattcttgaggtccaagtttgaagaaactaagggtcaagttactgcagaggcattggacgtgacagaaagcagcctgatacccatcgtgtgagggacagatgctctattcagcattcctcaggattctggttctggtacaggaggtctctcttatattgc

SEQ ID NO: 497125 - DNA, 119 bp, Homo sapiens
cgacaggctgtagagggcacaggtactccaggagatagggttttgtgtgtcattcatgaatctctagtatcaaggacaaggcatgattcagtcatgaacctgttgtctgggatgctcct

SEQ ID NO: 497126 - DNA, 446 bp, Homo sapiens
ttcctgtggtcgactctttatgtcatccccggcggccatgtcggctgtggtaccctgtcggctcaggcgcttccggcattcacaacccctcgctctgccgtgcttacagactactgctcatcctgctgaagctgcgtccgtggcttgggaaacccctggcgcccgcggtcagcggctgccccagaagggagacgtggagatgctgtgcggcgggccgccctgccagggcttcagcggcatgaaccgcttcaattcgcgcacctactccaagttcaaaaactctctggtggtttccttcctcagctactgcgactactaccggccccggttcttcctcctggagaatgtcaggaactttgtctccttcaagcgctccatggtcctgaagctcaccctccgctgcctggtccgcatgggctatcagtgcaccttcggcgtgctgcagg

SEQ ID NO: 497127 - DNA, 175 bp, Homo sapiens
  misc_feature (125)..(125): n is a, c, g, or t
ggtaccccgcggttatgtttacgcaagacctcatggctgctagtcgggctggttaccgctgagccacgatgagactccttgtaactaaagtttcttagtggatatacaacataagtagatgtaanctgagagccactgtttcccttcattgctccgtaagacataaccgcgggac

SEQ ID NO: 497128 - DNA, 604 bp, Homo sapiens
  misc_feature (346)..(346): n is a, c, g, or t
cacgagggggatacacgtcttcggatcgatcccttggaagatccttgatcagctgatggtaggcatccgttcgccatgcttccctcgcaggcaggccctggtcgttcttctggaatttggtatccgccatctcggcgtccagaaaggcctgtagcatgcctgtcacctgtgccttcgagttcgccatcagcgccggcaataattcgtcattgaaccggtcttccagggcgcgcgcctgtttcagcgattccttaagacagcccgacacgtcgccgttggccttctcgaagccatcgtgtgcggacgcggcttgacatatcttgtggatcagataaccgccaccggncgcaccgccaacagccagtccgcccagcagcacgaggcccagcggcggaaacgcgaccgtgacgatcagcatcgccagtgcgcccgctacgctggcgatgcccgccaataccatggccttggtgctgggcgattcgttgtctggacattcgtggatttgggtggccaggtgatcgaggtcctgcagcgcgtccgtaacggattttgagcactcctgtatttcgctgcgtaggcgcaagagctcctgacgcgtgatgac

SEQ ID NO: 497129 - DNA, 435 bp, Homo sapiens
cccgcaggctcctaatcacttgggtctttggaaacaactaaagttcaaagaacgtctcaaattctccattggagttgcttcctgttccaataaggagcattctttccttattgaatgattaaatcctatgcacatctccatgtttcaatgaggtttttttgtttgtttgtttgttcatttgttcgtttgtttttttctgagacttaacaaactagtctggtttgcagagctatctgatcttcgccttcatagcactcatttcaatttataattaaatccctgttgtattctttatttaatgcatgttgctctcagacacaataggcaagtaaactaggtggacaatttagaaatgttctctgtagtaagtggtgtttgtcagtgtctgtatgtttcactgtgtgtgaggtaaaagcggccgcgaatttagtagta

SEQ ID NO: 497130 - DNA, 354 bp, Homo sapiens
cttttggggtctttgctggtactgccaccatctccattaccaggtgttttctgttagatctattacgttaacctaaaaggagagagaaaaaagacaaataattatttccagtaaaactgcctctgattcaactccctttatcagggctaagttcacagagaaatactaacttgtataaaggatcaggtggtaaatatgtgtcctactcagacacacggattcttattgatagttggacaaattcccatctatctccacataacagaaaaaaattaaccaagccaggcgcagtggcacatgcctgtaatcccagcattttgagaggtgaagagggggcggatctgtagagctcaa

SEQ ID NO: 497131 - DNA, 634 bp, Homo sapiens
  misc_feature (503)..(503): n is a, c, g, or t
  misc_feature (524)..(524): n is a, c, g, or t
  misc_feature (531)..(532): n is a, c, g, or t
  misc_feature (541)..(541): n is a, c, g, or t
  misc_feature (544)..(544): n is a, c, g, or t
  misc_feature (546)..(546): n is a, c, g, or t
  misc_feature (553)..(553): n is a, c, g, or t
  misc_feature (561)..(561): n is a, c, g, or t
  misc_feature (564)..(564): n is a, c, g, or t
  misc_feature (570)..(570): n is a, c, g, or t
  misc_feature (573)..(573): n is a, c, g, or t
  misc_feature (587)..(587): n is a, c, g, or t
cccggaaattcggccattatggccgggaattcctgaagctgccagcattcggcccgagaggcctggttccggggcctaagttgggctcgggctactctctctttctggcctgaaggctatccagcgaactccaaagattcaggttaactaacgtaatccagcaaagaagggaaggccaaattccctgaatggctatgggcctgggtttaatccatccgacattgaagttgactaactgaagaagggagagagaatggaaaaaggggagcattcaaactggcctttaagcagggactggcctttcaatctctggaactacactgaattaacccccactgggatgagtatgcctgccgggggaaccatgtgactttgtcacagcccaggatagttaagtggaatcgagacatgtaagcagaatcatggaggtttgaagatgccgaatttgaatggaatgaattccaaattctgctggctggcttttaaatatggataggctaatncactaacacttaatgcccttngatgctnnctccatgtngangnatctgancaggttgntcnacaggnagntctagaaggcttgnaacttgtggggagcagagaattctcttatccaacatcaactcttgct

SEQ ID NO: 497132 - DNA, 178 bp, Homo sapiens
tgaggttgttagtgtagaatggagagtgttgggtgaataagtagtgagatgttggtgatgtatattggggtggtgggtgaatcggtgggactggtagtgcgagtacttgggagaggtgggtgaatatattgggactggtaggtgagtacttgggaagaggtagggcgtatacactggc

SEQ ID NO: 497133 - DNA, 613 bp, Homo sapiens
  misc_feature (503)..(503): n is a, c, g, or t
cccggaaattcggccattatggccgggaattcctgaagctgccagcattcggcccgagaggcctggttccggggcctaagttgggctcgggctactctctctttctggcctgaaggctatccagcgaactccaaagattcaggttaactaacgtaatccagcaaagaagggaaggccaaattccctgaatggctatgggcctgggtttaatccatccgacattgaagttgactaactgaagaagggagagagaatggaaaaaggggagcattcaaactggcctttaagcagggactggcctttcaatctctggaactacactgaattaacccccactgggatgagtatgcctgccgggggaaccatgtgactttgtcacagcccaggatagttaagtggaatcgagacatgtaagcagaatcatggaggtttgaagatgccgaatttgaatggaatgaattccaaattctgctggctggcttttaaatatggataggctaatncactaacacttaatgcactggtagggttataataaggttaccagggccatgacctcctttatattcctactttgagggctgctcctgctgaggtatctgaccggttgttc

SEQ ID NO: 497134 - DNA, 157 bp, Homo sapiens
aagtcagcgagataaagacatcctcgcgcagagcccgcagcagagcactgtaaacattggtatctcttgaggagcagagaactgcttaagatgttcagaaatgatggctcagtagagtgaatatctacacacttccaagcacaacacagccaaggcc

SEQ ID NO: 497135 - DNA, 1282 bp, Homo sapiens
tgagagagaactagtctcgagtttgatttatatttttttaggtgcaaagctagctgaggtttaatttgggaccaaaaaaaaaaagcaatggaatggtttggaacctggaggcatggccaaggggggtcccaaggtattaaatttccccatgttggggcatgagggcataagggttagagcctcagttgggtcttcctgtccccagtgcataccctgaataggagggcctcctttccacaaggctcggggcgcagcgacaagagagggttaagcgctggagatggcggctgccagcagtgtgtacactctggccagggaggttcgaggagggaactctcagacagaccagagtgctttcgccatcaaggtgtgttcttcggactcgtctcttatcaacacaccacaggtgtccccttggaaggaaagcgtggtgtgcgagctttgaagagcattgtggaatgcccggaggccaagagagccaaaacagcgtgggagccccaaaggcgttgaatcttgaagagccgcagggcacatttggtagaaggcgcccccccaaataggcgcgaagtctcaaacaaccatctcgtgaaatagccgcgtgtgggtgggctcttcccgtattaaaacatatctcggtgtttcgttgcatatccccaaaatttacgaaacgcggctcatatcgataggacttttcagaaaaaaaatccgcctgataagggttgaaaaatattagaaatgttcccaggggaccaactttgggcacgttttccattcaaggctcctcgggtaacacaacgacagatttgcagcgagacaagtgtcctcagcattgtgacccccatcaagcaggagcggaatcttaagagtttggggaacacaacctgtgtggcgtgtgagcaactccctttaagattggcaccacttttgtcagcaagcattgatacggggaatttttgaaatgtagagggccccccgggtgaaacgcccttctgggcacatttagagggcccccaaaatctcaacccatagagatcccgcgcatgaatgtacccgggtacagtctaacaaaaaattgcaggacaagggagcgccccaaggaggcaaccccgggggaccccacagcaagggacagagagcgactacaacaagagaatccggggaaaagtgaccaaagccaaacccggggagggtagggtgaaaaaaaccgcggacagtggcctataacctaaacaaaagatggtcgccagatcacaggaaacaggatgttgcccatgcgaaccca

SEQ ID NO: 497136 - DNA, 282 bp, Homo sapiens
  misc_feature (183)..(183): n is a, c, g, or t
gggccttttactacgtgggccatgctgtcattaccccttcgtatagacggaactctgatgcgttaggacgaggctgagtgattggtcattgcgcggagaagatatccgagacagccgacatcagcgtgacagcaggagacgcccgggaggaagaggcagaagtgtttcatgggggtcgaggtncgtgcgtggaccacgctggtggcaagaatcctccatctagttcttgtgctcaagagatccagaacagcaatccattacaggcttacttgagtaatacag

SEQ ID NO: 497137 - DNA, 879 bp, Homo sapiens
atgggcagcaactacggctaggtacgaggcctgggtgttagagagagagagagactagtctcgagtttaattattttttttttcttcttggttctcaaaaaggtcaaagggagcccaatggcaggggtaccaaagtgactcctccatcttaaagaaaatcacaacagagtacctagaaagagaggcgggtcaaaaaagtagtgaacaaacgcttttctcagattcaataggctatcccatcaccctttattgtggagaacggacacgcagagaaggacacttacggtgatgctgaggcagaggaagagcaaaggtgaccaaagaagaggcaagataacagatgtatgaaaaaaagcccaagatcgaagatgtgggttcaccactgcaggaggatgcacagcgcgatagaggataagcaagaagaaaactaaagaagatcaacagagaaatcaccttgatcaggaagaaactaaacaaagcaccaagcctatttggcccagcaaaccctgatgacatccacccaaggaggagtatggagaattctaagaaaagcctcactacatgactggcgaagaccaacttggcaagtcaaacgcacctttactgtaggaagcgtcacgtgggacactccagcgacatgagtaatacattcctcgatagagggactcccatattgaacctttttcgagaaccaacgaaggaacagagaacgacagatcgaattctaatgtacgccgtgagttcatcatggcaccgctgtgaatgagtgaaaccaaagatatccacaatatatccggaggagtaggatacatcatgagaatttgcccgtaaatttccagaaaaaggtcacagcaaaaatctagaagtatgcgaaccatg

SEQ ID NO: 497138 - DNA, 208 bp, Homo sapiens
gagcaagacttgtcttttaaaaaaaatttttgttaattaaatgtctttctcagaacccaagggtagaagagtgaccatgggcaaatgaacacttggattgggtttcttgtgggttttagcttaatttgcatcaactggcacttttctggcttaccgttgtgttccaccttaggcacaatcttcagctcttggcttaaagcctgggaaa

SEQ ID NO: 497139 - DNA, 231 bp, Homo sapiens
ttcagtcagcagtcataagtcagccatggagaagacagaggtttacagaggagaataatgagctataacattcagagaagagtatagagggtagggcgatgcccagttggcatgccagtccacctgtccaaatccttcacacatttcctattaggcttcttgtagattatcaagattccttgtgcattctagtatattctgtccctcgatagtcgaataaggtcttgccac

SEQ ID NO: 497140 - DNA, 184 bp, Homo sapiens
ggaacacgtggtccgacgaggcatcggtgggtcggtgacggatgacgtggacgagccccgtccatcggaaatcgggagcgtcctcggtcccatcagcccgagcacccgatgtcgaacaaggcgggacgggtccggtgaaggacgggtggtccgtttgactgggccgtccgggactacacactaa

SEQ ID NO: 497141 - DNA, 803 bp, Homo sapiens
  misc_feature (803)..(803): n is a, c, g, or t
tgccgagatgattggcctggtaatcgcggcactttgcggtgcctaagcatgagcgatcaccttggaggctcagagagttcaatggtctgtgcatgagctagatatgggatgtatccatccaatcatctccatagcccgtagaacatactgaggccgatggtagtagaccagagatagcgagatgtgatattctgcaggtcacttcagggagagtctgatcgaaagagagcaatccgcagcgaagtctcagggtaggcaagatggttgacacgtaagctgaagatcatgccattgcactccatgcctgggcaacaagatgtgggagactccatctcaaaaaacaacaaattagccaggtgtggcttgggcaacggttggcttcatgcctgtactcctagcactttgggaggccaaggtgggcagatcacgaggttcagggagttcgagaccagcctggccaacagagaccccccatctctattacaaatacaaaaaacttcacttgggcagggtaacagatgcctgtaatcccagctattcagaaggctgaggcaggcacaatccattgaacccacaaaggcggagagtgcaagtgagccaagatcgcaaaagtgactccagactgggcgaaaaggaacgagactcaggcttgaaacaatacgataagtaaataattagataaatatccaggtatgacgtaaggttcaacagattattcaatatatacttggaaaggtaaatgtataggcctttcctcaccataaaaagttaacaaggccaagggatgataagtcatgcctaan

SEQ ID NO: 497142 - DNA, 301 bp, Homo sapiens
gaagttcgacctgcaggagaagttcaagcagcagaaaatatgagatcaatgttctccgaaaacaggatcaacgataaccagaaagtctccagacccgcgggaagggctaaagtcaccgggcgctggaaatagagcctcggcctccttcaccaaagatctgctcctcgctcgcactgcctccggctgcactccccagttcccgggccctcctggcaccccaggcagctcctgtttggaatggggagctggcctaggtgggagccacactcctgcttaccccaaaccacttcacacagtatta

SEQ ID NO: 497143 - DNA, 190 bp, Homo sapiens
ttatcatcatctgattcatcttcttccttcagagattccttagcatatttctctgcttcttctcttatatctttgggaacaatttcatgtcttccattagttactggtaaattaagccacatgtgtaaatgtattttaaatttctactccagtccaatgtaactatttagccctggattatacatactgt

SEQ ID NO: 497144 - DNA, 361 bp, Homo sapiens
aacccccctttatggtttattatttttggattcatggagccctcataaaaatatttttaaaatcagaattattgataccctgtagggcaaaatggccatttttaatggataatcagaagtttgaattttcataaaacatatagcataaaaacttccaggactttgggtgacccttgtatgtcccagctttgctctatttattattattttgccaaataacccttttaacctttgataaagcatatttatggacatattttttaataaaaaaaaaatcccttttattacccttttttatttttttcaaaatatgccagttttttcctatatgttttataataaaaaaaattacatttttgga

SEQ ID NO: 497145 - DNA, 208 bp, Homo sapiens
gtggtcccaagaagcatctgaagcgggtggcagctccaaagcattggatgctggataaattgacccgtgtgtttgctcctcgtccatccaccggtcccacaaggttaggagagtgtttccccttaataattttcctgaggacaagacttaggaatgccctgcaaggagttaggtaaggaggttttcatatcagagcggtcacattaaa

SEQ ID NO: 497146 - DNA, 485 bp, Homo sapiens
attataagttattagaaacaaactgaaaaagaaacatctcatgcaaaaactggcaaattggcagatgtcctttatatacagcacgtgcaaggctaaagtcagtaagaacccagagaaaccaaagaacaggcaggttagagatgccctatatactcacacgcgatgacaaggaccatttcactggtcatcaacgtttttgtttttcgtccatcaaaatcagcatgccttaacaacactggagaaggtgtggggtgaagggtcattaagggcacgcagtagccataatgccacaccctttgtgccagccactgcgcttctggaaacctaccccacagcggtcaaccaaaagacagcaaaggcttctggcactaagctggtcacaaacgcattactaattattgtgcacatgtggaacctaccatttaagcctcctttccaaggcgaaaattcccactactacatcttgccacccttctttaacttac

SEQ ID NO: 497147 - DNA, 843 bp, Homo sapiens
gaggcgtcggagcaggcggcggggcgcgcgctcctcctccatggtgtttacccggctgcatgtgggagtttgacctccgcgccgcaaacctgcccgcctcaagttgtgcgcgccggccgccgccgccgccgccggcacggcatatggggagccgtgacttggacgacgaaggtaatacggggaagcgtctcctcatgtgatggaggatggcgtggcttggagatgactcgggagaattactctggctagtgaaggagttcccataaacgtgggtggcaaacctctggctcccagggaaaggagggggaataataaggccaagtaccaacgggtatggttggagcacggctgggtgctcaattggtggatttttccaagggggggacaaaaaacttttaactaaagtattatgaggattatggatttcttcaaggagaaagtgggaaaattttctggacacacactttttcaccacggacaataggacgtggtagcatagctgggaggcacttggaaaaacttggggtggaggtggcaaaaaggcaattttcttttcaagggcaaaaaggggaattcggagaaaaattggggcgaggaattatgactggtgtggggcaaaagggggatttcaagacctattccagaaggcgtttgaggacattaggggaacttagagggctctgggaacacaggaatttaggcgattctttccacactttaaagaaagtgtagacgataggctggaatggggacggaacaggtcactggtcttctagtacattcatgaattaggcacctggacaggtgaaaatctcagggagaggagcaggaagcagctgaacg

SEQ ID NO: 497148 - DNA, 669 bp, Homo sapiens
tggacttgaggctcccagacccccctcctagtatgcccggcttcagtcaccccgctttactttgtaccaggacccccttcccctacgctcacctgctatttattgctgttatttattgacctccaaaatgctgcataacagacctcactggggcaaggaggatcccccgggctcccaccctccacttggcgggccccctggggccaggtcgctgaggggagcctctcttacccccccccatcactagcgttccctctgccctctccccaccccgggggggacccacggttgggcactggctcattttctcgcacaatacctcgaaggggaggggggagggatggggttataactgttttgtttaaattggaactggaagagggatcatgttttgttttatgcccttccccgaaggggggagggaccacccgggagtcgcacctcctgtaactggccacccgcccgcctgtcacacttgtcaccacattgagttcatgtcccctgagaggttgtataaattcaggtcagagctgcagctacacagctgccccgtgtcataggaaagccattcccccacggctgatctctcccttcagaagtgggccgttttaaatgtacagcgataaggaactgttattttatgatcttttcattaaaagcttgattgga

SEQ ID NO: 497149 - DNA, 405 bp, Homo sapiens
ccccgtggaccattctgacaaggactccacgcggatctcatcaagctccgaggcacaccgagctcctcctctgtgataccctgccgcccacagtgcttctgctccttcaggaggctgccccacttctctagaccatctagggtctccatgtcaagacgtcacctcctcagagctactgcctaagcaccttagcttcaactattcccccaaatagtcccccaaatcctccctaccctcccctaactctcatttctcttctcgcttctctcacaagtcattttatatatttttaataatcttgtgcataaaacaaagtttgtatacaacgaaccattttattaccctttgtggaggtgtctgagggaatctgggcatgtgtggaaaagacacatcacagctggaggg

SEQ ID NO: 497150 - DNA, 1883 bp, Homo sapiens
cctcgctgatatcgtgctggtccgtagaatggttggtccggttgcttctcgcttgtcgctgaagggtcgtttcggcggcgttgtttagttgatccaccacctgggggtattttctctccggggcgagttgtgcctgcctcgagggtcatgtgttggtctagaggaagtatttgtgtcgccgaagattggtcgtctgtggatgatgttgctgtgtgtgggcgtgttggtgagctgtggagatgccgccttgatgccctgacggcacggtggtgttcattcggtgggaggggaaatcttgtctgttaggagccgcactttctcgcggaagaggatgtcttggtttctgtgtggtcccccccttggtgcgaggtggtggagcagtttgtactcgtggtgtgtgctgtgctggcaccggttggggggacctcctcgtggggtgttgtaaactttccgtttggatgctcctatacagcgcccaagggagtaggtgtattcgcctctcgcatccacgcgtggcgccgtaacccaccgtgtgtgtagttgtcgcccacaccaatggtcgcaagaaaacatttttgtgctgggggagtatataggaggacacccaacacatgggtgtggttaccaccacctccttctataagaagataattcctcaccacatcctgttggtgttatttattgtaaacattacgctggttgttggttatatgagtattgggagtgatctgtcgtcgggcacataacgttgttgtgtgtcgccctcacagaagaatattggttggggagaggataagggcccaccacctcctctgctgtggagttgtccaacaccaccgacttgctggttgtctccagcaggagtcctggtggagccctcctctgcaggagttagtcttgccagtgttgtggggatgaccacgactagaaggccctacttggcgccccgacatattattagtaccgcccctgttttgacgtcgttgtgggggaccgccctccttggtggacgattgttcttgtgcacttgttgtgttgtgtttcccaccgcgggaatatatatcgctgctcctcaacacaaaggtgatatctgcgtcctgagggcagcgttctgcaccatcatgatagatatagaaatgatatatgttgtaaacacatcatgtgtctttgggaaagggaggtactctggagggtgtgtgctccactgcgctgtgctgtgggagcatcgtgttctcacggcggtactctcacagagaagcgctttgtagtagagagagcgataatctctgtgagacacaccctctggggataagagacactgtttggtgtgtctgcctcgccacataccacagagtcgtgagtcttagtgagatatatatctgttaagactctagtgcgagatacttcgatataggcacacacacagggcgatatatgtgtctgcggtgtgtgtgagatcgcgatatatatcacatatatctatatattgcgctgggccacatagaaattatgtgggtgcgcctgtctgtgtgtgtctctgtgtggacactctacagtctcacatctgtgtcttgtctctgtctcacactcacactgtgtgacacacgtttctccctgtaatatggggctgcacctgtgtaacatgagtgtaagaatgtcgtgagcgtgatgaactcttccaatgtgtgtgttctatatatagagagaccacacacctgttgataaagagatagggggagtactgtgtgttccaaaaggcacacaattgtggtaaccggctctcgtgtgcccaagagcccaccattaccttgccagaggccccttcttgatgtgtcacacctataggcgtccttatgcctattaaattatttcgcaggtccgtt

SEQ ID NO: 497151 - DNA, 853 bp, Homo sapiens
cgcgccccccttctccgggtccgcccctcccccttctcggcgtcgtcgaagataagggggagttggccggcgagcgcctagtgtgtctcccgccgccggattcggcgggctgcgtgggaccggctgtgggatccctggccagccggccatggcgtgtggctgtactcgctggggagtgagctgtcttctccgaccagtgcgtggaggaagtacatggaggacgttactcaaatcgttgtggagcccgaaccgacggctgaagaaaagccctcgcctgcggcggtctgctgtctcagcctgtttgcctcctgctggccgtcgcctggcctgccttccctggctggcgaagtctcggggcaaatggcccatgtggttggcagcccgagaggctcgcgagcctctccctggatctgccggggccctcggcctggcaccttagccgctgcttgcctgcctgcggtatccgtcctgtggccctttttctgcccgttgtgcggactgtgtgcactggccggcccaggtgaaggcggggcaccacgtttgtggcctggggaagccacatatgatagagaggtatatccatcacaacgaaaggcaagaaggggttacaccatcgtccagagaccgggcctaaacggggatctatggccgcctgggccacattacccggcgactaaagggagcatatatccattcggcctatggtacaccccatttggcccaatggttgtgacaaccgaacacatcattgcgtcagagcacattgggcccccaaaatgcaccagtattgcacccgcggaggattcatatcaccgtaagcacacacatacaggtgtggacacaaacctggacc

SEQ ID NO: 497152 - DNA, 576 bp, Homo sapiens
ccgccggggtaaacatcctggtttccggtgtcacggcgttgtgtgtcctttcgccaccctccgtaggtcgcctcttggggcgggctatttccctacatcctaggggggctgatagcaggtccgcctgcgttatgtttgtagcccccgcgggctactacgtggcccagagtgccagatgcttcaccccttgtggaacggggcttctctcccccgcttgcgttcagcacgggtctgtttcatatcgcctcgatgacgctctcgaattactgtgtctccgcagccccagtttttgatcctccggtcctgctcacataatctcctttcattgacccgttgacacgggatccaagtctgtctcgacgtcatccccccccccactctctttgacgaagacatcttctgccccactccacattgtcccctgcgctcccgcagggcggctgatctgtgatgtccacgggttgtcatgtcccagcgcaaaaatagcgatctcccaccttgtgtatggtgcgaggctcccggggaacgtcttaattgacccctttaaaaaaagaacccacaacgccaaacatgaca

SEQ ID NO: 497153 - DNA, 100 bp, Homo sapiens
cacattgtgctggcttaaagtaattaatctgtaaatatactcctagtaatttaagatttgtttttaaactggaaataaaagatgtatagtgcatgtttag

SEQ ID NO: 497154 - DNA, 926 bp, Homo sapiens
tcctattgcagccgccgggagtactgcagcgaaaaagccggagtggacgtgtcttttgaaagtgctgctctttcacttctcaggcgtccgcgagagctcaggacccaggctgatctctgtaccattgggaacagtgacagctgatgcgtctgtgccgtgttttccagagttcctggagcatcagttgcttcagattaccaaaactgggggaggaacattgggattcctgaatttcaaacaactggatcagatggctgaggcatgacttggaacgccttagagaaaagagactccaggcactaaggaaagctcaacagtagaaacaggaatggtttctaaaggccatggggcaatacaggagaaatccctagtgaaccgagccatttcctcacgatgtcaccgcaggaagttgaacacttgtggtttgccatttctacagagaactccacattcaggtgtccaaatactaagacggacatctggcaatatttgtccacgaaacattctcgtagaccaccaatttttggaacttgctgtggacactgcacctttcttttgtgagagactgcaatatcaaaggtcatttctcatttagcagttgctaaaaagtactgggaaacaccatgatatgttgttgggggtaactggccttggaaaattgagatgactttcacaaagcacctttacgccatggggggcccggacttctgaattctcactactgtggacttacttgcgcccatatctgacctaagaatttgccacacttcacacgtggaataacttccgggcaaacacttgtccactcgaggtgtaagccctatttggagtgctaaccgcgaaacgtttacacctatggtaatgggccaacacatcgtacgcgtacctagctcgtttgcgcctttatagacccttgggggttgatt

SEQ ID NO: 497155 - DNA, 105 bp, Homo sapiens
tggtgcctcgcgtcggaatcgacagcctcgcgaggtctgggcggacccttcggacgactggacgtcgagcgtgacgccgttcttcgcgaggatcgtcttgtattt

SEQ ID NO: 497156 - DNA, 410 bp, Homo sapiens
  misc_feature (76)..(76): n is a, c, g, or t
  misc_feature (92)..(92): n is a, c, g, or t
  misc_feature (114)..(114): n is a, c, g, or t
  misc_feature (192)..(192): n is a, c, g, or t
  misc_feature (194)..(194): n is a, c, g, or t
  misc_feature (238)..(238): n is a, c, g, or t
  misc_feature (277)..(277): n is a, c, g, or t
  misc_feature (313)..(313): n is a, c, g, or t
ataaaaagcccatcactcctctagccaaaaggaaacaaaataaaaatgcccttttacttgtacaaggaagccttgncttggtgtgtttgttncttactatcccaattcttgagncctgggaggggtctgggaattggaccttagcacatttggggaaaggaggggaatagagggaagagaaatcaaaggggntngcaaagttctggctaagaaggagagattggaagaaaagcaaggnctgccccccccagatcccactcacccattcatgtggatncccactactggcggtcttagagcccataaaacctcntttcacctaatccacctgcagagccctcagagatgacgtcagccaacccagctggactgccttacttctgcctttttcacctgtatgttaaaaaaaa

SEQ ID NO: 497157 - DNA, 493 bp, Homo sapiens
  misc_feature (473)..(473): n is a, c, g, or t
caccacacctggcaagggtacctgacattctaagatatcaagacacttaatatgtgggctattagctgcttatttaaatgttgaccaaattgtctgatatatctgattaatcatgatttcacttcatttcggaagaaaaattatccatatcatttttaaagacgcaaatgactttggatttttgcatagagtacaatagacacttcaaacaatagattctaacattctctgaaacacctgagatgtttgagcgaccatttatatgggttatctatatttagtttaagaaacgcgtataggttaaaagatctgttaaaaatggtccatatctgtaaaattgtctcaaacgattaatatattgttcgtcgtcgttttttcttcatacgttatctagttatgcagcactggaaacagactgaagatcataaaccagttttatcagacctatgtgcaataaagcctcttgtttgtgncatgtggagaaaaaaagagg

SEQ ID NO: 497158 - DNA, 651 bp, Homo sapiens
ggggaaatagtttgcagataatggaggagtaaccctacaactatatgtccttagttcttacagaacctcatagtttgagaacaagagctgatgcaactgtatttatacaaatatgaactttggtccagaaaaataacattaacctcattgtttatggccatgctttgtgcataatcaaagtttatgattacatgtaaggaagtggtatctagtcagtccataaagattgtgctaattctgttcgtggaaaagtagccattagttccaggaaactcagtgtctgccttcagatgtcattgatgtttctcctgtgtggaaagctgatgtgtccagctcaacctttgtgctgacatcataccatttctgatcatgaaatattggctactggtgtatgtagcagttcttaaatcagcagtattcatgagaagagaaaattgccccctcattagacactgttgtaacgaaatcttctttaatacaagtagacaattctgtcagactacaaatgtttagctgttactcatttctagggaacgaaattctaaagtccctccttcactttgagcagtgtcctaatccggactcaatggaggagagtagttttactgctgaaggtaacttaaatttgagactatgtagtcatgtgaccga

SEQ ID NO: 497159 - DNA, 179 bp, Homo sapiens
  misc_feature (90)..(90): n is a, c, g, or t
  misc_feature (92)..(92): n is a, c, g, or t
  misc_feature (103)..(104): n is a, c, g, or t
ctaattatgtttttagacacttagaagttattgaggactttaaagagcttttgtttatttgggttaataccccccgacatttgacgttgnancaaaaaaatannatgttatcttttaatttatgttaaaatagcattaataaatcagttataggttaatgtagataggatgttttgtga

SEQ ID NO: 497160 - DNA, 813 bp, Homo sapiens
agcggaccagggtcggccagggcgcgctgcggatacaccgggacgccccctcagccgcgacagtaacggcctccggccaccaggggcggccaggcgcgctgcggatacaccgggacgccccctcagccgcgacagtaacggcctccggccaccagagggcggccaggtcgcgctgcggatacaccgggacgccccctcagccgcgacagtaacggcctccggccaccagggggcggcacacgggcctcaaactgtaaacggctccgggcttcggaatccgggcggggagcggagagcggttcgcaaaagccagttggttgcccggatgccgggcatttgtccacgggaatccgcggccacaagcgggcgtacgacagaccacgcgcaaacagttcgctcctttctttgcatgaaagctatatgcatctagtgtgacggattatcctaacctggagactgtctttttcagctcggcatcacggggggcggggggcggtgaccccccatcccggttcccggggggcggtgacccccatcccgggttccccgggggagcggtgaaccccgaattacagggttcccgggctttcttctgcatcagaccgggttcctgggcttcccctttcgtggtttaaattcttccttcggggttcacacacagggtccacgtccggggggtccctggctataccaaacattaccttcctccctaatgttgaaaaccgggttctccacggagaagaaccttggccattccgaagttttaccagcctcgggcaggaattcgtacatgcactttttttccagttcaag

SEQ ID NO: 497161 - DNA, 466 bp, Homo sapiens
gagaaattgcgtgaccggacagacagttgctcaggaagaaacagccccaggatctggagagtgaatctgaccagacatggatggggccacaccccatcccccgatttcaaaaggcagctgctaatttctgtccactttggtggttcccttccctgaccacccaggagttagccctgtgtgcagataacgtgattcccatcttaacacataaaccgcatttccccgccgaggacagagcccctctcatcactgctctatccctgacctggaagacagcagcaccccaggtttaaagagaggtgaagactagggcgatcctgagagatgacgtctaaagcatctcccgtgggtccctgcaccagtcgtgcactcccggcaaagtctaggctcacagttactgtccacagtgacagaggcattcccgtcctctcactcctcactccccaattcgctcatcctttggagg

SEQ ID NO: 497162 - DNA, 211 bp, Homo sapiens
agctcgcaccgctctcgtgaacttccgtgagactcgtacaccatgctcatggcaatggcagatccttaaccactgagaaaggccagagatcaaatccgcatcctcatggatactagtcaggttcttaacctgctgaaccacaacaagaactccctagtctctgtcttttgattagagaacttaatcctcttacatttaaagtaattcctgg

SEQ ID NO: 497163 - DNA, 417 bp, Homo sapiens
tgggaacatcctatactgcacaggagaatccttggaacaatccgacatatcagctgtgccaagattgagaaaccctacatcgaagaatactggccctacagaaacactgaacagacacatgtaattcacaaagggaatgttattaatacagctacctataaagaaataccaaggaagctgggcgtggtggctcacacctataatcccagctatttggctgattcaggcggatcaactgaggtcaggagttcgagaccagcctgaccaacatggagaaacccagtctctacttaaaaatacaaaattagccgggcgtggtggcagtcgcctgtagtcccagcaactccagaggctgagacaggagaatcgcttgaaccccagaggtggaggttgcagtgagctgagatggtgccactg

SEQ ID NO: 497164 - DNA, 535 bp, Homo sapiens
  misc_feature (469)..(469): n is a, c, g, or t
  misc_feature (483)..(483): n is a, c, g, or t
aagtgcagctttgttacatggatatattgcgtggtggtgaagtctgggattttagtgtaccatcccccaagcaatgtacattgtacccataagtcatctctcaatcccccatcccccatccttccacgcctccagtgtctgtcattccaccttctatgtccatgtctgcacattatttcactcccacctacaggtgaggacattcggcgtttgactttctgtgcctaagtcatttcacttaagataatggcctccaggtccatccatgttgttgcaaatgacaggatttcattcgttttgaggacctagcagcattccgtgtataaatgcaccacattttctttatccagccatctgtttatggacactcaagtcgatccctgcaagaactaaggcatgaaaggtgggagaaaggaagactaggcattttttgggatgcctactgtgtgacaggtgctttcacttggcntcctcatttaaccntttcaggcaatccactcagtaaatacctggggcccgatggcgggtttcatga

SEQ ID NO: 497165 - DNA, 444 bp, Homo sapiens
cataatctcgaaaaactggaaggagaaagacaagaggctcaagacatgcttaatcactcaaaaaaaaaaaaaaaaaaaaaaaaaaaaactttgggggcggccggaggaccctggaagaaagctttctataacaacaattgtgggtgtgggggccgggggccccccaagatgggttaggtggaacaagtgggccaaaaaggggtgacacatagaggagaaatcggggaaaggagaaaagagggggggggaatttcttcacccaaattaaaaagacggcccgggggggggaaaacgaggaggcggtttgtgagaaaacaaacttccaaaagggggagttcagggaggggggcaaaaaagggggggactaattaaaaaccggggggacgtcccaaagaggagagccgaagaaatttaaaaattttaagcccccgagctcgggggggg

SEQ ID NO: 497166 - DNA, 970 bp, Homo sapiens
gatataagagatcgcgcagagtcattgactccttgtgtcgtcctcttatggtacttcccgcgtgttttcgggacactccttgttggccccgaggacataacaaacgtgggcactaaaaattttggcgggggcagaaaatattaaaaatttgacagcacgtgtgctcgacaaccaacacatttccgcggcccacatccaacaatctgtcgcccttgcaggcctgggtttttccccggccaggatcttttggggtaccaaggcctccccccctaccccgtcgggtttagggaagcccttgcgatttaagccttgtgtccccgccgccccctttgcacctgctcgcctggggaagaagacgccggtcttctcccctaggggcgccaacacggagtcatgcccccgatgggcgccacagggggccttgtagtagacccccttcggggcggccgccagttggtgatttcaacacccgggcgttttcttacacggacctcccgcggagttccttagtccttcatgagatacttcaccacctctcgcccccgcttcatacattgttccaaggcaacttaattggcgagactctgtactatgcagggagcccgttgttgtgcgtggcaatcggcccacccccggggatgcccccccctctctgactcgaaatcccctgtgaaggttttttttgtcaaaaataaagaataggtgtgacacacagacgaaggagaaaaccgcggtatgtattgtaaacagatggtgtccctcgcagagcttgagtggtcaagggcacattccactctccacgggccaccaactgtctacacccataggtggatcgtggtagctaaccagggttgggcgggcaaattggatcgcaggacctccacctctccccgcgccccattcctgaggcttccaaggcctgattcttccccaaaaaagtttttaacccggctttcgccccaaaaaaaca

SEQ ID NO: 497167 - DNA, 221 bp, Homo sapiens
ggctgagcagatcctgtctcaaaaagaaaaggtgcagccactgtggctcacatctgcaatcccagcacctcgggaagctgaggcaggcggatcacttgaggtcaggagttcaagaccagcccagtcaacatggtgaaacctcgtctctactaaaaatacaaaaattagctgagcttagtggcatgtgcttgtagtcccagcccctcaggactctggggtag

SEQ ID NO: 497168 - DNA, 800 bp, Homo sapiens
  misc_feature (43)..(43): n is a, c, g, or t
  misc_feature (94)..(94): n is a, c, g, or t
  misc_feature (114)..(114): n is a, c, g, or t
  misc_feature (152)..(152): n is a, c, g, or t
  misc_feature (155)..(155): n is a, c, g, or t
  misc_feature (159)..(159): n is a, c, g, or t
  misc_feature (218)..(218): n is a, c, g, or t
  misc_feature (227)..(227): n is a, c, g, or t
  misc_feature (298)..(298): n is a, c, g, or t
  misc_feature (333)..(333): n is a, c, g, or t
  misc_feature (379)..(379): n is a, c, g, or t
  misc_feature (382)..(382): n is a, c, g, or t
  misc_feature (386)..(386): n is a, c, g, or t
  misc_feature (400)..(400): n is a, c, g, or t
  misc_feature (441)..(441): n is a, c, g, or t
  misc_feature (447)..(447): n is a, c, g, or t
  misc_feature (459)..(459): n is a, c, g, or t
  misc_feature (472)..(472): n is a, c, g, or t
  misc_feature (484)..(484): n is a, c, g, or t
  misc_feature (549)..(549): n is a, c, g, or t
  misc_feature (575)..(575): n is a, c, g, or t
  misc_feature (592)..(592): n is a, c, g, or t
  misc_feature (617)..(618): n is a, c, g, or t
  misc_feature (621)..(621): n is a, c, g, or t
  misc_feature (682)..(682): n is a, c, g, or t
  misc_feature (764)..(764): n is a, c, g, or t
gcgtgcagaggtgctcaagcctcctcgcggtccgcagtcattnccgccgcgccctgcctcccgcacgccccgcagttagcgcccccgctccgcngcccagtagttgcgctcgcnccggcaccagctcccggataaacggcgcgccgcgcggnagnatgnacagccgcaggagatgaaggctgaccgatagcggggcgcagtcggcgccgctgcccatngagggagtngacatcatgccccaatacaggacgaaggcgttctgaaggtcatcaagatatagggcacaggtacagatttnccctttttttgggtaccgattttttgttccattanatggttggtttttatgttggcacataatttgattccagtctggatngcnaggncaaattctcctttnacctgggaaaatgggaggtcatcaaggcttgggacatttcnatatcnaccatgaaggtnggggatgtgtgcnacatcacctgcnaaccagaatatgcctactgttcatcaggcagtcctccaaagattccccccaatgccacgcttgtnttttgaggtggagttgtttgagtttnaagggagaagatctgancggaagaggaaagatggccggaatnnttncgagaataccagactccgcggtgaaaggctatgctaagccccaatggagggtgctatcgtnggaggttgcactggaaagggtactacaaggacaagctctttgaccagcgggagctccgctttgagattggcgagggggaganctggatctgccttatggtctggagagggcattcagc

SEQ ID NO: 497169 - DNA, 83 bp, Homo sapiens
ttatcttttgtgtataaatctcaaaatatggaattttggaatatttctaccattatataaatatttttaaaggtaaaaaaaaa

SEQ ID NO: 497170 - DNA, 407 bp, Homo sapiens
cggagaggatcccaggcactagcgtcatggcacgtgttattagattatattaacagagaagatcctttcaaaaatatctggttaccgggggctgggagtgcagtgacggtgatcacggctcacggcagccacagccttccagctcaggtgatccttccacctcggtgctccccacccggaggggctgggactacaggcatgtgccaccacaccaccaggctaggctaagggttggtattggttggagagatgcagttgccctaagttgcttaggcttctttggacctcttagactcaaataatctggcctggcatgggtctccccaagtgctggaattacagggccatctaaatcttttatctcaggttggccttgtgacaaagggtggggtactttttctgacatg

SEQ ID NO: 497171 - DNA, 153 bp, Homo sapiens
ttctgtggtcctatgtgctcctgttgtgtgtgttggtggttgtctccctccagaaccttcactgtgcggggcgcaccgcaaagcggaggctgtcatggctgcagttgctggggtgcgggcgcctttctctcttgggtgcggccttttccctcc

SEQ ID NO: 497172 - DNA, 140 bp, Homo sapiens
tacgatctttaccatccggccttacctcggtaccttacctcgtgaccttaacctcggagccttaacctccggagccttaacctcggagccttaacccttcgacttcaagtctcgttgaatatttgtactaccaccaagat

SEQ ID NO: 497173 - DNA, 521 bp, Homo sapiens
ggctgacgccattttaggccttagcctgcctgcgacccaggcgctcattaaaacagcaggttgctccacactgcctcgtgtggtctagttggcgacacatctcaatgagtttgaacggatacaagaatctttcatctggtgccgaaacccgggaggggctccggtcttcgtcccccgtgtacttacccgttcccgccccaagaaaggcaggccacagagccggacaaaggaagctcctcagcctccagttgcttctctgtgcatgcacatcaggcactgatctcacctactgaaaggaatgacaggattctccccagggcctggaaggcttgaaggaatgaataacgtcgctcccttctcaggcccgagtcccgaaggcgcgaaggccactggtgccaggaggtgagtcagcgagatagcagaagcaggaagagagccggccagaagacacctactcggacggggagacacgtgacccctgaagatgagaaagaggcatccaggcagtgaagatggaatga

SEQ ID NO: 497174 - DNA, 250 bp, Homo sapiens
  misc_feature (155)..(155): n is a, c, g, or t
  misc_feature (189)..(189): n is a, c, g, or t
  misc_feature (206)..(206): n is a, c, g, or t
  misc_feature (220)..(220): n is a, c, g, or t
gccgagattgcaccactgcactccagccctggcaacagagcaagactccgtctcaaaaaaaaagaaaaaaaaaacacagctgcctactgcttgcaaccaagctgtagctcttattaaagtaaagagaagagagccctggagaccagcagaaactngacatttgaagtcaggcctctacctcctgagctngagtcagcagcctgggntcctccaatgaatnattcccatctttacttgccctcttccgatt

SEQ ID NO: 497175 - DNA, 414 bp, Homo sapiens
ctcggaacgtgttatccctgctagctggacccagttagcaggtagaacacgtgtgttgcgatgacagactatgccaagataggtaatggatggagaagaaatgtgggcttatagagggggatacatgattcccctttgagaatagatgttgaaggagcaggagggtatcctgtggggaagattcataagaggggatgcagaggagaaggtcgtccacatattgaataaggtgagaaacagatggagagaaagaaagtaaatcatgagaaagagcttgactaaagtaatgggggttgtctctgaagccttgtggcagtacagtccaggtaagttgctgagattggtgggtgacaggatcagtccatgtgaaagcaaaaagaggtcgggatgaggggtgcaaggaatagtgaagaa

SEQ ID NO: 497176 - DNA, 728 bp, Homo sapiens
agtgatctatcaagctagccaggctcttaactgctgtgtggatgatgaacatggaacagggtccctagaagaagctgaagcagaaagagttcttctaactggcaactgggaagagaacactttgattgatgaattgcataaattgaagaacgaagggcctcagaggaagaataaggctagttccccagaagtgaatttatgccatccaaaggatcagttacttgtcagaaatccgcttgcctctaaaagcagattgtcgtctgcagtacggttcagaaagccagatgcagcagattactatgtacttaagtcatactaaaagcaggagctgaaagatatggtagccacacgcattagcaagtacttcaagactctcttaacggctgattgctctgacacttcactactacatttactctgcaaggatgtatccaatgacttccgaaatagctatcgaagtcttacagctgtggctgcttccagaaagatccctcaggccttgcttacgacagacccaatatctcacgtcacaaggcttatcacctccaacgtgctgactccttcacattctattgtccctcactctgctccagcttcactccttccagcccatggctcagctcctgcgaggtcccagctgtccgctgcgactgccagccaacctcccgccccttgtgttggccctccctgcacattgttcctcgcccttcccgccgggaccaccattc

SEQ ID NO: 497177 - DNA, 547 bp, Homo sapiens
catcccctatgttgtcctgccctgatgccgctagagcagagatggcaggaaggacgtatatgtttatcgtattagacagctaaagattcctgttagcagcaccacgaaggccagctcatagggtgacagtatcacagatgcgtttatgtgcctacagttcatggactccttgcatcagcgtgcagtcgactggaacgtctctggccttgaaaacccctgggcgccaaggttgcagtgagaaagcgagaagtgaacgcgaacccaggtctatcagctccaagctcctaactggcgggccacttgacgtttcctcaggagtgacatgcggaccgcctgcaagctacacagcctgggtcggcccggggtgaccacccttcgggcttggcacactctgaggtggagcaggttggggaagagctggagctggggacacagccttgcccgtgggtgggcagggcctggtgggctcaggggccccaccggctgctcaatgaccctcagcaccgtccgcttgatgtcggcgatggcttcagtgtacacgggcgcc

SEQ ID NO: 497178 - DNA, 560 bp, Homo sapiens
tggttgaaagacaccagaagatttagaatattccataaactgagttgacaaagcagcagggtttgaaagaaatgacaccaatgttgaaagcagttctactgtggataaaatggtattaaacagtaccgcatgctatatgaaaatctttcatgaaaggagagtcaatccatgtggcaaacttcatcatcttattttaagaaactgccaggttgggcaggcgcagtggctcatgcctgtaatctcaaaaaaaaaaaaaatggccaggttaccccaaccttcagaaaccaccacactaaggggtgagcagtcatccacatggaggcaagacactctaccagttaaaagataaggactggctgaaggctcagatgattgttagtactttttagcaagaaagggttttttatttaagatgtattcatggttttcttagacataatcctatggcacttaatagactacagcataatgtaaacataacttttattttattattattattatttttttttgagacagactcttgctctgtcgtccaggcgggagtggagtggggtgaa

SEQ ID NO: 497179 - DNA, 332 bp, Homo sapiens
  misc_feature (28)..(28): n is a, c, g, or t
  misc_feature (161)..(161): n is a, c, g, or t
  misc_feature (175)..(175): n is a, c, g, or t
  misc_feature (216)..(216): n is a, c, g, or t
  misc_feature (262)..(263): n is a, c, g, or t
  misc_feature (287)..(288): n is a, c, g, or t
ataaatgtcaggaatgtgggaaagcctntgatcgcccaagtttatttcagatacatgaaagaactcacactggagagaaaccctatgaatgtcaggaatgtgcgctttcatttctcttccaagttttcaaagacacatgattaggcacactgggagatggnaccttataaagtgntgcaggaagtgtggataatagccgtttgacgcgctcccagnttctatttccgagagtacagtgagaaggaaactccatagcatgganngagaataccccgaatgaagtgtannaacagtgtagggacaggccccttcatttgcgtttcaacaaattt

SEQ ID NO: 497180 - DNA, 161 bp, Homo sapiens
gcccttccccaccactaacggaggaaacaagttggctcgggatcccgggacgcagggcaccagcagtccctactcttcccgggaaggatcaatctgaagtccccggcggcaagaagagaagggtgctcgagccgccgccatcttccccaacggaacttccc

SEQ ID NO: 497181 - DNA, 116 bp, Homo sapiens
aggagcgttgctgtctcctttctcccgccaatgggtgtgctcgcccacctgaataatcgggtgtactccgaaaaagggggggaggtcaatctggcaaaaaaatgtcacttttgcct

SEQ ID NO: 497182 - DNA, 1094 bp, Homo sapiens
  misc_feature (140)..(141): n is a, c, g, or t
  misc_feature (143)..(143): n is a, c, g, or t
  misc_feature (176)..(176): n is a, c, g, or t
  misc_feature (253)..(254): n is a, c, g, or t
  misc_feature (268)..(268): n is a, c, g, or t
  misc_feature (336)..(336): n is a, c, g, or t
  misc_feature (401)..(402): n is a, c, g, or t
  misc_feature (432)..(432): n is a, c, g, or t
  misc_feature (490)..(490): n is a, c, g, or t
  misc_feature (494)..(494): n is a, c, g, or t
  misc_feature (553)..(553): n is a, c, g, or t
  misc_feature (574)..(574): n is a, c, g, or t
  misc_feature (632)..(632): n is a, c, g, or t
ggggaagcgacgagtccgggacgcccagcgcgggcccggagcagtggggaagggaatgtgctggctcggtctggcgctgggtggatgggggctgtgatggcctgccctactggtgtgccgtctgatgggacggcgctacnngntcccacgctaggccaaacgcctccggcggccgngccctgagagccccttcacctgcagggctgacccagccggcgacgctgtgaaccacgccctcagcctgccttgccanntgcccccagcctgngcgccccagcaccatgcggcgccctgcgcacggagccccgagggacatggggcacccgcaggcccggnccctagcaccgcctgtgccggccccgaggtccgggacgccggctgccgccgcggagagggcaccnnggccgacgcctccccccagggtcagctgcngggctcccaggcctaggcgcccatgacccctacgccaacagccgcctggacaccgccngccngccactgcgacctagcgccgccgccgccggggcccaatgccggtcatgcccattccgcnggctgggtgcgctccttccancgtggccgcacaccaactgcgctgcatgctggcctgcgggcccgtgcgcgcctcccanctggcccggaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctagctgctgctgctgggccgcgggcgcgtgcacttccgcctggtgaacgagctgatcgtctatggcatccacgttacaatgatgttggtcggggctgggttggtggatcagtgggaccgtaggagacattgtaaggggcggtggttggagtttagtggtatcgaccgggcttagggtgaggttactccaatgggtgggatggcagggcatcgcttgaaaaccaaggagacaaggtacgagggacacaggggagagaaggggagattgag

SEQ ID NO: 497183 - DNA, 1121 bp, Homo sapiens
  misc_feature (459)..(459): n is a, c, g, or t
  misc_feature (517)..(517): n is a, c, g, or t
  misc_feature (521)..(521): n is a, c, g, or t
  misc_feature (580)..(580): n is a, c, g, or t
  misc_feature (601)..(601): n is a, c, g, or t
  misc_feature (659)..(659): n is a, c, g, or t
cggtgctcacgcggagttggccggggcccgttgcgtctctgcggcccgaggaaacagtgcctgggtccatggtgcctgggcctgagcgggcgtctgcagaaacgcagggacccggatggagccgcgggccgcgagaccctgctgtgggacacatgctcctgccgagtcagctgtttgatgtggcacctgccatggcctggggtccctggcctggggcgagctccagtgccaatggcctggccttaaatagtggcctgctctggcccctgcaccccgtggaggagcctggtgcggagtggacgagggcgatggtctgggcccctgcgggcacgggagggtcagtgcggccccggcccctccctcctccgccctggccatggtccccacggcatgggccccaggctgaatctgaagattatttcgtgcaaggcccgacgcctccccccagggtcagctgcngggctcccaggcctaggcgcccatgacccctacgccaacagccgcctggacaccgccngccngccactgcgacctagcgccgccgccgccggggcccaatgccggtcatgcccattccgcnggctgggtgcgctccttccancgtggccgcacaccaactgcgctgcatgctggcctgcgggcccgtgcgcgcctcccanctggcccggaccaagtacaacaacttcgacgtgtacatcaagacgcgctggctgtacggcttcatccgcttcctactctactttagctgcagcctgttcactgcggcgctctggggtgcgctggccgccctcttctgcctacagtacctgggcgttcgcgtcctgctgcgcttccagcgcaagctgtcggtgctagctgctgctgctgggccgcgggcgcgtgcacttccgcctggtgaacgagctgatcgtctatggcatccacgttacaatgatgttggtcggggctgggttggtggatcagtgggaccgtaggagacattgtaaggggcggtggttggagtttagtggtatcgaccgggcttagggtgaggttactccaatgggtgggatggcagggcatcgcttgaaaaccaaggagacaaggtacgagggacacaggggagagaaggggagattgag

SEQ ID NO: 497184 - DNA, 237 bp, Homo sapiens
cacactagagtatcccctgtattgctggtgctggcatacctaggctactaacagaccgcaacgttaaaattaccttttttaaccccgcgggaagaggacaccggatcctataccaacacctaaagggaactacccgccaacgagaacttgagattcttaccccaccatgcttgggaccagaccaccataaaggcacttactgctacggacaaaacgaaccctagggacacctatgca

SEQ ID NO: 497185 - DNA, 126 bp, Homo sapiens
ccaagaggtgaatagagagtagacacctgaacaatttagtgattctgcaagggcaggtgatgatttaaggggttccgtatggtctcatctggtgttcaaaacaaaacagtcatgaagtcttggtgc

SEQ ID NO: 497186 - DNA, 833 bp, Homo sapiens
ctcagtggcttatgcctgtaatcccagcacacgcctgtaatcccagcacacgcttgtaatccagcacttggggagccaaggtgggaagatgccagaagccaggtgtttgagaccagtctgggcaacaaagtgaggcacccatctctgttaaaaatttaaaaattagccaggcacagtgatgtgcacctatagtcccagctactccagaggctgagacagggagatcatttgagcccaggagtttgaggctgcagtgagctgtgatagcaccactgcactccagcctgggcgacggagcaagacactgtctctaaaaaaaaaaaaaattcatcaatcctccatctgtgactcggcggcttactactggtatgtgacctgtggcaagttacttatcctatctgtgcctcagtttccacatctggaaatttcggtaatagtatctattcataaggtggctccagattgtacccccatttacttacttagaataatgtgtgtcccatactaggctgtaaatgagtgtacgctatgcggcatatcataatatgctctgcttataaaacccagaagttaaaagtccggttcacctgttacagaggtagtacttcccccgcggtttacggggagtaatcggtaactaacaggcacgcgggactaccttgggaccggtgacgcaattcttgcatatgggggaccccttggctagataatttccaaaaacacacaaaaaaattttggcgccgccaagattaactcctggcggcccagaagaaggcacgccagacgcgaagggttcacaaagcggcggctgacacaggcgctcgcaagcggcc

SEQ ID NO: 497187 - DNA, 409 bp, Homo sapiens
ttcaatcatctagctaatggtcagtcttgtctcatctctacttgcttatttttaaacaaatgctactatcagttcaatatatagttcagaattctctctacagtgtttagaagaaaacatgcatattacacgtagcacaacagcacctatgagtaattaattttaatgtcagatattcagacagatatcaaatttccccagttgtaactcactacctcccacccccatgcatatgtggtataggttgttggagtcaggatccaactcacgttcataattcattgataattggttacgatcgataactgtcacgcttataaactccccacctacctcttcttagagctcactagaagagaaacttggctttttatacattatctagagaatcttttgctgcatcacggtc

SEQ ID NO: 497188 - DNA, 180 bp, Homo sapiens
cgggcacagtcggtggtttgtcgcccggcgagctgcaggacgcacggtgccgggtccccgcgcagaggatcgctggccgggccgggggagcggcgctgacaccggcgctgtccccgcaggcagccggctgcgcatggcgacacctgatgctcgccgagggctaccgctggtgcagaggcc

SEQ ID NO: 497189 - DNA, 966 bp, Homo sapiens
  misc_feature (390)..(390): n is a, c, g, or t
tcgagacctgaccgtcatacttcaaggagcagtttctggacggagacgggtggacttcccgcgtggaatcgaagtccaagagcacaaggtcaggattttgggcaacattgcgttctcagttccggcgagttctacggtgacgaggagaaagatcaaggtttgcagacaagccaggatgcaggctgtttatgctctgtcaggccagtttcgaggcctttcagcaacgaaggccagacgctggtggtgcagttcacgggtgaacacatgatgcatgagacatcggactgtgcggggcggctatgtgaagctgtttcctaatagtttggagccagacagatcatgcacggagactcagaatacaatatcatgtttggtcccgagatctgtggncctggcaccaagaaggttcatgtcatcttcaactacaagggccagaacgtgctgatcaacaaggacatccgtagcaaggaatgatgagtttacacacctgtacacactgattgtgcggcagacgatacctatgaggtgaacgattggaacagccaggtggagtccgggtccttggaagaccgcattgggacttcttgcaaccaaggaagatcaaggagtcggagggttaaaaacggacactgggatgtgcgggccagattgaatattccaaaacattccaagttggggactgggcgaagcccgagaaatattctgacctgatgtataaaagcccgggctggggcaaacacatggcgggcacagtggtgggcccccgtggatgtaaaacacgcgtaaacaggggggtggggcaccggagctatgaaaaaccagatcaaaggaggggaggacacaagaagatgagaccagaattcctacccagcaagttatcacaaataatcaggcggagcacacagtaaacctttcgactcagaagtgcacaccccagaaacagcttcgggatggcagcggacacat

SEQ ID NO: 497190 - DNA, 374 bp, Homo sapiens
  misc_feature (91)..(91): n is a, c, g, or t
atgagaacccatctcaaaaaacaaaaacaaaacaaaaaaaagaagaatgagtctttgcaccaatcccaaaggtgatgtgactctctgtgtnacctggtctctgctcacaggaagaatcgtgacctttcacagcatatggttgatttttttcctgagagactataaatcatgatgaaatgttttgggaatatttttggtactttaaattattgtagaaatttataaatgtgtcggattttggccaaagtggcttaaactgtaatccaaacactttgggaggccaaggtgcgcagatcacctgagggtacgaatcgaagaccagcctagcctacatggtgaaacccagcctctatgtcagattccggggatcctct

SEQ ID NO: 497191 - DNA, 206 bp, Homo sapiens
  misc_feature (91)..(91): n is a, c, g, or t
atgagaacccatctcaaaaaacaaaaacaaaacaaaaaaaagaagaatgagtctttgcaccaatcccaaaggtgatgtgactctctgtgtnacctggtctctgctcacaggaagaatcgtgacctttcacagcatatggttgatttttttcttttatttcttactttttcctgcaggaaagatggtgaaatattaatgaactaagt

SEQ ID NO: 497192 - DNA, 105 bp, Homo sapiens
tgtggatcgggggcacgaggagggctgcgaggccatcagcttcctcctgtccctcatctgacagtgctggtcctctactgcgggagcctggctgggcaaatactg

SEQ ID NO: 497193 - DNA, 335 bp, Homo sapiens
ctctgaggatcccgatgtatccccaacaccattaaaaatacaaaaattagccgggcgtggcggtgcgcgcctgtacatcccagctacttggcaggctgaggcaggagaatcactcaaacctgggaggcggaggttgcagtgagctgagatttctccactgcactccagcctggtaacagagcgagactccatctcaagaaaaaaaaaaaaatccccatttaatgtccttaataaggggtggtacatttattacatggatttatgaagggactagggtagaaattgcagaagggaaaaggttcccatctggtgtggtggggcgataccatcggggt

SEQ ID NO: 497194 - DNA, 452 bp, Homo sapiens
atatacaagatcattactgtatatgagagctgcagtgtggctataatcatcctctagttgtgtgatccaccgggggtgctctatatacgctgcacgtcgcgtatagagagcgctctgactggtacacgatgctttacaacccaagtccagattacgttaccacagtacactggactcatgaagccggctacccactatataccattgtatttatctattacgcattctgctatggtattaatgatgctgctccggactcttctggtgaagaagattgcatgtgggttagggaaatctgatcgatctaaaagtatttatgctgcactttacttcttcccaattttaaccgtgcttcaggcacgtggtggaggccttttatattacgccttcccatacattatattagtgttatcttaggttactctggctgtgtacatgtctgctactgaaat

SEQ ID NO: 497195 - DNA, 327 bp, Homo sapiens
tagtcggtacctggtacgggagtggtggctcacgcctgaaatcccagctcttgggaggctgaggcgagcggatcagttgaggtcaggagttcaacgccagcctggccaacgtggtgaatccctgtctgtactaaaagtacaaaaaaattagctgagcgtggtggtgcgtgcctgtaatcccagctactcgggaggctgaggtgggagaatcgcttgagcccaggaggcggaggttgcaggagcagagattgcgccactgcactccagcctggatgacagagtgagacccaatctcaaaaaagaaatcgtttcccactcccgtaccag

SEQ ID NO: 497196 - DNA, 156 bp, Homo sapiens
attgctggtgtgagtgtaagccaatatgaagaacaatttgtaacactatttactctgacaatgaagttctgttcatcatcttttccatttgagtacgcaagtcgaatattggtatttaaaggaagcatctgctttagttgcatcattggtcgacgc

SEQ ID NO: 497197 - DNA, 514 bp, Homo sapiens
ttggtgtgctgagcgccggtcccctggacccactgttgtttctctatactttgtctctgtgtcttatttcttttctcagtctctcgtcccacccaactagaaatacccacaggtgtggaggggcaggccaccccttcagtgagggaaagaatcagtgcctaataaatgtaggcacctaccccacactccaacttgtgctgtctgaagccttgggcacaatgggcaattcgtgagagtaaggaagtggtggggagggacaagagagagaatcatgaggaactgtgcttagttttgggaaggaggcagccccagaaaagggcactcctccccgtgggcttggaagtgtcactttttacatgacagtgtaagatatttggttgaattgtgtgtgtgtgtttgtgtttgcatatatgtctatattacatgtacatgtagattatatataatatacaatgtactttttccacgtgtatgtataatcaacaataaaatgttttaaaattgagattataaa

SEQ ID NO: 497198 - DNA, 584 bp, Homo sapiens
ggatggcctggccagcacggggaggagcctgggcgagacccatatcgtgctctacggtgacgcggaggagccttacaggagtgtgggcgagctccccagcaccgtggaatcactccagaaggtgcacgagcacgtgtacacgctgctcagttaggaccaagcccaagccgaccgagtgtctcctcaggactttctggacagactttcttctctagacaacctgtaagcctcagtcagccaagtggaggcggacttgaaaatgctcaagactgatgaggacagtattgttgcatactctgtcaaaatagaaaccaacgagaacaatcttgtatcagccaaagggttactagatgacctgaggaatgaactggataggtgtttgtgacagtggggaagattcacgaaaaggtctcaatgaattgtgtgtgagggcagcgctttaaaagccaaatttttatgaccaaaaatgtgagggttttttccatgtgtccactaaccccctttttggaaccttcttgagggagttgtgacaacctgacaccaaggcattggggttattattgccaggttacttatttaccctt

SEQ ID NO: 497199 - DNA, 359 bp, Homo sapiens
  misc_feature (315)..(315): n is a, c, g, or t
gaatcatttgagcagcaccatcttaattggctcattaacatatttgtgaccaggcacagtggcgcatgcatgtagtcccagcacttcgggaggccgaggcgggcggatctcttgaggtcgggagtttgagaccagcgtggccaacatggtgaaaccccatttctactaaaaatgtaaaaattagctgggcttggtggcgcgcgcctgtggtcccagctactcggaaggctgaggtgtgagaatcacttaaacccgggagatggaggttgcagtgagcagagattgcgccactgcactccagcctagggtggacanagaatggagacgtccgtcttaaaaacgaaaaacaaccatatttt

SEQ ID NO: 497200 - DNA, 103 bp, Homo sapiens
gaaacattacacagactgggcagatactttgtgaagtcatggatgcctatgctgagcacaagttacagttctgggcagtgacatgctgaaatccctgggctgg

SEQ ID NO: 497201 - DNA, 247 bp, Homo sapiens
accctatacactatacagcagatcgcgtatactgtagcctttaaattacttaaaatacctaacacaatgtaaatgtatagtaaaactttacacgctgttaaactgtatttttaaaattttacattctttttttcttttttttcttttttctattttggatctgtggttggtttaatctggtggagctgataccacctccccatttttttgtcccttgggattttacaattttttatacctccatttt

SEQ ID NO: 497202 - DNA, 572 bp, Homo sapiens
  misc_feature (329)..(329): n is a, c, g, or t
  misc_feature (455)..(455): n is a, c, g, or t
gcagcctgtgagccatcgagcaatagctaaattctaggcatgagtgtagtctcatgataaggagcttggggctgcaccaaggggagaacattctcctcctgtcattctcctccgtcgtctcgtcagatgtatgaaaatatgcctgtgtatcacagcaacaatggtacaaattggatggttaagcttaatgattccgattcagacggcagtatttttctgctgtcatgagtcccttggcataagtgtggagtgtcgtgatacaggtccacgtgaagacgaggaaactgatgtacttggaagtcgcctcgtttctggacctgctttaccgnagtgaggccaggacattactcgtaccaaggccgttatctgtgctgctcagcgttacacacgccagttattccttgtcctcccttttggggggggggccctttaaaagtttatcccaatgctgtggngcgttcatacaagacaagcttcgaatctgcactgagctggagatccatgagtttatgtatcgtttggtcatgcagggtacaagctctacacatgtctggcatcttcctatccctcac

SEQ ID NO: 497203 - DNA, 743 bp, Homo sapiens
  misc_feature (205)..(205): n is a, c, g, or t
ctcgtggacgaagccgcccgagaaacgagcggtggttgtcgcacggggagtggggtaaaccccgagagggggggttccccccaccgaaacgagaccacagggctcgcgtctgggtaagccacccggtgctggagtacgttggtaagcagaagttgtgagtcattggtagctcctcgcccgccctcgtctccctacagaagtatgngttctgttgttcaacacactttagttctttctaagggacgctccacttttataccgagcatcattttaacacctatgtctatctacaaagggcgaaccaacttccgtcgccttccttccccaatctttttgtgaaaatacataatttttaaccccaccttctcttagataatatctgtacaaacgatgttgatttgttagaaatacaataaaactactcggcgggaaatagccctaagagctaatagagaaaatagaatactcccgcccaatctcctctcaacgcagacgcctctgtctatttgccgccgccgattattctttctgacatgccactctccttcccgcatttcttgtgaatctttttgttgacgcagccacaggacatataaggagaatcactggacacaccgctagtctgtgccttgaaatatcgtggccctcatagtcagtcgtgcaaacggtgtagtgagtttacgcttcaaatggtatataaacagataattagattgggctgtccccatcaataaacgcagaaa

SEQ ID NO: 497204 - DNA, 779 bp, Homo sapiens
  misc_feature (96)..(98): n is a, c, g, or t
  misc_feature (117)..(117): n is a, c, g, or t
  misc_feature (119)..(120): n is a, c, g, or t
  misc_feature (123)..(123): n is a, c, g, or t
  misc_feature (140)..(141): n is a, c, g, or t
  misc_feature (145)..(145): n is a, c, g, or t
  misc_feature (190)..(190): n is a, c, g, or t
  misc_feature (265)..(266): n is a, c, g, or t
  misc_feature (272)..(273): n is a, c, g, or t
  misc_feature (285)..(285): n is a, c, g, or t
  misc_feature (292)..(292): n is a, c, g, or t
  misc_feature (301)..(301): n is a, c, g, or t
  misc_feature (303)..(303): n is a, c, g, or t
  misc_feature (308)..(308): n is a, c, g, or t
  misc_feature (315)..(315): n is a, c, g, or t
  misc_feature (325)..(326): n is a, c, g, or t
  misc_feature (333)..(333): n is a, c, g, or t
  misc_feature (340)..(340): n is a, c, g, or t
  misc_feature (344)..(344): n is a, c, g, or t
  misc_feature (360)..(361): n is a, c, g, or t
  misc_feature (363)..(363): n is a, c, g, or t
  misc_feature (528)..(528): n is a, c, g, or t
ttttttttttttggggttggagcacagggtacttaatggatgggtacatgacaagggggggctccctaggcccctcccctcttcaaggggtctacnnnggcaactggtaaggagggnannatncagtggtggtggggganntgangtgtggcaggaactccccagcagtgagggtctctctcttcctctngtgctcttggctgggggctgtgggtggtccagggggttctatatacctccttggagaggccatgtggtgggccanngaggtnncaccaccctggntggctgntagccaaantncggtnggtcatnaccaggaaanngagcttngacaaangtgngtctgtggagggcaanngnccagcccacagctgtacaaatgtggtggaggacgttgggttgtccgcgtgttgagacagctcaagagggaagacccacctgtgggtgcttcagtgatacgcccatggattgcccttaggagggggcccttccagaggcctgtgctttcaccaccttctttgtgantgctcactcactattgtggcgcaggtttttcataaacgggcacaggtcaggttccaccattggacatctgtcggcgcatgtggggcgacacgggaaggcgccatggccagtggaggcttcccctgtcacagctcaggggattagactcttcgcccacacagccttgggacagcgccatgaaaaacggcaaggggatgatgtgcctggaaaaagccccggcggaccatccacggcaaaagttccccggaagg

SEQ ID NO: 497205 - DNA, 245 bp, Homo sapiens
cccctcacactttttgcagacagcaccatcacaggatccaggaacccagtgttctgatgaagcttacggactgagcgacctacgcgagcaagcagcagtttcgtggctgaatatcggagaagagtccaggacgccagctgcgatttggtgaaggacgctaggaagaacgaaggagcgctaactatttgcgtggtcaagctcggaatacacggattccaggatggagcgagtgcaacaagtgtgct

SEQ ID NO: 497206 - DNA, 1561 bp, Homo sapiens
  misc_feature (646)..(646): n is a, c, g, or t
atcatatctaattgctcgtgtcctcacagcccaataatctagtactagaactactcatgaagccaaactagattccaataatgatgtgatcattgactacggaatagtgcattgtaatcagtataacgtatggccgtcattgtgacggggaacatcctaccttgatagaacatcaccataataagcatcatgttctaaagccgcacacggtacggacgtggggtgcctagtaagtgcacttgtagctcgttatgtactactaactaagtgagccgcgggactagtggtgttgatgacaattaacgactcttgccatctaaccattccaatcttcttcgacaacacacactctgttgaagctataaaaagcaatcataacgtctctaatctccctcatattcgcatatgggtcaccttaatttcacccttattggagcgcaacttagatattattcaatcgagagactctccatactaagccatacacgagattccagatcagaaaacatttatacgatacagcaatccgtatcgccgtaaacgttctttcctatattcggggacactaaccatagttcctctttcgttagagctaacatctaagggccacagtaatttagcatatcccaaaccaactccctctggnaaaggtctactcaacacggtgccgtaccagttccggtctccttccaataaagttcgtcccctacctgggcgacttggagcgatttccgtacaagtataagcttaatatgcttgactcgttagatctaaaaatccttccatagatcatatggtaaagcgtacgtaataactgtttggtcaatctattacaatccctaactccgtcaagggaagtatacttggtacggctaactccccgggttggaatgagccaatcctagtaaggacccttcgtaaggggaaagctcgtgcgtattagacccctaccgccttttaatcccgcgcctattagtttaacaactcattaatttggttgacgacacctttctcctggtagactttggttaaaccaatggtcttcgccttgatcccatgggagacaccggtcttccaacttggaaggggagctccaaccaaactaaattcagcaggggctaaggaagccccgggggagaaactcttacccgcaaaaaactcaggggtgggtaaaataccccgcacggggtaaattcccataaaagcgccacacggaaggggggggagaaccctccgggcgtagaaaaggagtatccacaacataacaaagagacaacccccgcatagtaaaaagggggagggccctctgagagaagaacaaagcacaaacccaaacaacaaaaagagggggggcgacgtacacacgaacgacgacgaatcacaatcgctgtagagactacaacgagcagtaaaaactaagcgcgcctcagcccgaccgaccatgagagatgagtagcattaggcggcagcacaacataaaaatgagcggacgtatatactcaaacagacaatcacaaaagaaaacagaagaaaaagcgagaacctacagaagtgggggagt

SEQ ID NO: 497207 - DNA, 174 bp, Homo sapiens
aggatcccctgcctgtaaaggattttatttctccttcacttaagaagcttagtttggctggatatgagattctgggttgaaaattcttttctttaagaatgttgaatattggcccccattctcttctggcttgtagggaagctgctcataggcactttataccacgacacagtg

SEQ ID NO: 497208 - DNA, 124 bp, Homo sapiens
cttaaggatccgtgggagacgtcgggggctgggatagagttctgttggactggtggaggacccgcgaggtagaaggcaccgcgaggtagaaggagccgcgaggtagaaggacccgcgaggtaga

SEQ ID NO: 497209 - DNA, 1072 bp, Homo sapiens
ttgctggccgcggcggctcgtgtcgtcgtcgcgagtgtggagtcgggactggagctgcatggcgcggtcgacgccgagtgatcttatgtcgctagctcccggcccttctgccccgccggcttccctcagtcagcgttgcccactcctctccggccgggcgcccctggctccatatctcgctctctgtccaccacagacacggtccccgccgatcatggaaccgggcagtggcggcggcggcggcggcggcgggagcagcagcggcagcagcagcagcgactcggcgcctgactgctgggaccaggcggacatggaagcccccgggccgggcccaagcggcggcggcggcttccctggcggcggcggcgaggcccagcgggagaaactcagcgcggcctacagccggcaaactcaacgtcaacgccaagccctatacgtgcccaacggtcccacgccgccggagtacgtgcacgacacattcccagcaggtgcccggcaagcgccggcaccccccaggactagggggaggcgccaaataacccacgggaagccgagacagccggggcggggaggccgtgcggcaaacctgagagaactcctccacaaggagggaccagcaatgcggtgacggggacacaatacaggcagtagcgatggaaacttaggcagcaaccctatagacgactgggagagaccggaagtgtctcccgaagaagtcatgcgcgcccaagaagaactacagtggcggccgaaccaaggggggatgttacttgggcagaaggaagggcgccagagcacagtcccagtgacatgaggcgcgaagaagcacgccaacagtctacgctagtgaatgccagcaaggggcccaaagacaggacatggatgctgcatgccgggcgtaagtcgacgcacatgtgggccaagactaggccaacagcagccaacacatacgacgaaggcgaggtgcgcagcgggaaagcagccgacgagggaccacaaacaaggaagcaggagagcaagcacagccacacaacgtgcaccagagcaccgaagagacgcggataagagtcac

SEQ ID NO: 497210 - DNA, 458 bp, Homo sapiens
  misc_feature (108)..(110): n is a, c, g, or t
  misc_feature (142)..(142): n is a, c, g, or t
cttttcctctaccatgctgatggcaccatcttcctgtctttcagccttcagcatggtagaggaaaagagaaagatggtgccatcagcaaatattattcttaattgaannnttgaaatgtgtatgtttcttactaatttttanaaatgtattccttgccagggcaggcaaggtggctcacgctgtaatcccaagcacttcaggaggctgaggtgggcggatcacctgaggtcaggagtttgagaccagcctgatgaaaccctgtctctactaaaaatacaagaattagccgggcgtggtggcgcatgctggtaagtatcagctactcaagaggctgaggtgagattatcgcttgaacccaggaaacggaggttgtaagtgagcggagatcgcgccactggactccagcctgagtgacagagtgagaaatccatctcaaaaaaaggaccaaaaaaaaccc

SEQ ID NO: 497211 - DNA, 621 bp, Homo sapiens
gcctggctggtgatgccgttctgcgaggatctgtatctctggagcgagcgttcgttcgatctccgtccggcttctctcctatctaagctgactgtcggctgggcactcacgattgtgacacgcattcggagttggcacatggacatgagccccctgaggtcccagaattatcttttcgggtgtgaactaaaggtccgaccaaagtattatcacttgaaggtgtggactaatgacttgataggatagtgtatccacacaggttgaatctgtttaaagaatcaggttcaagcttgtagggggaggctgggtgcaaattatgcgaattgagattagtaacaatctggtgtagataacggcaatgcatggcctagaatagaaactctgacagagaaggagccaggaataccccacactctcacaaacgctcaaagcaaccttgggcaaaccttgttcttgcagatagattgtcctcgctaacgatgcccaacacagggctattcgccctctgtggtggctgttgatagatatacactcaccgagtggtctataagggttagaacgtcgtggttcacgggtccagtgcatattagtggacagcacttagtagctgtggcaggaaga

SEQ ID NO: 497212 - DNA, 128 bp, Homo sapiens
  misc_feature (10)..(10): n is a, c, g, or t
  misc_feature (54)..(54): n is a, c, g, or t
catcgataantgagctttctcatctgtccgatgctatggttttcgtgagatgtnacaattctagatctatccaccttgtttttttattgtccaccaaccattaaatgtaaatattgtttttagagtcc

SEQ ID NO: 497213 - DNA, 229 bp, Homo sapiens
gatcagccttggaaacatggcaaaaccttgtctctgccaaaaaaaaaaattagctagacacagtggcttgcacctgtagtcccagctacttcggaggctgagatgggaggattgcttgagcccaagagctggaggctgcagcgagccaatgatcacaccgcttgccctccagcctgggccacagagcgagaccctgtctcaaaaacaaaaaaattactttggacacaat

SEQ ID NO: 497214 - DNA, 1840 bp, Homo sapiens
  misc_feature (1840)..(1840): n is a, c, g, or t
ggctggtcagtgtgacgcgtgacgcgaggagcgaactggatcgtagtgcatgatgcgtgcaggagatgacacacagtggacataacatgggagcatgcgagaacgtcagatgctatcgcggaatgtcatgcgtcggctgcatccctacgcatgcgacgtgcacacagtcaaagaagcatgaactggggaaacggcttcagccaggcatgccacgtagtagccaggcctgcaatgccacatggttcagtctcctgcaattgtgatggcagataccagctggcgagaagatcagcaatccaccatgatctcaatcgttgaccaagtggggtacgagagacttaagatccccaaagcaagaagactgaagataaaatgggattgtggctcggagccttatgaagtccctaataaaccggctggatcgagtagaattctggcaacactcatacaaggccggaaagctaaagctctcaccgttcgtacctgggagtatgtcccctaagcgattttgcgctcctcccatatgaaaactctccaaggagatggccttccctttgaagaaggaaagtgctattcaaggttactagcttggaaagttgcatgggtagggagaaataatttcaccaatagggggcatatactgaactagagcaaaggccttcaatattgcatcaacctgacattaccaggatgcagcccgtagttaagtaagagactaaggacaagcagcgtcatatatttttagcccccacaacggaacgttagaagtctacttagggaactatgaaccccaaacaactgattggccggtgaagactacgaaaggaaggcggaactattagagttatctaccattaataccaagcgcatttgcatgggagagaatacctgaacgctattgccacgtgaacacggcaccgaggaaacacccacaacatatcccctcatttgggattgaccccaacattgcaagtaggttcaccattcaaaggaacagccccaccgtacgtggagaagacacaagggacagcataatactccttggataaaccctaagacaaaaaataaagcctaaaggcaaggtgctaaaaagaaggattaacgcgaaacacggtgaagagccgaagacacaaaaacaaaacgccgccacagaaacggggcaccaccagataatatacactggaaaagcgcgcccacaacacattaaagcaaaaaaccaggccacatacataggcaaacacagcgagagtcacacgaaaaagagtagacaggacagaaaacaaacaacacaacgccaaaaacacccggagtaacaacacagcgtaagagtgagggactcaacaagtggaccagaaacggcaccacaatgttggcaggaaaccacatttcgagacaccgccgctcccaccacagcgaccgagccaccatgggaaacgaaaaacggcacacgggcaaacaagcgatgacgcacgcggactaccgatgtcgacgcacaagcataagacgtatcgagcgagcaacgtggacaatatctgcgcgacgcaacagaaataagagcctgcacagatacacatgacagcgacactacgcgatccgaccgagcacgcaggacgtccagcaaccagacaggcacggcagcacagtgagagacgggagaacgcaaagcccagacgagcaagcagccacgagcacagaaagccgcagcaacgaaacagtactcgacacggcggaactaccaacagacagaagacgcggaccgccgccagaccacaaccagcacacaccacggagccaagagacgcaagtccgacaccaccggcatgacgcggtgcaggagggn

SEQ ID NO: 497215 - DNA, 239 bp, Homo sapiens
cgtggccagcacggatgtgacgatctggccccggtaccggaatcccttctggagtcaccgtctacatattctatcctgggtttaccccgtgtggctggtatcccagtcaggaacttgccgggcagtgccttgcaggcacagattaaataagggatgacggtgggcttctccttcttagttttgatgagcagctcctctgatttctcgcggtccccaccgctgcagtccttactaggggt

SEQ ID NO: 497216 - DNA, 924 bp, Homo sapiens
ggctggaatgcagagttgcaagtcatggctcgctgcatcctcggcctccctgggttcgggtgatccatcccgcctcagcctcgatgaggtagctgtggggagctacgggacactgtcatgcaaccaccagcagttctggcgtagacttgttatctgtactgtcctggtctgtatgactggggtgtgtttgcccactggtggcccaggtcatggatcttggatctcctggatatcaaggcaatgcggagctcatcgttcagccatccctagggtacttgcggattgtacacgggtgactaggccagctgcatccatggtcgcacgtagctttagttttcgatacctaggagactggaagagtaggtgacatacagtgttgccatacacttaggacagtaaggttaatctaaatatttgctgtatattatccttgtattagaacgttcattggcatggaatagaagagctttcgcaatagttgcttctaggactcatgttatgaggaattcgttttctaagtgctggttgacttcttgtataggtcaaggctcaccatttttttaattgtgacaggggaatgcctgggaaagagagcacgtgcaagagaaggtgagaagtataatttgttggtgacttcttgttgaacagtcactttcgtggagtggctttgaatactcgagttactaccgtgtagtgggcaagtgatttctattcgtagaaatcggatgttgataagtactgggggctgtcattggatggaatcagtgagtctagtgagcatgtttggtaactttagggtcaggtggtgttgcatgttggagggaaggttttggaagttcaggagaagggtggcccatgtttggaaaggaccgatgatctgtggatctggaaagaagttaggcgtgaaatggtttaaaggtctta

SEQ ID NO: 497217 - DNA, 231 bp, Homo sapiens
  misc_feature (26)..(26): n is a, c, g, or t
cttaaaaaaaaaaaccccgggggggncccctcaggtttgttttttaaattaaccccaagggccctttttttttagaaaatttcccccccccccgcaaaaaaaaaaaccctttgggttaaagggggggaaaggttttttttttgttttttttttaaaaaaaaatgtttccagggccccaaattttttccccaaatttgggtttttttttaaaaaaaaaaaagggccccttta

SEQ ID NO: 497218 - DNA, 100 bp, Homo sapiens
tccggtggcgtgggggataggtgtatgaacatgaaggtgttttctcgtgtgaatgaaggttttatgatagtaatgtggtgggtgagatagcctcattggg

SEQ ID NO: 497219 - DNA, 448 bp, Homo sapiens
gcggccccttttttttcccaaggttggggaccctttccggtccctttgcctcccggggaattaaaaggtttttttccccttccccctttgggggggccaggccggaggaatttttggggaggggtttaaagttcgggggttttggtttaggaaaaaccaattttccggtttttggaaactttggttttgggacccgggaccccttgaatttggggtccaatttggcccccgcctttggttttacgggcttgggtttttttttgtggtggggtggcccgggttttgcctttccggccaggagggccgggccgggttcctttgggccccaccccgggttcgccaagggggggccctttccttttttcccccggaggtttgtggggacctcccttcttgcaaataaatttcccgttttttcccaaagggcccttaaaaagttttcgtggga

SEQ ID NO: 497220 - DNA, 1062 bp, Homo sapiens
ggctttaggctggccggctggcgctgggagtgtggagtcgtctgctgttgctgtttgtgagcctgtgtgcgcggctatctgtgggccggaatccttaaagatagccggcaatggttgaaaactggtgataatgaaaacgatggtctgccctggagggcaaaatctgtcatcaaattgagtatatttgggcgacttcaatttgccgaggggcacaatgtttctacaaggaacgagataaaacagtggattgaaggcttgggtaacctttttgcgcagcataatgcataaaaattcaaacagggtatgaacctgtctaaacagacagactttacgtgtaattgtggaagcatttgagcaaaatccaaggcagaactcatggaactcagttgaagataaaagtaaaatcagaaggtctccaaggcaaaccctatacctgaagtgactgatgagtatagaagaatgatgtaagaaaaacagatcgtgttgatattacaaaggatatccccaattgattgcaagttctttgaatgaccagtaaaagagaactgggttatgaaggattagaagtgtacaatggtaggtacgaatattacaggatagaggacaggaaccaattgggccatagcggcagtttacgcggatcaagtttgggagagggtagggagaaggcatttggacttcgctggctacagcaaaatttgtaagaggagcgccttggcccaaaagttacgaaaggaaaaggaagaccgtgggtagatactgtatgcatgtgcacgaagtatatttttgaccaaagagaagaagtgggcaggagacggggagcgccgacacagattaaagaggttggggaatgcactatacgcatatacagggaaggcgtaaggcgagggggaggcaaggaaaggggagggagacacaggagagtagttgcgggagcaagtgacttggcgtcggcaaatggacagtcggcgcaagaggacagggggaattgtggagtggctagtggtgaggaagtttcggcgggtgtggttaaggtattcggcggcgtgagcggggtggatg

SEQ ID NO: 497221 - DNA, 3055 bp, Homo sapiens
tttttactataaaaggaaccatgtataacattgatttttaccttcagttttgataataggctgaagactgccttcaatcactttaatttttggttccacaactttggttataattttagttgctgaaagtatagaaagtggaacatgaaaaatatttacataaaaacctgaacaaaggttttttttttttttccttttcttttttgtctctgtaggatactaaggtacaggatgtggtaatatgttcaggcagtcagatacaggaaatatttatggtacataatataatatcttctcatgtccaggtgttgaactctgaagtctagtgacttgaatttgatctagtgaaatatatactcacaaagtgaggaattatatctagaaatctgtaatttttaattgtaccgctaaagcgctttaccttcttttgtacttcttgaaaatactggctgcattgcaacagaagacaaatatgattaatgtcatgcaattcataatatcttaaattgcattgctggattctttctcaattaaaagaaaaaatgaaagaaaaaggcttttaaaatgtttttcatgcatctgataacagtgacatagaaaggaaaaaatgaaacatagttcagaatacttaaaagtaagaataaatttcagccagccagacatgagctctattcaacaaacatgatatgatcagtatttaagttataggctaaaaggtctttaattttcagctttgttatcactatccttttttttttttaatttaaaggtatatattttaaacgtgtgtcgtctacctaagtaagataatagtctttgaactaggtactatgtttgctgtttgggtgatgggttcactagaagcctaaaccccagcattactcaatatatccatctatcaaacctacgtgtgtacccccctagatctataataaaagtaaattaaaataaattaaataccagtcaactatttggttgactttggttgtactgattaactggaaatgtgcctctgaagccacacagccagagcaactggctttttgtcatttctaatgaaaagccttgaaagatggttctattagataacgggccacactgaagctaactgtgcatctagatcacatcaaagcagtagaggtgagatgttagcacagctttggtttctgcagttctcacctcatgcttgtaagatgtttagctgtgtcaactttttgaattaatgtgggttcttagccttcatagaccctgtgtttcagccttattaggttttgtattttgagatctcaaattgtgaagctctaaaataaaacaaatctgtgtgtttaggtactagttccacaggtggtcttgccacagaagaacctttccatgaaagtcgaatacgaatacacagggctctctattgctgctatcaaaatggactaattccttttagcttacattttttacatcatgttaaggaatttgacgttttggatgttcagctggttggtagttttcatttcaatcttgattttctgcagacttaaatagttttgacaggtgaagctctgaggattaaatattgattttagccctctccaggtcaaatgttccatatttgacaacttataccaaaaacagcatccttcccctcaactatacactttaaaatggatgttattttggggatgaggataatatgcagcaaaaaattataggaattttagaaacaagtcaacaacgaaatataaaaatagaaaatttggtttaatttacctttacttctactttaaaatacttcttaataacagcataccgtctaaggaggagtaaaagaaacatcttacattggaatgtaaatgttagagctgtttcaaggcctctgggtaggtagggaaggaccattgaacatgtgtgtcttaataaaatgtagcttatgctctgtgagtgaggatgtaatttagtaggagaaaataattatatttttgctcattgtaatcaagatattgcattcacatatatagaaagtagtgaaactaagatggataaagaagggaagctaaagaaatgtagtgggaatgtgtatatatatatgcatatgtatatatttatacctttgatgaagaaagatggcataacatgtctgatgaatagagcccataaggattgcttaattttcagaaaacatattttttacaagattgtattcccatggtgaatcataactattccaattaaatctttaatacagtgctgagctggcctgatcctggaattgcatgttattattgcataattgaaatcaacaacagcagcagacattttgttttgctccttacattggctttactccttttccatatctagtataaatcttaagggaaattttcttaattaaataactggatgctcatggtataaaatggaatgattttctagccagaataaatgtgggtattgaagtaatgttttagctactgatacactttgagtgtttaattacagagccaaaacaaaatgaaaagaatttctgcttgaaagctacagggaaataaagaaagagagaaaagataaacagagaaaaagccatgatggaaaagatatactactagctacacttatgagaatgaaataccctttatcattgttaagtagtagaggtttaattttgataatctggttgtgtcagagatcaaagaaccctggaatttggaaactttaaatttgtcacatggcagatttttttgttcctttgtccaattttggatgggagagtttttgaactgccaccttataaacattggtattcttcaacacgtgcttctcagcctgcccttagatagctcagggcttgagggtggcgtgaacaacaagtcttggctaaggtcatttctgtgtccacacatctgaatttttagatatttctagagggtcttttcgccatctcttccctttatatgtcttttaattttcctggctctttgccacgctaatattatattttgctgtctttctcatgtcatatcatttctgtttttccaatgagtggggaagaagttcattggagtaa

SEQ ID NO: 497222 - DNA, 1152 bp, Homo sapiens
  misc_feature (401)..(401): n is a, c, g, or t
  misc_feature (517)..(517): n is a, c, g, or t
  misc_feature (545)..(545): n is a, c, g, or t
  misc_feature (559)..(559): n is a, c, g, or t
  misc_feature (602)..(603): n is a, c, g, or t
  misc_feature (609)..(609): n is a, c, g, or t
  misc_feature (624)..(624): n is a, c, g, or t
tgggacaggcagacctagataagggagcggggaactacttggagaaccgtttatgtgctgtaattggacattcagcgtaccctatggaccccggttatcccatactggggataaatcctagaggaacgtcatacatgtacacccggagatggtgtaccagaatattcatagccaccctattcaccaaagccaaagcctagaaataaccccgatgcccatggagccagagagtggaccagtataactgggatattcacataatagaaccttataccattgtccaatgagactataatgatacctaccatatggatgaatctgagccattaaataattaatagtgaaaaaagttttatccccgaagagtaaatgtagcatgatgccctttctaaatgaaaggntttttcttttctatggagttattctttacatacaatatagttcataaattttaaatatattgtttaataaattttgataattgtatataatagtatagtcaccatcaagatgtagnaaatagaaaataggctaggcacagtggntcacgcctgtaatntcaacactttgggaggccaaggtgggaagatcacttgatcccnngaattntagatcagctggacnatgtagtgagacctggtctttaccaaaaaaaaaaaaaaaaaaaattagctgggtgcgcgtggcttgtgcctggtggctcccagtttactcaggaggctgaggcaggaggatcactttgagcacaggagttgtttggagggctggcatgtggacgcagcctggggcaagaaggacgtggaagactcccggtttggttggccactggcactcccagccaggggtggacacgagtggacgactctggtctcaaaaacaaaatcaaccaaaaacaagacagagggctgtgtgggggaatctttaacccagggcggggcgctgatacaaacaggtctcgctgaaagcctcgcgcgcccagtggggccggggggtccgacagccctgtcttaattccccaaaaacttgtggcgaagaggctggaacgagcagggggtggtaaacaacctcggaagggtcgcgaggaaggaggttcgccagcaacccccgtgcggggccaacacggggctgggaaaacccgcctttctcttgtaa

SEQ ID NO: 497223 - DNA, 719 bp, Homo sapiens
  misc_feature (303)..(303): n is a, c, g, or t
  misc_feature (340)..(340): n is a, c, g, or t
gatgcctgacgtttttacgactcctctttcatgtttgtgtcccatctcttctcagaagaattagccatgttttgtgaattccaggtgccatcttcaaaaacacccttggattctagccaatcaccaaaatggcagagacggccacctgagaccaattagaatatccacaccagtggaagagagctccagtggtaaatttcctagatgtacaactattgatttcatgatgtattgttccataaggtgactttaaaacaggacaaaagtcatgattcgtatctttgtttcatcttgtcgttaatnttatatctggtaattttcttgaaaacataaggacttnttttacaaatttgtatgctttcataagtacttcattgtaactttaatagtaaataaactttggctttattaaggtgtaggagagaaaaccctacgaacagaaataaaacaattgtgatgaatcattcattaatccctgggagaagcagagtgggcgtactgtgggcttaggctcactaagaaggacctggattcacatcctagctttgtccattgtatgtggccttgggcaggtctcataagccacactcctttgcaaaatgaagataacaatatctacttctgagagctgttttcagaggatgaaagtgcataataagtgccttatcttacacatggcccagtcttggctcaaaaatgttacttttgtttcttgaata

SEQ ID NO: 497224 - DNA, 511 bp, Homo sapiens
aaagcaataaaccgggcagcaaaagttgggatctttggaaaaacggtaaagtaagcccagtaacaaaatgaatccaaaatggccaagacaaagaaaactaaagaaaaatttgccttccctctccaaccagctatggagcacagcatgttgggagatgaacagggaaaaggccaaggtaaggagcctgggaaggaaggtatcaacaatttaaactgaactcgtgccgaattcggcacgaggcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 497225 - DNA, 545 bp, Homo sapiens
tgcgcgacgcttccatccactactgtgattctgcagactggaaaaaactcctgcacagcctgcagactgcacattattagcgcgaaccaggatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctataagccatttattatatatacaccttcatcatgatgaagctcgcgctgggtcctgctggtcag

SEQ ID NO: 497226 - DNA, 3314 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggaggtgcgttccttatgttacctggggccgactaccttcgctgtgattattttgaaatagtgttggtttagaaatattgaacatctgatattttctcttagttcttattttataaaaattgtgggaattatttcctcagctatgagttcttattagctggtcagaaataaaacatagttagcttttaatggatctagttggaattaatttatctattaagtcactgggcccaacaaaatgtcatgatttttgcatatacaagtgaggattgtggaataaaattgtaacattaatgtcagtataaaaggaaatattagaaacagtaggaaaaaatgaccattgtataagtctctgtctaataagccactccactactaggatttatgatagggctcccattccaatgatatagaactccctggattctcactaagtatttattccacatccagaaaacaagtatggcatggagagttaggatgtcaaatggccctctctctcaaccaagattcaggacatagctattaccttttagatccctattgatatgatttttgggggatatgttctaaaaatgtttatgattgaatcttaaatggtaatatttgtagaaatatagttaatcattacaatgtctagcttatggatgtatagtcacaatatgagggtaaatcaaatgcatttgtattcccctgcttttagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 497227 - DNA, 247 bp, Homo sapiens
agcggccgcctttttttaagcaaaaagggtatttatgggttcacataactgaaaagtccaggggatattctagcttcaggcacggtgggatccagggcacaaacgctgtcatcaggattcaagtctctccatatttgggctctgctttccccggcacgggcttcattctctacatggtaggcccggttagttggaggttttcatcctacaaagctaaagcaccctcagtaaagaaagggcggccgct

SEQ ID NO: 497228 - DNA, 3230 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggaggtgcgttccttatgttacctggggccgactaccttcgctgtgattattttgaaatagtgttggtttagaaatattgaacatctgatattttctcttagttcttattttataaaaattgtgggaattatttcctcagctatgagttcttattagctggtcagaaataaaacatagttagcttttaatggatctagttggaattaatttatctattaagtcactgggcccaacaaaatgtcatgatttttgcatatacaagtgaggattgtggaataaaattgtaacattaatgtcagtataaaaggaaatattagaaacagtaggaaaaaatgaccattgtataagtctctgtctaataagccactccactactaggatttatgatagggctcccattccaatgatatagaactccctggattctcactaagtatttattccacatccagaaaacaagtatggcatggagagttaggatgtcaaatggccctctctctcaaccaagattcaggacatagctattaccttttagatccctattgatatgatttttgggggatatgttctaaaaatgtttatgattgaatcttaaatggtaatatttgtagaaatatagttaatcattacaatgtctagcttatggatgtatagtcacaatatgagggtaaatcaaatgcatttgtattcccctgcttttagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 497229 - DNA, 2531 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 497230 - DNA, 630 bp, Homo sapiens
agcctgaaaaagtcaccctgccgaggatcaacttcttcaccccagaacaaggcagagcagaaggatggatctgagtgcaaacaggtccaggaccacgccacaccatatgccgaggcttgagaaggaaattcactgagccattccttacgagtgttcccaggagaaacaggaaagtgagaacgtcaagtcagtccaagaagaatacagaggccaagtcccagttgctatatcagcaatctcacagagagagcggcctcagtcccttgaggcgtctcgtttctgcaggccagtgctggagtgcactgggccatctgtggtcactgcagccttgactctggagctcaagtgatccgttctcatttcggcctccaagtagctgggatcacagcacgaagtgacccatgatattcagggtggtggctccttggtcagagtgaagttcctgagtgaccataaggcaggagatctcctaacagaccatgatgggtcagtgtgagccagtatgaaaaccatctagtggagcaagaaaatagtgcctattttagcatggagacttggggatgttggttcccgaaaattggctaacttatccggggggtaaccggtgtaaaaattacctctgggggggtg

SEQ ID NO: 497231 - DNA, 3230 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggaggtgcgttccttatgttacctggggccgactaccttcgctgtgattattttgaaatagtgttggtttagaaatattgaacatctgatattttctcttagttcttattttataaaaattgtgggaattatttcctcagctatgagttcttattagctggtcagaaataaaacatagttagcttttaatggatctagttggaattaatttatctattaagtcactgggcccaacaaaatgtcatgatttttgcatatacaagtgaggattgtggaataaaattgtaacattaatgtcagtataaaaggaaatattagaaacagtaggaaaaaatgaccattgtataagtctctgtctaataagccactccactactaggatttatgatagggctcccattccaatgatatagaactccctggattctcactaagtatttattccacatccagaaaacaagtatggcatggagagttaggatgtcaaatggccctctctctcaaccaagattcaggacatagctattaccttttagatccctattgatatgatttttgggggatatgttctaaaaatgtttatgattgaatcttaaatggtaatatttgtagaaatatagttaatcattacaatgtctagcttatggatgtatagtcacaatatgagggtaaatcaaatgcatttgtattcccctgcttttagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 497232 - DNA, 1818 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattcacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 497233 - DNA, 772 bp, Homo sapiens
ggtgcatctgaccccgaaaggttaaagcttccatcagagtgggaagggccaggagtggggaggtcccagacagggacagcacagaagggagaatgagttgggagatggctgccgggagcagaaccgggttggaggagactaaggaggccagaggcgcccgacggcacgtgcatctcgctctatggggcttctgagtggcctctccctttctagacaatctgacagatacagtagtggggtctgcgcggaacgaggctgagagggacgaagtgcatgagtgagtgggacgcgtgacgggtgcctggtgggcaaggagggccactacctggcgcctgatagacatgttgctatgtggagcgtggtagataagacgggtgtggaaggtcatgccgaattgaggcgccagcatgacatgagtagcttccgtcatgccacatactatgacatcaaggcatagtagacccataggtacaccatcagcacacacgacgacaagggtaccaactgcccacaagagccccgaagacgaggcgaagaggtaacaagccacaacagatacgcacgcgtgcgcccccaaccacgtggagtgcgccttggacagatgtggcgcgacgaaacaaagggacgagacgacgcgcggaaggacatacaaaaggcagaccaggagcagccgagcaaatccaccaaggagagggaggagagacggaacaaacaaaccaacagaaaacatacaagaggacaatcatcaacaaaaacaaacgcgtgaccgaac

SEQ ID NO: 497234 - DNA, 1568 bp, Homo sapiens
tgcgcgacgcttccatccactactgtgattctgcagactggaaaaaactcctgcacagcctgcagactgcacattattagcgcgaaccaggatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 497235 - DNA, 3343 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggaggtgcgttccttatgttacctggggccgactaccttcgctgtgattattttgaaatagtgttggtttagaaatattgaacatctgatattttctcttagttcttattttataaaaattgtgggaattatttcctcagctatgagttcttattagctggtcagaaataaaacatagttagcttttaatggatctagttggaattaatttatctattaagtcactgggcccaacaaaatgtcatgatttttgcatatacaagtgaggattgtggaataaaattgtaacattaatgtcagtataaaaggaaatattagaaacagtaggaaaaaatgaccattgtataagtctctgtctaataagccactccactactaggatttatgatagggctcccattccaatgatatagaactccctggattctcactaagtatttattccacatccagaaaacaagtatggcatggagagttaggatgtcaaatggccctctctctcaaccaagattcaggacatagctattaccttttagatccctattgatatgatttttgggggatatgttctaaaaatgtttatgattgaatcttaaatggtaatatttgtagaaatatagttaatcattacaatgtctagcttatggatgtatagtcacaatatgagggtaaatcaaatgcatttgtattcccctgcttttagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaaaaaaaaaacccccaaagggcggccgct

SEQ ID NO: 497236 - DNA, 850 bp, Homo sapiens
agcggagggttcaccctccgctccacagggtcggcagcagggcggggcctccggaagctccgccccacgctttcccggggcgcatgcgacgtgggccggagcgtctggaagctccgcccgtcgcactgtagagtcggccgaggcgcacgaggtatttttcacgctccgcccctctgcaggctaaagtgcgtgggcgggaagcggtgggcagggtgccatctggctccgcccttctcctgtggtgtgggccaggcggcggcttcctcctcctgcagcagccacaggctccactctgatccttctcccgcggcatggatccttctcccgcggcgtggatccttctcccgcaaatctccgtgcgcgtccccagtcagtacccgcagcctcccgacgcacccgcttggctccaagcctcccttaccccaggtttcctggctaagagagagacagagggagagaggggggaagacgagagaacaggcaatgggaggtgatggtgagagcttattggaacagacaagagggaggaaacccacattccttcattccccatccattcatttatggccttatgtattccattgaatcttcacagctctagaaaaaagtgtgctacaattattccctttattacatgaggtcactgaggcacagtttaagaaaatttgccagcaggcacagtgggtcactccggtaattcgcagaactttgagaagggggaggaaggtggatccattgaagcccaggaagttggagaccaggtctgggcaacaatgggggagaccccgtttctacaaaaacttaggcaaaattagcaaactggttcacacttgtagtcccagggtattca

SEQ ID NO: 497237 - DNA, 240 bp, Homo sapiens
agaagaaagagcgcaatgacataagacgatcactgcctggctccacagtgctgggattacaggcgtgagccactgacccaggctattttacctttttcaatgactctgtctcctcagacctgaaagtgattcacagaccatggggcccagaaacccgatcaaagtaacgtgtgcattgagtagacatgaggacatgaggatctccactttcttcctcttgctaaaaagtgccctacaacg

SEQ ID NO: 497238 - DNA, 1628 bp, Homo sapiens
gtgggtaccactcgtgtccatgtggtaccacgggaagaccacgctgactgcagaacagtcacgaagattctagctgagcggaggtgggtgctaatgttcaagaagtacgaggagattgacaatgccccggaggagcgagctcggggtatcaccagtcaatgcgtgttcattgtggatgtataacactgtcctgacctgtccatgtacagcccacgacgatgacttgcccggtgtcaagtgctaagcattatgttaatgaatatggatcacaggcattgaatgcgctcgacggtctgcaatcctggtggtagcagtcaactgacgagccctatggcgcctcagaagccccgtagaaagccacgtaatttactagggaccagaaagcagcattttgctgcgctggcactgcgattgctgtggcgggctgatattgattgaaccgaagggtgctgtaacgagctggttccccagcgtaacttcttgcgaagcaatgggcttgggagaactgtggtgggcacaaggttggggaacgagatccgggtggcaaggaccttgcttcctagcaccggaacggcttttggggctttagttagcggatgcgggcggacggtggacgtaacccccccgaagcttcaactaccggtgagatggggctttcgtcggcggtccgtcttgggtgggcgcgccgtattgagacgtgtggattccgcgaggaagcccacgttggcaagggttaagggggcacttgaacacgattgtcctaggtggcaagggaaaagggcctaagcgtggtggattagcgattgttagtcgaaccaacggtataatccactttctcgccaatgggtatggccacgcaggaggccctggtcagcgaacctcgtttggggccctgacaaaatgccctattatccgcatttggccatatgcacccttggtttagaaaaagcgtcgaggcagtcgtttacctccccttggatctcaggcgttggtagtccgcgagaatagggattcaacgccgtagagtggtacttggacactaccgtgcattaacaagcataaaagaaagggctggggttgcggttacttttcctggacgaccacagaacaactgggggaatgcgaacctgcataggtatgttggaaagagcctttccacattaaaggggcgacatacttcaccgcacacacaaggaaggaacgagttacatgctgagcacagacgtttggctctgtgcgttcgagagccaggcgcggcgacagtttctggacatgaagttatggtgtaaccgccatcgcagccgggaagtcgacacgatgagaggaatcagaatgtggggacacggcgcaagaggacccccgtgcgaagcgaagtataaagccccactccggcaggggacccacagttggcctacctggcccggggccgttgagagacaggaccaggcggacaggagagaccattgtcgccggcgccagagtgagggccactagtgtgtgacagatttggggagacagcagcgcacccaagcgtggaagcgcacaacacggagaggtagcaccacagatcgccaaaaacgaggtgatagcgaagagggcgcccagagagcggtagagaaaacggttcc

SEQ ID NO: 497239 - DNA, 346 bp, Homo sapiens
gagatcccctcccacgccgcgtctccatacagccaatttcagaacattttcatctcttcaaaagaaaccctgtacccttcagctgtcaccctcctggtccccgtccggtcctcgtcccgccctcagcagccacgcactgcctgtaaagtcccctgtcctgccctgtaggtggaatctataccttggggtctgttctgacgttcacctaacagcctttccaggctcagctgtgctattgtatggaccagggggttgttttgtttttgttgtttgttgattgtgtgtgtgtgtgtgtgtgtgtgtgtgtgtgtgtgagagcctggtatggggcttcggcgtgtgcagg

SEQ ID NO: 497240 - DNA, 411 bp, Homo sapiens
aacgtgacggtgagcttgtcacttgtgccacggacactccagccagggcgacagatcacgactccgtctcaaaaaaaaaatgccgagatgttataacgtcgcggggaaaaaaatagagcccagagtgaaaatatcctacggaatccgcagggaaggcttttctgataggtaggcactgaagcaaagctgaaagacgaacgggaccaagtgaatcagtcatctcagagaggagtgcttcaggctgagggaacacagatgcaaagaccctgaggtgggaaaaagctcagcatgttgaaggaaaagaccagtgtggctgaaatgacgtgagcaaaaggaagtactatcagggtcttccaggcaggatgaccaggtactttatcattcaaactgaaaggctctgactcggatctt

SEQ ID NO: 497241 - DNA, 735 bp, Homo sapiens
gtacctcagcaaggtgccactagaagcgccaggctgggtgcctgcctctgagcgccccgcggggtgccatggatgtgtgaaacagcatgaggagcaggtggggccctgtgcccccgccagttgcaccctgtgcggaccctggcttgtggctggtgctccggggtgggctggctgggatgcccaagaagtacgcagtgacctgacgactaccatgttgtccaagcaggtgctggtgcctgggtgtgaactggcaaagtgctggagtgcttccatctggcgcactggacagaagtgtgccctgaagctcctgtatgacatgccccaatggccctggcaggatggtagaccatcactggcaggcttctggctggcccccatattgtcttgcatcctggatgtgtatgagaacatgcaccatggcaagctgctgtctcctcatcatcatggaatgcatggaaggtggtgagttgttcagcagtgattcaggagctgtggctgaccaggctttcactgagagagaagctgcagagataatgcgtggatattggcactgccatccagtttcttgcacagccataacattgcccaccgagatgtcaaggcctgaaaacctactctacacatctaatggacgaaagacgcagtgcttaagctcaccgatattggctttgctaaaggagaacacccaaattgcctgaagaacctggtatattccctaatattgggccttagtcc

SEQ ID NO: 497242 - DNA, 381 bp, Homo sapiens
gatctcccgtcatgcgcggcaaggcgtcgatggtctcagcgacccgctcatggaaccactccgcggagatggaaccatcgatggtccccaggtgggtggcgaacagcggcaggacccagtcgcgactgtatgcgccgagaagacgaagaggcgggttggtgtcgacggcttcagccaactgctgtggtgttgctgtcaacgggtcccccctgccggcctcaggtgtcgccagtatctcctataccgacgacacggtgccgctttggcgggcggacgggggctcgaggagggcgaggatgcgtgcgcctgggcaccctcatccgccagatgccctcggcggtatgtggtcggggtcggcagcccggggtacgtagcgttctt

SEQ ID NO: 497243 - DNA, 832 bp, Homo sapiens
agcggaagggaataaatgctggccccgcggagcatctgtggcaatgtgcttgggtctgtggaatgtttgttatttggctatttacagtagatcttgctgctgctcactttttgggacggctctctatttatgagctgtgatactcgctgcagaggtctgtgggtttacttctgaagtcggctagagtaaccagcccacgaacccaccgggaggaacgaaaaactcgggatacgctacctttaagagctgtaacgctcgctgcaaaggtctgcagcttcacatagataatgaactcagagtaccaacccaccagaagaaaaaaaaaaaaactctggacccgtcttaacagttggaggaaggaactccaggtactgcattccttaagagctgtaacactccctgcgagaattggcggcttcgttttggaagttcgtgagaccaataacctgctgctcagtggtgaacgatcccgggaacatgtccttggtgaaggagacggtggacaagctgttgaaaggctacgacattcgcctaagacccgacttcgggggtcccccggtctgcgtggggatgaacttcgacatcgccagcatcgacatggtttccgaagtcaacatgccttcttactgtgggaggtgcttagcaagcggaatacaatcaaaaggcgtgaagacacaggcggaagaagaaatcgaggagcagactggaacccgttaaacactttttctaaacagatttccaatccgtggccaacatggcaatagtgcaattcctccaaggtccttcctcctggaaccaaactctgggcattagcacgaattaccccggagaa

SEQ ID NO: 497244 - DNA, 174 bp, Homo sapiens
agagcagaggcccaggctggagtgcagtgccactataacgtcttacagaaggcttgaactcttgtgctcaagggatgtcccacctcagactaccaggtagccaggacttcaggtacacgccaccatgcctagctaagcttatgacttttgtagacacaaggtctccgctgatgc

SEQ ID NO: 497245 - DNA, 907 bp, Homo sapiens
gatctctgctatggctggtgagcgctgaagggagggactcggcagcaatcttgtcatgcatgacctgctcaccgctctctctcacgtcgacgccttctcgatacgacatcgcactatgggtccgtggagccacagtctagtgattgaggcgagacagtcctcgagtgttgcatgcgaggcccgaggactggaataggtctagccatcttcctgcgtactggagtcaggcttccaaccattgggaagaataacatgtatgttagtcctagggtagctctagctaggcttcgctcgagtgcaacatgtctctcctaaactaccttctatttcatgaccatacaattacacgagatccctgagggtatgccattgacacgggttctctggatggcacattgtcttggacgaactgtcaaggcacaacctctggagtcaatctacctggactctcgaggttatgagtagcactgagggcctgatgtatgacttagcagtgatacaatcgggatatgcgtagcctgagattgtatactgtcttcaggagctggaggaccaagggtcacccggcctcaggtcacgcccaaggccaaacccagtgttcagtctgttcccggcctcctactgaggaggctccaagcccaatcaaggccagcactagtgttgtctgatcaggtgacttctacccgggagctgtgacagtggccgtggaagggcagattggaatgcccgtcaaggccggagtggaagaccaccaaatccatccaaagtagagcaacaacaaagtacgcgggcagccagatacctgagccttgaaggccgagcagtggaagtcccatgggaaggctacagctgcagggtcacgcatgaaggggagcaccgtggagaagacagtgggccctacggacat

SEQ ID NO: 497246 - DNA, 159 bp, Homo sapiens
gtatataagcttatggactcacagtaaacattgacattactcactgcacatcatttgttagtcgctaggcagatagcgatcaaacatttgatttttgacattatgatacccgtcaagtcaaagcccagacactatttgttgtcaaaggggcttttcggg

SEQ ID NO: 497247 - DNA, 332 bp, Homo sapiens
attcttgttattctaagaagttgtgctacataaagttactgcaaacactgaattagagaacagccaactatcgttcctaggaggaatacagggttgggttcctgcagacctctggtcacaacattgtcatcatccagtcaacacataaccttgttttatgtgtgtttctgtttaaagaactcactgtaactcaggcctgaatggcgcttatctagcacacctgttttctccagaaggcacatcaccgcctcttgcacttaggaacactagagagcactgcagcaccatgcctgggagccagtttaagcagcaaaatcaccaacaggaaaagc

SEQ ID NO: 497248 - DNA, 322 bp, Homo sapiens
tgggacaaaagagtctgaacaacagtcttcagccctagacctttcctctgacagagtctaccaaaatgagaaggaaccagaaaaccagccctggtaatctgacaaaacaagacttttcaacaccccccccaaaaatcacaccagttcatcaccaatggatccaaacaaagaagaaatcactgatttatctgaaaaagaattcaggttagttattaagctaatcagggaggggccagagaaaggtgaagtccaatgcaagaaaatccaaaaaatgatacagccactgaagggagaaccattcaaggaaatagcttaaattaaa

SEQ ID NO: 497249 - DNA, 421 bp, Homo sapiens
ggcggacagatcaagaggtcaggagatcgagaccatcctggctaacacggtgaaaccccgtctctactaaaaatacaaaaaaagaaaaaagaaattagctgggcatggtggtgggtgcctgtagtcccagttacttggggggctgaggcaggagaacggcgtgaacctgggaggcggagcttgcagtgagccgagatcgcaccactgcactctagcctggacgacagtgacagactacgtcaaaaaaagtcagtggaaaggtaaccaaaaatgacacagattatagaattagtagacaatgaaattcagttaaacaactgtatcccacatgttcttaagctagagaaaagactgaacatgatataagtagagacacagaaaataggctgggcacggtggctcatgcctgtaatccccggca

SEQ ID NO: 497250 - DNA, 159 bp, Homo sapiens
gtggtgtggcgttctagaggatcccatgggagatgtcacattcttccaatggggcaatcatgccgtggctcgtagaaggcggtgtgccatctctttggtccattggtatctgtattcttagcacttagtatcaggattcgcccggaggtgttgaagctg

SEQ ID NO: 497251 - DNA, 1271 bp, Homo sapiens
gttctagatcgcgagcggccccctttatttttttttattttattctgtagaaaaacattataataatagggaggtgacacggaaaaacaaagcaagggcaggaggtgtggggcattcaaaccagggccagggctgtggacactatagggaaaagcaaaccagattaagaaggcgaggctatacttacaggttagcaaagtggagaagcccttcttcacctcgagccaacttccaagaagataccctcatgtgagtcccatgggtgccctcataccgccaaaacttatagccccacagcaccgtggtctccatcatcttccagaacaaagaaacagcgagggcagagacactgaacgtggctcttcattttacagggagcgtgtcttgtgaaaacagtggtgtgtgtttatacgcaacacacaatgtgtagagctgtgccccaagaggtttcccatacaaacgccacacctgtgcgtgtgcgacacatatgagggggttgtgttttgcaaacccacatgtgtccacggtggaataacacaagtgcaatttggaacacccgtgggattcttataaacatgtgggccatagcgaacccaagtcccgtggacattcatatggggaataaaatacccctgttagactatgggggtgccccaatatttcgtgagaaaagtgaatcacatatgtgagcgacgtgatctacacagaactcccatgggtcattggaggaagccacattacaaaagtgggggtttttccccataggtttacaaggtttgataaaaagagtacacactctgacccacaaaagaacaggggtattctcacccccggaaaaaaacgcgcaagagacccaagagtcagaagcattgggggacccacaaccaaacaaaaaatcaccccagaccaccgagaactgggcccgggggaacaaaaaaggggtaaccccacatagacaacatcacggcaaggagaggatggcaaccaggagacacaagagagacaacacccactcagacacgggggaccaaaaagcaaaacacacacacacacgcactatatagaccacatgggaacacacagaggaagggaagtgccccaaagcgaaaaccgggggaaacaagaaacagccaagggaaaaaacacggtgcagagaaaaccccaggagcaccagcgacaccgtacggccgtcacgggacagcgaaacacgagaaacgaaaaactacatgaaaaacaggcagccccgagaaaacagggaacaaacccagaaa

SEQ ID NO: 497252 - DNA, 223 bp, Homo sapiens
tactaatggtggtactaatggtgtactaaatggctgttacctaaatagctgttactaaatggctgtacctaaatggctgttacctaaatggctgttacctaaatggctgtggtagaatcataccccatggataccacatattaaaccatgtggtatgattctaccacagccatttaggtaacagctatttaggtaacagcaatttggttcccgcgctttgggt

SEQ ID NO: 497253 - DNA, 171 bp, Homo sapiens
cgatacacgcgcacacgctctgaagctcactagcacggtgtgtcttgtcacgttccataaatgtcattcctcatagcgttgtgtacatcaccatgtctggctgtcattgctgaagccacgaagaaggtgtcacaaaatcgtcatggatgctggagtctctgcccttgggtg

SEQ ID NO: 497254 - DNA, 353 bp, Homo sapiens
atatcatatacacaatcataatactacatgacaatccatagacatcgctgtcagacataaccagagcctacgttattcacacatctagtaagccatctacctgcacgacaacacatcatgacccaccaatcacatgtctatcatatagatacaacccagcccatgaaccctaacagggagacctcatcgagccctcctaatgacctcacggactagccatgtgctttcacttccactccataacgctcctcatactaggcctactaaccaacacactaaccatataccactgatggcgcgatgtaacacgagacagcacataccaaggccaacacacaccaactatccaaaaa

SEQ ID NO: 497255 - DNA, 878 bp, Homo sapiens
gagatgaacgtccatgcgagagagtgtggggttataaggtggtcatgagtgcgagttctggatctggtcttattactgactagtgctgatctgtgtggcggattccaatcctgttcaggagccgttggctggcctgtcttgacaatctgggagctgacgaccttgctactgagttggtatgtgacacgaagttaccatggataccgtagcaagcatgctaacatgctctggtgctcctgaatacagctggtgccacagtatgtgagctgaccatataggttcgtcattccataagcgttccaccactgaatgttgtgaaggacccacataattgtcgaacaacttacgcgtggtgcgtcacattttccctagccccactcgcaaggggcttggggggtgggcagaatggcgttgtcgggaatgcattcggggtcatcgaacattgggataccccttgcggtgttggcttcacctcggggggttttccacatgggctaatttccatattcctttgatgccgtacggcggtgccatacactctggcagtttccacggccttgtggtggagtctggcaatgtggggaacgcgtaagctcattgccacaaaaaacgcacggaattcaatgtacccacggtgtaaatctttctcaggggtaaggtacgcatttgtgtgccactttggctacctccaagtggtacgtggactgcatggccataggtttgcgttcggaaaacttgctcctgggaaggcctttcaggggctagaatactcgactcgccgtggcattcctaagacctttccctcgagaatgtgttacctaggggggcacttaaccacagtggctgtggaagccgcgaccactgggagctgcgaggaa

SEQ ID NO: 497256 - DNA, 300 bp, Homo sapiens
ttccgcgttgaagacgcgcagctcggcgatttcgccgttggcggcgaagtcaaggcggacatcttcgaagtcggccagatcgtcgacgtccagggtgtcaccaagggtaagggcttccagggcaccatcaagcgccacaacttccgtatgggcgatgcaacccacggtaactcgctgtcgcatcgcgcgccgggttcgctgggtcagcgccagaccccgggtcgtgttttcccgggcaagaagatgtcgggccagatgggcgcggtgcagcagagcacccagaacctggaagtggtcaag

SEQ ID NO: 497257 - DNA, 462 bp, Homo sapiens
gggggaaaaacccccgctttttttttgcccaagcttgatcccatggggcgggggctttcccctgggggggggggggggctttgggttaccctggggggggcccactcccggttttttacggcctatggggggtcccggcccaaagacggcccgggcccccatttggtcctccgggaagggggggtaaaaagtttcccacggccccttggtccttggggagggggaaaaaccccccctccaagtttaagtggggggccccccccttgggcgcaaacatttttcggcgccctgggcccaaatttcgggggccggggggacccctttttttaaagggggccccccccggggggggcctccacttttgtcccttttaggggggggtaatttcgggtttgggggaaaaagggaaaaggggttccgggggaaaaagttttccctccaaattccaccacaaataaggcg

SEQ ID NO: 497258 - DNA, 355 bp, Homo sapiens
  misc_feature (5)..(10): n is a, c, g, or t
  misc_feature (14)..(15): n is a, c, g, or t
  misc_feature (18)..(18): n is a, c, g, or t
  misc_feature (20)..(23): n is a, c, g, or t
  misc_feature (27)..(28): n is a, c, g, or t
  misc_feature (32)..(32): n is a, c, g, or t
  misc_feature (38)..(38): n is a, c, g, or t
  misc_feature (40)..(41): n is a, c, g, or t
  misc_feature (47)..(47): n is a, c, g, or t
  misc_feature (50)..(51): n is a, c, g, or t
  misc_feature (54)..(54): n is a, c, g, or t
  misc_feature (61)..(61): n is a, c, g, or t
  misc_feature (64)..(64): n is a, c, g, or t
  misc_feature (69)..(69): n is a, c, g, or t
  misc_feature (73)..(73): n is a, c, g, or t
  misc_feature (77)..(77): n is a, c, g, or t
  misc_feature (79)..(79): n is a, c, g, or t
  misc_feature (88)..(88): n is a, c, g, or t
  misc_feature (91)..(91): n is a, c, g, or t
  misc_feature (93)..(94): n is a, c, g, or t
  misc_feature (99)..(100): n is a, c, g, or t
  misc_feature (104)..(104): n is a, c, g, or t
  misc_feature (107)..(107): n is a, c, g, or t
  misc_feature (109)..(110): n is a, c, g, or t
  misc_feature (113)..(113): n is a, c, g, or t
  misc_feature (120)..(120): n is a, c, g, or t
  misc_feature (124)..(124): n is a, c, g, or t
  misc_feature (130)..(130): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (140)..(140): n is a, c, g, or t
  misc_feature (142)..(142): n is a, c, g, or t
  misc_feature (174)..(174): n is a, c, g, or t
  misc_feature (178)..(178): n is a, c, g, or t
  misc_feature (192)..(192): n is a, c, g, or t
  misc_feature (202)..(202): n is a, c, g, or t
  misc_feature (217)..(217): n is a, c, g, or t
  misc_feature (225)..(225): n is a, c, g, or t
  misc_feature (232)..(232): n is a, c, g, or t
  misc_feature (240)..(240): n is a, c, g, or t
  misc_feature (243)..(243): n is a, c, g, or t
  misc_feature (314)..(314): n is a, c, g, or t
accannnnnncccnnccntnnnnggcnnaggnagcacntnnagcccncanngtntgtgtgnagncaggnagcnccgntnaggtagccnccncnngggcnntggntgntnngtnttggtcntgtnaacccnccncntcntntnttggactccctcccccccccaaccactttttntttntcctttaacccaanggagactttntgatgcatcgttttntttgctgngccaaancaggtcanaanagggaaaggaggggctgggggtgaggggccaggccatggccaaggggccagctgcccctcatttatcactntgaccttcacagggacagatctgatttatttattttggtta

SEQ ID NO: 497259 - DNA, 435 bp, Homo sapiens
cacggatgacgaggtccttcaccagcaggttgcactgtgtgggatgggggaaatgatgcagtagttctctggacatcagctttaaaggaggagtctgtcttgacattgggtgcatattgtttccataggatggtgccaaagctgctctcaatgccatcatgcttgcctgaggcttttaccatcatcatcatcttctggtggttgaattcatctctggccagggtgtcaatgtcgttcctattcttaacctgacgccggggcttccgagcatcataaaacattttccagaggtgggaagtcgatgcttgcagcaggataagctgagacgagaggcgtttcaggaacatccccagcaagccatctgcctttttgccaaattctccttccagctcggcctgtgccccagtcagggggaggtccaccatctctaggcac

SEQ ID NO: 497260 - DNA, 350 bp, Homo sapiens
taagtaagcatgaacatctgtattgaggaagccactttgtattacttgctgctaaaaacaccgtaactgggcgtggtggctcacgcccgtaatcgcagcaccttgggaggccaaggcgggcggatcatgaggtcgggagatcgagaccatcctggccaacacggcgaaaccccgtctccatctattcattcttggaatcctcaactcctggcaacttcttccacgtgctacgacgccagatcctgctgccattccggaagccgttaattatcttcacccccaaatcccagttacgccaacgatgctcacgcctttgcagtcaccagtgcgccagcagcctcaggacgcag

SEQ ID NO: 497261 - DNA, 436 bp, Homo sapiens
  misc_feature (110)..(110): n is a, c, g, or t
  misc_feature (327)..(327): n is a, c, g, or t
ggggccccaaaaaaggggtgtttcaattggtgtgtccaccccccccccccccaagaggggggggggtgtggtggggggggaggttttataaacacgcgctgtttgtgacncccgcgcgccccgggggccaccccccccggtgttttttcccccttaaggaaagcgcggccggccccccccccgccgtttttagtttggggggggggggggggattttttttttccccgggagggagcgccccgtggcgccttttgtgggggccccttattatgtgttggggcaaaaacccggggggggggggggggcgaattccccggggttgtggnaccaggggggtgggggggcccccccccccccccccgttcccccccggggggggggggaaaacttttgttttttgggggtttttttttttgaataaaaaagattctccta

SEQ ID NO: 497262 - DNA, 335 bp, Homo sapiens
  misc_feature (294)..(294): n is a, c, g, or t
taagtaagcatgaacatctgtattgaggaagccactttgtattacttgctgctaaaaacaccgtaactgggcgtggtggctcacgcccgtaatcgcagcaccttgggaggccaaggcgggcggatcatgaggtcgggagatcgagaccatcctggccaacacggcgaaaccccgtctccatctattcattcttggaatcctcaactcctggcaacttcttccacgtgctacgacgccagatcctgctgccattccggaagccgttaattatcttctgcccctcatttatcactntgaccttcacagggacagatctgatttatttattttggtta

SEQ ID NO: 497263 - DNA, 297 bp, Homo sapiens
  misc_feature (42)..(42): n is a, c, g, or t
  misc_feature (138)..(138): n is a, c, g, or t
  misc_feature (156)..(159): n is a, c, g, or t
gaagtatctgttttcatttttttcgcgttataaataaaaatnctatgctggccgggcgcggtggctcacacctgtaatcccagcactttgggaggccaatgtgggtggatcatgaggtcaggagttcaatgaccagcntagacaagatggtgaaannnngtccctccccctccccatcccctacttcccttggttagggggggcccttgcaagggggccccccaatgttttgtcccccctgggacactttttagtattaaacgggatggttttaaaaactccatgggggaaccggga

SEQ ID NO: 497264 - DNA, 387 bp, Homo sapiens
taaactgaaagctatcaactctggagactgagtctgcgctgagtacgctacacctgatgtgactaacagtgttcatttgatacattgtacagtctacagataatgaaagatgtgtagggaatggagcgcgcagggcttgataattcagacactggacatagtaaaagtatccctgtacttaataggtttctcaatactgaaccgtgcactaaaagtttaatctgcactgggcgagtgttctgtaagagtcggtaccacgttaagggaagcaggactctgaggcacaccatgaagaatagtcattgtctcataacaaatgggtggcgttgggtggatcagaagccgactgtaaacctattactgaggctaaattaagtgtggatctta

SEQ ID NO: 497265 - DNA, 843 bp, Homo sapiens
  misc_feature (277)..(277): n is a, c, g, or t
caaaaaaaaaaaaaagcaggaaaaagggaatatttagcagtatggtccgttctggatatgtgaatttggtttggtgacaactaaacaagggcattcagcagtttctggacaattaacatacatcattcccacactcctggtcaacaaagtggctttttcactggcctaaaattttagatgtagatatttggaaatagattttttccatttatacccagttttcctttatgatggataccggtggttaaaaggaaaataatttaccaattggatcctntccatcccaaaaaaaaaaaaaaaaaaaaaaaaaaaaaaaaaaaaaaagagagggggcggcgcgcgcgcccaagaagatatctccccgcggcgaggggcgcgccgaccgtttcagcggcctcccccgcggttttggtgggacacaaggggcggcccctctaagagggaggcgggcgtatatatataaagccggagagggcgcggggcgccgggtgttaaaacaacgggcctgggagcggggggagaaaagcgggcgcaaacagggggacaatctgtggggagagaggggacccctataatctcggggggggggggaggcacaatctgtgggcggaaaaaaatcaccctctacaagagggagatttttaaaggggccttccagagggggaaaaaatatatacaaactttttaagaggggggtaataggggggtgtttcaaacacaataacggcggaaaaatgtctgacgagcgagtagtgtagaagaataatggcggcaacagggaggaataataaaatagtagaaaaaattattacccaggcgatattttgattaatatataggggg

SEQ ID NO: 497266 - DNA, 445 bp, Homo sapiens
  misc_feature (47)..(47): n is a, c, g, or t
  misc_feature (58)..(58): n is a, c, g, or t
  misc_feature (113)..(113): n is a, c, g, or t
  misc_feature (116)..(116): n is a, c, g, or t
  misc_feature (137)..(137): n is a, c, g, or t
  misc_feature (142)..(142): n is a, c, g, or t
  misc_feature (152)..(152): n is a, c, g, or t
  misc_feature (193)..(193): n is a, c, g, or t
  misc_feature (269)..(269): n is a, c, g, or t
gcgaaagccggcccttgggcctccacgtcatgatggctctctcctgntgccaccatgnggcccctggtgaatacttcccgatgggatccggctaaagaatatcgcggtatggnttntctcgatgcctggacagcacntcgcngccgacggtncagtgagctgacaaatcaaatggcccgggagtgtctggtgntgtgcaggacaaagggtcatccacaatttgtcccttactgattgctggcatccaacactcatgccggacattggtnccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttac

SEQ ID NO: 497267 - DNA, 372 bp, Homo sapiens
ggaccatcttggggtacaggagaatatatgtataggtgatatcttcttagaaaaacaaagtaggtaggactcaatattcagtatgtctttatatatccaacctaagttggtagaatcctttctttgggctggtttgaatttcatatagggagggtgtaacccattgtgcatgagcacagtgacacacaccctgtctgggaaaggattctggctttttttattttattttattttatattattttttatattttgggtagcaagggggtttcaccaagctgcccagactggtcttgaactcctgagctctagtgatcctcccgtctgggcctcccaaagtgctgggattacaggcatgtgccaccatgcctgg

SEQ ID NO: 497268 - DNA, 851 bp, Homo sapiens
cctcataagtgagtactacgatttctatacctggaatcatgtatgtttcatttactggatgttacattttaggaaggaaaatagtttgtttatttaaacaactgaatacttataaactgtgttcctggaagttatttattccataaaaaattgttctttgtcatgaatttataattcctaaatgaagaccaggaaaggtacaattggtgggaaggagagaataggctatataaattcaatgtagagtgtctagatttctctaaatgggaagagtgctttattttaacactaattatgggagcagattcttagcaaattctttggaaaagttaatgttatgatgtgcattaggctgcccatcgtgtatataaatgaagcagattggattttgtattcttacgtttctctgcttggtagttgtggctgtacttaaagaaatacagaatttcatatatttaaaaatgtttaaaattgtgacccacagaacattgtaaatgattaaaactagcatgaaaatattacaactaaaagaattcttaattcacagtgttttacttcgacgatgtgcctttgatttaaattggcgaaacttttttagaaggatacatattcgtgtcgcaacggtctttgaagagctggaataaaattctgcttaggtaagaaaaaacatcaatatagaaaaatttgttgggggtttgccctgagaaaacgtttaaaacttgtttggggcgggcccatgtgtattaacttgtcatggtgtctaaggaaccgtgagaatggtggtttcacaaaaaggggggagagcgttgacactgagggttgggcaaaggatataggccaaggtatagcgg

SEQ ID NO: 497269 - DNA, 910 bp, Homo sapiens
acaggtgtgaacctgtaatcagcctcccaaaatgctggcattacaggtgtgaaccactgcacttgagctggttggagccctgtcatcttgtcattttgatgagaccctatagttttgtttttttttttaatctagccctgttttgtacatcttatgccacagacttggattaactaatttcttgaagaagcagctttggttacttttagtgggaaatgtttgcagatcacaatttaggcgctatatgggttagattgctacccgctgatatcatttccaaactgtgtctttgggtattgctaggaaatgcaatacttttttagagagaaaaaaaatcataaatgtatactagtatttacaattcaaataagagattatggattttattgttttttaatggactatattttttagaatagttgtagccttatagcaaaattgagtggaaggtacagagattttcctgtatctcctgattatggggttcttaatttgtttgattttatgttgtttctctctctctcgcttttttttttttttttggaaacagattcttgtcttgtactctgattggcctgcgtgggcccatcgtatttcctctgcgcctgaaccaattcttgggctcaaagcaactctttccacttaatgtctctccaagtagtttgggccccaacggcattttgcacactatacccagctactttggtcatctttacacagggagtggcgactcatcatcttggtgcaccagcgctggaactttggcgtacaacctctaccggtcaccctcccaagtgtgggattcccgcttagcctgcccacgcggttctttttaccgaagacttggtctcacacctcgtgtgcacatcttactctcgacctatttaccacgtatcgcgtgattagacac

SEQ ID NO: 497270 - DNA, 113 bp, Homo sapiens
ttgtgcagggagtgagccgcattccggggctttcgcgtgctccctgtgggtcctcttccagttcttgactgtgcaggcagctcaggaaaatgtagaccactcacaggatgcag

SEQ ID NO: 497271 - DNA, 177 bp, Homo sapiens
gcgggggtggctagtggctagggccgctgcaacacctcagatattgagtgttatcccattaagctgtacgctaccccacccccagaagcgggattgggaggctggggcatgcattctagtgagcaagactctcagaacgggtgggggcaccgtgggggacacctgaacgaggggcac

SEQ ID NO: 497272 - DNA, 537 bp, Homo sapiens
tcgaatagttctagaggatcccgaagggtgctgcggttgaacaggcttggctgacatgaagttgaggctgcagagtcgtgaactgggtgatgcggttggggtggggatacatatcagaggtggctaagtaaaaagtatgggggaaaaagccagctagaggtgatggaagagagcgtgggtcctctgggtgtgcggactgctcactctgcggatgctggccgcgtaggcgaactgggggaagtgggtccgttgatgcagctccagtaagcccaggtcgtcatcgcgtatcagggggtgcgattgtgatggcctgggcgggaagattcatcatcgaactaccttgtgtcgacctcggcacgtgacctgacggtatgacgggtgggctgcgcttcttctgtgaccaggtcctggccatgatgatgcagagcgaaagaacctgtgctccatgacctcctttggtattcgatgggtcccccaccaaagcttcgtgttggtatccgttcttaagccggccagcaatgcagggacttgacctcg

SEQ ID NO: 497273 - DNA, 359 bp, Homo sapiens
gaagatactatatcaaggtttaatgttgctgacatacatgatgatagtataatgacttgtttatgatataaaatactagttttttcatttataatttctatagggcattcactgtttgagtcaaggttaggcttgttaagtgattaaagtgcattttataacagcagcatgtactaattctattctaaaagaataatattcataaacagaaacaggtttcatatattgtatgcaacctgcaaaattgaattattttgctgatataaaatactaagaactcacttgaggaccatgccaccttctgaaaaggccacacacctacttcttaaatgtgttaaagttacagtgtgtcccagaca

SEQ ID NO: 497274 - DNA, 303 bp, Homo sapiens
gactacatacgttccgtaggatctgatagtgcccaccatacagaagttgttactgaggagtccagagaatgttatagaaactattgctagtctgttgggatcagtgacgctggacctcagccagtatggcatgggcatcgtgaaaggactggcgtggtcacctgaaatccgacagtccccggctgatggatgaagctgtgctggaacggcggaacctggtacgccagtgcagtgactcttcggccatggtatccctgaccaagcatctatttgctatcctcggaggcgtcggaagtatgtagt

SEQ ID NO: 497275 - DNA, 162 bp, Homo sapiens
  misc_feature (3)..(3): n is a, c, g, or t
  misc_feature (5)..(5): n is a, c, g, or t
cgnantgatggtcagtctggtcttaagcttgactcctggcttagcagtctcctgctcagctcctgagtcgtaggattgacttgctcaccacgatgctggctattttcaatgtttttgtagagatggggtctcactatgttgcccaggctggtctcaaactcc

SEQ ID NO: 497276 - DNA, 717 bp, Homo sapiens
agcgggggtgagaacccctatgcaagtgcggacctacaaatgtttgtccgctccgtgggcactgtagtggcttttaccctggccgggcgggcggggctcagccggggctgtgctgggctccgcggctggagccgggctctacccagagcaagaccctgatggctgcggtgtttcatggtaacgcgtttatgaagtactcgaccgcatttggctacatcgctggtggtctattagctgcattcagtcgtgaccaccgtgcctgggtattgggactggtttggtatgggagtgttccaagtgattctgagaaattgcagaagagacccagttcagcgcaagagtatttcaaaaagcaatatgagacgagtcaagaatccttttggacttagagatcactaatccatcttcagcttcaattacgaaagtttccatgggtgtcagtgattcgagtattcctgataggacttataaagctatcctgcagaaatattgtatcaatatttactcttggcatcaaggtcaatttacatgatcgttaagcaacgttttcagtgtctgcgaaataataatttcacttccctccaacgattcctcttcagaagaaagaaatacacagacagaagttagtgggaaaaggtgggactctctgaaagtgaagttgagccatcggaagagaacagcaagggctgtgttgtatgccagaatgggactgtgaac

SEQ ID NO: 497277 - DNA, 711 bp, Homo sapiens
  misc_feature (528)..(528): n is a, c, g, or t
tctgagcaagctgggaacgcagaacctgagaggcccatgtgagctgggggcaggaaggatggggcattagcctaggatgcagcttgactagggaggaggccctggctggcagccagacctgatcctttcccctgggtcctgggaagaggggagtgctcaggctgagcactccctctgtgggagtagggatggggtggtgcatggggctgtgggactctgcatccagttccttctctgcatctctcttggcgcagcagcacacactatggggtggatctagctcacactttcagcctctcttctcagcctcagtcccctggtgatcagtgccctaactctccgccctccattggcacagcccctccaatcagcacccttagcccatctttccactcttcagccccctactatccaccttctcacacttagaaccccagctctcagccctctgtgtgttcagccttagcactgctcaacagccactctttttttgggggagacggagtctcgctatgtcgcccaggctgnagtgcagtggcgccacctcccgggttcaagcgattctcctgtctcagcctcctgagtagctgggattacaggcgcgcgtcaccatgtccggctaatttttgtattttaagtagagacggggtttcaccttgtgggtcaggctgatctcgaattcctgacctcgtgatccgcccgcctcggcct

SEQ ID NO: 497278 - DNA, 528 bp, Homo sapiens
gtgatctagaggatcccttgcaggctctctaccttgacccacacacatctgcgttggcttcttccctgggagggaggtatcccaagcatgttcttactcgtggcccagacactctccccagatccgggcacagctgcctcctccttaggattcaggtctcacggtggatgtccctgtgagagccactcccaggtgtggtccatcgcataaccctatcctgtcatgccccccagcacttagaagcatctgagattatcttctatggtttctccaatgtagtgtcagctccatgagggcaaggattggtgtcggtccggtgtatggttaaatccccataaaaactatgcctcagggcggggcgcggtggctcacgcccgtaatcccggcacttggggaggtcaaggcagggggatcacgaggtcagcagatcgagaccatccgggttaacatggtgaaaccccgtctctactaaacatacaaaaaattaggcgggtgtagggcgtgggacctgtagtcctagctactcga

SEQ ID NO: 497279 - DNA, 1928 bp, Homo sapiens
ggcaacagtatgtcaggccggatgctctgatacacacccgaaggtattgcatcctgccatcacagcgatgtgcttaatgatatatgcggactctttatttgagcgcagagcacattccacaggaccatgacccaggaagacgtcaagctactaactaggaaggatgaggagcggtccaagcctatgatcttagtcaatctctgaaggtgccatgttcgtaagtgatcattccgtagatgctctagctagtctacagttccgcttcacacccatacggctatcaagcacttgcgatccataatgggtcttatctctgtatcagaccatgaggattcaacaagttagagagaggcgccatcaagaacaccgtcagcggcgcgatgccacatggcactagttctgtcgtcgtcacatatcttccgccctgagccgctgaaacgagtcgtctgaagcatcgtgttgtccaatccgtgcagtctccagtggcatgggaagttcaactagagtagctatgccttcatagacctatcttgatagctaggagctaggaccattggcattcgtagcgagaggtatagcatttctaccgcaacaagctagtggtctggcgggaaaccacaaattcatatgcgagaaggacgcctgttgggcaagttaggaaggccccaaggccacaggcctgcactgacttgagcgcacacacaagattcaaggggaaaggccaaccccaggcaagggagcaccacgaagagcgttctccatgtaccaataccctttcacctgagggcaaacgagcggacgcggcaagggaaaggacacggcagacgacagccaaacaatggaacaggaagccagaagaaaccagaagacagacagcataacacaaacgacacgggaccccgacaaacaagacagcagcacacacaacacgacaaacaaaaagacccgcagccagcaagagagcaaggacgagaacaaaagagccaaccaggatgcagagcccacagtcaggtctaacacagagcgggataacacaccagtacagaacaggcagcagaacaacgggtgatacccaaccgataattgttgtttcatgtattatatactcacgcagaacaaacaacaacaagaagaacaacacacacacacacacacaccacacaaacaagaaaagacgacagcagaagacagcagacagacaaacagcacaatgacagcgactgacaggagagtccgaaaacgtaacataaaaaatagcaagtatagagaaaagagaaaaaaacagacacagagcaggcagcagagataacacgaaggagcaacatacgaaggatgtgaccaagcgtctaaacgctagaggcatcaaacaaaagaacatagaaaagcaaaatagagaggtggtagaaaaacagaataaaataaaaggaaaaacagacacaaaaaacagaacataagcaagaataagaaaggagagcaaggagacgagaggaaagaggaagaggacaagaagaacaagacgaaagaacagcagagaaggcacaccagagaagaagaaagcagacgagaacgagagcaggagagcacaaaggagcaggacagaaacaaagcatgaagaaggccagaaaggagggaccaacagaagagaaaagaacagagacacacaagcagagaagccaagcaggacaagggacgaacgaaacagaaacggacaggcacgagagacagcgaaggaagagaaagagaagacagagacggaggaagacgcagcagagcacgacgcacaacacacggacacacagcagacaacaaagacaacggaggacgggagacgcagacacagaagcacggagaacgaagagggcagaaaaaagagacagtcaagacacaaagagaagcaagagagagagacacagagagacgagaagaag

SEQ ID NO: 497280 - DNA, 189 bp, Homo sapiens
gcatttgcaacacatttgcattatctagcattggaaagaaatttcatgattagaaaatccctctggatatttggttaaaagtgtgaactacagattttacaaaagtggtcagtggtttgcaacacatcaccatatatgtgatgctaactgtaaatgcataaatgacaacctgagatctgtttttcatca

SEQ ID NO: 497281 - DNA, 498 bp, Homo sapiens
tacttataaaaaataaggggtgatatttttttttggtcataagcaaacagtacacctattggcttagacattatacattaggagcacaggtttgtatggggaggacaacggataggatacttaatatgatctgcaagtgctacccactatttgggaaatagagggtaaaagcgaagttaagcacgtattaaaatgcatcagcggttgaattaaatgcttatggaaagtggaacaaggtgaatatatattatacaagaggcccataccactttttagggatttgctttttttaggcatcccattcttttttcccaatgaacaaagtcaaatgggtactccactacattgcttcttggttgtcgagccccgcgctagaaaagttatggcttccggagctgacgagaagggatctttcaacagggacaccatgacaggcatgaatggtcactttcagttttctgcctctgggaacactatttatccaggagaaaaaaataa

SEQ ID NO: 497282 - DNA, 286 bp, Homo sapiens
ccaagtacatggataactactccgaggaggagtatgagagctctcccccgagcaggaggcagtgacgacgccgtgcaggggcaggaattggaagaggacgactttgacgtggggaagccgaagaagcagcggagatcgataagaagaacgacgtccatgaccatggcaaaagaacttcaagcagaaagtggtagcgctgcagaagaggtacaaagtgtccgacgaggacctggactcggagcagaaccctgcggagcacattccccgagacaagagagaggacctg

SEQ ID NO: 497283 - DNA, 446 bp, Homo sapiens
cttgaagagaaaggaagcaagaatttcagttagaatttcaaagaaacaaataagaagaaaggttgtaggaaagagaatttcaagaaaagtagctaagaaagttgccagaaaagccaagagatttgcacaaatgaataaatcattcagaaagaaacaaatgaaaaagttaagaaaggcaggagcctcagatagaatattgataaaaataaataatatcaataaagttatgaagaagaatgataaagtattaatagtattatcaaagaaattaaagactgcaccaaaagtaaaaagagctccaattgtaaagcaaattaaagttatcaaacgtgtaatcagacatcaacaacataaagaaagaagaactgtaagaagagttgttagagcttcaattagaataacaacaagaagaagaagatagacagtaaattcaaattattttcctt

SEQ ID NO: 497284 - DNA, 374 bp, Homo sapiens
tcggcaagcgtactgtgtgcccgaatgtggactatcatcagcacgcatgagagcaggctaggcgagagcgcttgaacgcaggcacatggttctgattgtagagcacttacgtacgcgccctgtgctcttactccatcgtgccgatttacattcacaaccgcgctagctcgagtgatccattttactactcactgtcagtgtgcaagaagtgatcatgagtcgtgagccaacaacgttaatatgagtagcttacatgatggcttttatagtaaagatacctctttacggactccacttatgactccctaaagcccatgtcgaagcccccatcgctgggtcaatagtacttgggcagtgagagtctccgtcgaact

SEQ ID NO: 497285 - DNA, 268 bp, Homo sapiens
  misc_feature (111)..(111): n is a, c, g, or t
  misc_feature (154)..(154): n is a, c, g, or t
  misc_feature (264)..(264): n is a, c, g, or t
aggccaagcagcagagtgcctggtgtggacgggagaggagtggggaggttgggcgcagtggctcacgcctgtaatcccaacactttgggaggcccaggcaagcagatcatnaggtcaggagatggagaccatcctggccaacatggtgaaaccntctctaataaaacacaaaaaattagccagacatggtggcatgcatctttaatcccagctactcaaaaggctgaggcagaggaatcacttgaacctggaaggcagaggttncagt

SEQ ID NO: 497286 - DNA, 332 bp, Homo sapiens
tggctctcctacaccaaatagtatgattaacagattctagtgtatcacatttgaaatgctttatgttatggctttatgttgatgagttagaaaacccgatgtgtttgtttatgttagatatggtttatgtttttggctatcttatgtagaaaggcatgtacaggtatggcttttattattctatataatttttactgggaaagcttttccaagattttgaatagctaaaatgtcaacttttttcttaatagtattttcatctcagcctagtgatgatgaatcaagtagtgatgaatccagtaatcagcccagtcctgcctttagacgacgcc

SEQ ID NO: 497287 - DNA, 780 bp, Homo sapiens
gtggatagacgaaagctggcctgggctggggccctagtaggtcctctaatcgtgtacttaccgtgtgctgagtatcaacactcgttgataatgacctatgtggatcacggattctgacctaaacttataaatgccttgcgtgtcataacgtcttgctctctcgaaaaagttcatgaccttgtcgtatccttagcaggacgagcatacatagcactcgagagtgtagagccgaaaagtcccacacgatcaatgctttgatgactccatgttctacgataggctgcccgcctcatggcgtcccaatttgcatcgctccacttactacgtaccttccccatcattatctttccccttgaactaacttctggggccacaatggccacgccacagactatgccaacgatatagtccaggaccatgtcatatgcgacatctggacactgccttggtctggcgacacgagagaccaaacaccaaattatcttggtttataacacccgtgggaacattttcgtgtgggtgactgacatacggggttacgtcataccgcagtttcccccttaccccaagtgctggcgtactgacaaactttgctctggcacaacccactgttatctgacatctacttttagcgcaatcccacttacatgggtaatctcccaccccgcggttaatattggtgacaaattggttgtgtgaaggccgtaccacgagtggaacttcaggacaatctccagggggtcgccatatcatgacgtagggagcgccggcacttttgca

SEQ ID NO: 497288 - DNA, 432 bp, Homo sapiens
gcattacaaccagacctccacctcctatcagaacaatggtggcattagcttctcaaaggaacaagagccctattgttaactgtgcatgtgagggatctaggttgtgtgctccttatgagaatctaatgtctgatgctctgtcactgactcccatcactctcagatgggaccatctagttgcaggaaaacaagctcagggctcccatggattctacattatggtgaatggtataattatttcattatacattatgatgtaataataatagaaataaaatgcacaataaatgtaatgcacttgaatcatcctgaaaccatcccccaaaacgtctgtggaaaaattgtcatccatgaaaccagtccctggtgccacttggggactgctggcctacagggaccagtaaggaccagtgaggagttacagaggggtgg

SEQ ID NO: 497289 - DNA, 600 bp, Homo sapiens
aattcggaacgaggggtcatgaaaaaaaattgagaaacattacctcatacacaatgaatgaatcagaggacagacacgggaatggcacgactgtgcagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgcccaaactttatatacttcagttttaatgacaagcatttcagaaatataagagcggcagccagaccaaccagtttttccagatatcttgatgtgaacctgaccctactcctttagaagacagcctgttcatttttaaatagctttaacccaaactgttctatgaccattgtttcaagagacattaacacagttctgtaaatagaagtgtctatggacaaataagtttgggaaatgtggcatactgtatccttttcttaacatttgcatattaaagactctgagatatcctgcagtaaagacac

SEQ ID NO: 497290 - DNA, 343 bp, Homo sapiens
  misc_feature (89)..(89): n is a, c, g, or t
cccctttttttagtgaggggggcgttagggttttaaaaaagggaatttggctccccttccgttgagaggggcccgtccccccagcttgncggtttttaaatgcccaaaaatgccctggggtaagccccctgggctttttaggaaccggcccctggagaaggcatgttccccaaaaggtttttgggggggccacccccccccgtaaaacataatgtttcatgaagaaaactgtttttttttgccatgaaatgaaaattttaaggccttgttataatttttaatggccgctgcggcgggcccttaaaaaagttgcttttttggggcccagggttttgagccccta

SEQ ID NO: 497291 - DNA, 418 bp, Homo sapiens
ctgatgtccattatggcagcttcctgttcttcctacatctgaaataattttagactcttctgtgttctcattgggcttaaaggtgctttcaataaatccggctctcgtttccatgtctggaatataccgaagttcaaagtggccaacactgaaattccacttctcattgccactgcgaggtccgacagctctaacagttttttgggtacgctgtagaagcaggattgtcttcctcttgttccatttcgtcactatcccattggcgacaacccagagctgaacagatatacctcacctttccactatatgcactgagtccatatgtagtcagagattttcctccaaccaaaacaacatcatctccaaatttataagaagattcaagaagtgattcaactgtgaaaggaactgtttccat

SEQ ID NO: 497292 - DNA, 141 bp, Homo sapiens
cactgggaaattgccttgatcttgaacaaaacaaaagtctagtaactttagcaatagaaatacacctaccaaatgctttctcctcaaatatctacgcgaaggaccatggtttaaacagcagcatcaaggtcacacagtagt

SEQ ID NO: 497293 - DNA, 287 bp, Homo sapiens
agaagaaacagactaccttaatagccttgtatctattttaaaagttaaaaatgtagttaaacaccatcccatagaaaattctacgtccaaatagcttaactgctaaattctaccagacttttaaggaagacataataccaatttgacacaaacttccaactcattctgtgcagcctgggtgacaaagcaagatcctgtctaataaaaagtagtaaaaatagaactatcatttgacctagcaatcccattacagggtatatacccaaaggaaaataaatcattctacc

SEQ ID NO: 497294 - DNA, 431 bp, Homo sapiens
  misc_feature (326)..(326): n is a, c, g, or t
  misc_feature (387)..(387): n is a, c, g, or t
  misc_feature (414)..(414): n is a, c, g, or t
ctcttaacaccaaggagctgaaattcttggctgggtgcagtggctcgcacctgtaatcccagcactttgggaggccaaggcaggtggatcacctgaggccaggagttcaagactagcctgaccaacatggtgaaaccccctctctactaaaaatacaaaattagccaggcacggtggcgggtgcatgtaatcccagctactagggaggctgagccagggagaatcgcttgaacccgggagtggagattgcagtgagttgggatcttgccattgcactccagcctgggcaccaagagcgaaactctgtcttcaaaaaaaaaagcttnaaattctcaaattgggtaaacatagtttcacccttgtctcttgcccatttgcagtttaaantgccacagcctgggagtttcatttccnttcctaaaatgggggtt

SEQ ID NO: 497295 - DNA, 211 bp, Homo sapiens
tgtctgccttggactacaggtgggcacatgctgggccatcaccgttagtattaatgaacctataataatggtggttattaactaaagtccaactttattcagatttctttagttttaatgaccattttctgtcccaaaatcccatccaggttatcatgttacacttagttgtcacgtctccaaggtagtactagtccaaaggcaggacaag

SEQ ID NO: 497296 - DNA, 199 bp, Homo sapiens
agtgagagagaacgtcagactggctagtttaattccctgtgcgcagatactgcatatggaccaacatgggtcatcaacgcagacagtggagcccgcgatgaatcattcaacatcatccccacgccacagcagatggatccagttttcctgcgtcatccctcttagcagttcacaagattcctgctgggtacacgagctc

SEQ ID NO: 497297 - DNA, 389 bp, Homo sapiens
ggaaggacagtacagtggcttctcagaattgaatatggggttagacttctaaaagagctgtggtagagggagctgtcaaaggagatcagtcactgttaaagggagcaacagatacgatatgagcaactgctgtgctttcagaatacccaggcagatgaaccggtagactatgtgcagtatcgaacatacgactgagatcctgttgtgcctatcacctggtgaagttgccagtcttaatgaaggagtcaaattctatcgcaataagagcactggcaaagactacgttttgcacgagactacgagccgactgatgtcatgcaagaatatgtgcatgcaccacggatggctgttcataaccgatatcgcagatttagccgggatgtgtggtg

SEQ ID NO: 497298 - DNA, 715 bp, Homo sapiens
  misc_feature (4)..(4): n is a, c, g, or t
  misc_feature (196)..(196): n is a, c, g, or t
  misc_feature (257)..(257): n is a, c, g, or t
  misc_feature (267)..(267): n is a, c, g, or t
  misc_feature (343)..(343): n is a, c, g, or t
  misc_feature (352)..(352): n is a, c, g, or t
  misc_feature (557)..(557): n is a, c, g, or t
  misc_feature (616)..(616): n is a, c, g, or t
  misc_feature (635)..(635): n is a, c, g, or t
  misc_feature (650)..(650): n is a, c, g, or t
  misc_feature (685)..(685): n is a, c, g, or t
actnatttggagtatggctcacacacgccccccgacaggcatctaagaggtggcccccaaatccgcaatcgggagaaaaaggcaagaatcgactagagaatgtaaggataaagggaggcactgcccacccctgctatgtctgttttcccccacaggggcttctttaatacctggggttccctgggtgaggaatgtnctcctaccctggcaaggggccaaacctgttgccgtggccccaaaggcaaccctgaagaaanagtatcaatnccaagggggctttggtttctgggtggccccacctcgtcgtggggtagatggcacttaaatgctaactgagcaagcnctggaagtnaccagggggctccggaaggtcacccctgaagtggaaggcctgaaatcctgaggcccatttgtgttgggggcactggtggctggatgaccagttctggggacattcaggtgggtaagggaatgggaaagtcccgcttcagggggcgttaagagtgttaccacccatagaaaacttctgggagtataccgctggccccggctctttnttggagggaccagcagggtgaatggctcgcagttgtgcctccctggggcggggcgagtngctacccctgggggtaggngggggcgtccacaanaaaacacggagctttgcggcaacccccttcgccanccgcggggccccgaagctggcgccttcaga

SEQ ID NO: 497299 - DNA, 111 bp, Homo sapiens
tacgagatgcaagattaaaaatccactgccttccatagaaacgattgaacaggagaagcaagctaggcgaatcgtatatgaggcgtgcgccgcctatatgcactgtacatt

SEQ ID NO: 497300 - DNA, 139 bp, Homo sapiens
ccgaagatccacaccgacaacaacaaaagtatgggatattttggcaggcgaagcaggaaagtgaaaaagcaggaccaggacgtgccgatgccggaggaaaagagcacccacaagggcgaggggtggctgagggattcca

SEQ ID NO: 497301 - DNA, 726 bp, Homo sapiens
taacaaacccggtgctggggggggtgtggggtataatcctaatgtggcaaatgatctcatttaggggggaaggcccttggagaagtaggccttattgctcctgtgtccttccgtacgcgggaggaattcgaagtacatagaaaccgaccgggattatcccggtctgagactcagaatcacgtaggactttaacttgcgtctgaccacacatactgaacctttaatagcggtatgcaccatcgggatgtcctgatccacaaatcgaggtcgtaaaccctatggtcgatatggactctagaataggattgcgctgatactccctaggggataactgggtcccgatgtgggtcaacgtgtaatctggggactccagtggaagtattacgatagtatcggcttttggacgtgggttgaaaggtcctccacgccaagtgctaaccgtgctccgggcagagttgagggggtttcagtgtcaatcccgaagggggtcgtccccacaaaaccgaacattcttcacattcgctccggtatacggggacaagatatcaagcgaccggtggagggttcgtggccaaggcacgaggccgggattccataaatattgaaagctccactagggtcatgcagaggacccagccgggtcaactgcccgactcttgcacgggggcagggcaccgtacaacgggtcaaagcgtcaagaagacgagttagcccctacggggagcc

SEQ ID NO: 497302 - DNA, 327 bp, Homo sapiens
cccccccccccccccccccccccccttgcctttttttttgaaggggtgaaacagccctcttataaaaaaggtttttttttggggggggggggccccccccctcgaggggtcccccccccctttttaaaaatatttttgttttttgtgtttcccctttttttgtttttttttcgcgccgggggccccctcccttttgggggggggcgcaaagctcctttttttttttggcccagagaaagacacaagcacacaacaccatgtatgcgtcatgacagccctcagtacagacaaaaagaaaccagagaagaaaaaaataaaaacatacca

SEQ ID NO: 497303 - DNA, 399 bp, Homo sapiens
  misc_feature (74)..(74): n is a, c, g, or t
  misc_feature (113)..(113): n is a, c, g, or t
caggcactggctggtgttggaatcggggtcaggattattgtcaggaccctcagagccccatggtacccactgcntggtgcaaacctctgaagctcccccaacccaggcatctntgagagccttaagttaaggagcctccaaacacagtcattcctacacatttatttctaaaagcagcttgcaatttacttacttattatatatatatatatatatatatatatatatatatatatatatatatttacttatttatttattatactttaagctctagggtacatgtgcacaacgtgcaggtttgttacatatgcatacatgtgccatgttggtgtgctgcacccattaactcgtcatttacattaggtatatctcctaatgctcgtgccgaatcctgca

SEQ ID NO: 497304 - DNA, 504 bp, Homo sapiens
agatgtgatattcagctaccagcactctgggcagtcctgggactcagatcatatccttctttaagtagaggttctgtgccagcaggtacagcaggtgcctactgttacagggagtcttctaacccaggcagtgtacctccagcatctgttcgaattttgattgaagcagcttcagcttcccgcacagtctccttcacagactgcatgaggttctgggcatagtgaaccagcatctttgtggactgctcagactcctcatcactgatgtaggtccggcccagcatgttggccttcactgtggacaggattttgagctgggtgctatatggttgggattcgctcacatacctgtaagaggtaggttctaatccgtatatctgtgcactgcttggaaacctccttgtgcaaccgagtcacctcatctgaggccttggcgctgtccttggcacaacggaatgagtgccgcttggtaccactgcccctcttaccagcgagaatcccagc

SEQ ID NO: 497305 - DNA, 153 bp, Homo sapiens
cagcaggcatcccctttcatcagcagcacaagcggcaggcagggcaggcaacaatcccaaccaccaatctcagctcaaattccggccaagctcccagccaggcagcggggcaggcaggccggcaggcatccatggcagcccagggctcacggc

SEQ ID NO: 497306 - DNA, 697 bp, Homo sapiens
caatcccttggcctgtgatccagtatgggcccgggtaaattagcttattagcaaaagtgtccccagaaataggaagagctagtagccttccatggtatattaaaaaagcctggtatggtaagcaccctatttcagtatgttccacacgtatgactgaacaattgtaattacagggggtctggacgattctggtgtagtatcctagccagccagtctcctatgaggctggcagctccagaactgatttgctcacatttagcccgtagacatctgttacaagcagtctgtgttagtatagctctcctcagagctctagccctcgagtagtgagtacagaggtcaggtagttggtttagtatacacagcagcgtctctggcggtggttatctatcgccctggtcaaggcagtagttgaccccccgggatgttgtgcggctgctcatgttagtgctgctctcgctaaggtgcttgtttcctgtagttcaagaatctggacatagtacttcttgtaacacgtcagcgttgggcttaccccctacataggttactttggttaaggacagaagtaaaggggcacaggggtagtgttttgtctttctttgggctgttagctcactcagtagttgaaggtgctaagtcatagccttatggaaagtgtatgggaggcagaggagattgtctagctacccgatcccgt

SEQ ID NO: 497307 - DNA, 238 bp, Homo sapiens
  misc_feature (194)..(194): n is a, c, g, or t
  misc_feature (231)..(231): n is a, c, g, or t
taggtcatgataagagccgggggtaagggtccctttccttcccatcacctctaaccacgaagacaccctccaaagtgacagggagaagccccagagtcctgctgcctcgagatggaccttgtgaggcatgacaagattgttgtacgtgagtcttcctgttgccctacgagccatggctggcggtagtgtggcanatctcctcgctccacgcctgcgaccttgattgtccantgatgcc

SEQ ID NO: 497308 - DNA, 185 bp, Homo sapiens
  misc_feature (82)..(82): n is a, c, g, or t
  misc_feature (84)..(85): n is a, c, g, or t
  misc_feature (89)..(92): n is a, c, g, or t
  misc_feature (95)..(95): n is a, c, g, or t
  misc_feature (109)..(109): n is a, c, g, or t
  misc_feature (116)..(116): n is a, c, g, or t
  misc_feature (123)..(123): n is a, c, g, or t
  misc_feature (154)..(154): n is a, c, g, or t
  misc_feature (164)..(164): n is a, c, g, or t
  misc_feature (179)..(179): n is a, c, g, or t
  misc_feature (185)..(185): n is a, c, g, or t
tttgagtgaatcggaaaggaggcgccggctgtggcggcggcgggagctgctcggaagctacacctcgcaagggctccccccncnncccnnnnccncccccaacccccancccctcntcgggcnacccaacccgcccaactcccagcggagagcnaggttttctnccgctttcatagcanccagan

SEQ ID NO: 497309 - DNA, 949 bp, Homo sapiens
atatgggatatgtatggatgagtatatgaaataagctgactcggaaaggagtgaatgaaggtagaatgaagtgtaggaggtgtttgtactactaattgttcattgtgatgtgtatccagtgagaatgtaaagtagcctatttaggcgcagtaagtatgtgctcatacgagacattcttgaaattaggtgctagcatgtcatgtgttgatcgctcgattggcttgtagaagcagatgtgatggaggatgaatgaggcaatttcttaccatttgatctgtgagagatctcgcaggcagggatgagagtagcgttcctgtctatggaccattattgagtgaataatacgcaattgtgagtaaatggggatcgtctggagagacttagtctataggtgaagcaagaccctatgtcatttctgtctgtgtaagatggcatagtggttcagacgagagagataagatagagaatgagaggaggctatagtgttaggggtcgggcatcgtgagattccccgaaaaatgttggatgaggtgaagacgggctgataggtttcagagtgtgcacgtgaactgctcgttgcatgtgtactctacaggaattaaggtgatggctgtaccagggtgaaggtattgggggccgacttcatgtaatagtctgcaatcgagttcctactactgaggtatgccaatgaggagtcggctgcttcaagtggcgtcggttaatcccatggatgcaacagaatgtggggctgcttcgtgatcctcgcccacggtgaaatctgtcttacctggatgcatggttgcagcttctgagtgcgcattgttcttcccgtgcgagaagggtactcattatcaggatttttcgaggggaccaagatcgtcaggcgctccaaagaggggtggacccgcttactgaccaagggaaacttttgaaagggcctcaaaaatgc

SEQ ID NO: 497310 - DNA, 288 bp, Homo sapiens
tatcagctcgcctgctactgggctcttctgcgctgctcagccatcactggactgtcgaggatgcaaggtccatctgactcctctctatgctttgcttagccttgagtgccagttgcctgctttgggattactcagttctttatccagccctgcgactgtgtcccagtctcctaatgtggatctgggtatgccgacatcctctttggcagtctgagtgaagtgctatcatctctggcaggtatctgcattgaacctatgatcagtctgttttcgcaagacagacagagg

SEQ ID NO: 497311 - DNA, 154 bp, Homo sapiens
acttgagtatgtgagagagtctttccgatttcaataattgagttctttttttttccttttttcagataggttcctgctcagcccaggcagcagtgcagtggtgcaatcatagctcactgcagcctcaacctctctagctcaagcgatcctccca

SEQ ID NO: 497312 - DNA, 284 bp, Homo sapiens
ggaaactacctacatgccccgcggtggtcagcccgccttatcccagcactttgggaggcctaggcgggcggatcacaaggtcaggagatcgggaccatcctggccaacatggtgaaacaccgtctgtaccgaaaattagctgtgcatggtggcgcgcgccataatcccagctactagggaggctgaggcaggagaattgcttgaacccgggaggcagaggttgcagtgagccgagatctcgccactgcactccagcctggtggcagagggagactccactcaaa

SEQ ID NO: 497313 - DNA, 181 bp, Homo sapiens
tgactcccgtgtgtatgatggtagcctttctgccctgtgcgtgccacatgagaatggctacacgagcagtgatgccatgccccaatacatggccaccttgctgcaggcctctggtgggtcttgcgcgggcagcttcttggtgtgccaacggacttggtgacccctattgtagcctattgcc

SEQ ID NO: 497314 - DNA, 440 bp, Homo sapiens
gtaaggacacaccctgggaatcttcgtgagactgggcggggggggtagaagatggtgaacggctgacacttcatacgggaaacaaatactggtctgggaataagagggccctcactcacatcaatgaagtcacctattctgtgtagctggactattctctcagggttctgagatgccttctcttctatgaaatctacttggtactggcggggtggaaatatttccaaggccactttggcttcaacttccagagtttcaaagggaagatctttataaattaaagcatgagcatccttggtgaaggaacgtaagttctcttgggtgggcatccactcatcaggttggctatccaaaactacgtcataacagaagggcaccagaaattacaggaacttctgggagctctgaccaaatggaccatatattcatcttggaaggcc

SEQ ID NO: 497315 - DNA, 423 bp, Homo sapiens
ccttcaatttcaaattgcagtacttttagttttaagtaacttggcccttttagacagaaactgttgtgttgagggagtcccagccctttaatccaagcaggggacagtcccccaagtgcccttgatttttgcaaagaacttagtttttcctgcggataatttaaagctgccagcatttgaaggaaaggaaacccttaggatggttttggcttgcggtaggtaatttttttttttttttgagacaggatattgctctgtcactcaagctggagttttgtggtgtgaccaaggctccctgcagcctccccctcttgggctcacccctataatcccagtgagtcataatgttgaggtgggaggattgcttaaggccaggagtttgagatcagcctgggcaacatagtgagatcctatttgtacata

SEQ ID NO: 497316 - DNA, 1009 bp, Homo sapiens
ccggtttgctgcgagctgcataccttctggtatgtatacatttatacaaagatccctgtggatcaggcccatctccgtgcgaggctctaacttcgatcgatagcggaagggagccatgccggggtgaatatacatgtctcacctcctgaagtccccccttcccacccatgtccgggacctgggggctcctgccggatccatgggggcgttgccagctgcttaggatgaggagctggaatttatagctggtgttcggggaggaaaaggaggcccccccgctgggcgcggggaggattgggggaagaactggatctcagaggatgccccgtcatgctgccgtctggccttgggtagagccccctccctattggacggctgcgaccatagtcgggtagttccccgatccatccagcacctctcggcctcgtggacattgtcatacggccaacgcgacccgtggacgcagcgcgccgctcacgcgtggtcaaccgtgaggagacgccatgtccccggcgaggtcgagtgaggcatgaggacgagtacgcaacgagaatggccagtgattgcttgagagagagttgccattgggagcgatagtggacggatgattaccctcgggaaagttggtgcccacaaggtcggatacacccgggatcaacacactcccgaattcatcattcaccaatcgagccggaggagggcaccgaccacgagggccatgggcggactttggcggacagtgcaaccaaagtacggcgatgaagatggaccccatggcgctagagtgtgggtaaacgcgggacatccataccccgttagggacggacacagtttaagcacgcgtgcacgcaaagaccagcggcatagatgcacatattactggggaagagggactttaccgatgtcatggaaaatggccacagggcggcggacgacgacacaggtgagcattgtgggatagatggggccccacttctcccttttatccaagggcgccgcaaaaaggcca

SEQ ID NO: 497317 - DNA, 468 bp, Homo sapiens
ttagaaatggtttctttttataagagacccaaaagaatgggcttataattacactcccacaaagtggtccatgcatttaggtgtggcatgcaaggattacagcattacttatacattatattgataacaggattaatgctactgttccagagctgggagaagtgcataatatattgtccagctgagcccttagagggtgtacgtcacggccgacatcttgtcttgtagacctctgaggtgggagacttgatgaatatacggttctatgccttacaccactgtgtgaaagactcacaaggcctcaaacaacaggtggtttcagacacacacctgtgcgctatcgctaatatgtccatagtctctcaggataccaacacagcttgtactggggacagggaggtgcaccatggtggactgctgcaggggtttcaagggtctccctctacagagacaagttgtgcaaagttc

SEQ ID NO: 497318 - DNA, 423 bp, Homo sapiens
  misc_feature (18)..(18): n is a, c, g, or t
  misc_feature (55)..(55): n is a, c, g, or t
  misc_feature (83)..(83): n is a, c, g, or t
  misc_feature (177)..(177): n is a, c, g, or t
cgttttgggataagaagnttaaaaattataaatatatcaattttcacctgttaancctataaattcaagtgtaatccccaatnaaaaaatgccaacaggttttccccccaatagcattgaaatgattttaaaatttaatgaaggccaagcatggtggctcactcctgtaatcccagnactttgagaggccgaggcaggtggattgcctgagtcccaggagttccagaccagcctggacaacatggtgaaatcccgtctctatttaaaatgcaagaaattagctgggtgtggtggtgtgcacctatagtcctagctactcgggaggctgaggtgggagaatcacccaagccttgggaggtcgaggctgtagtgagccaaaatcacatcactgcactccagtctgggcagccagagtgagaccct

SEQ ID NO: 497319 - DNA, 232 bp, Homo sapiens
catcgagctcggtcccgaatcctaattacgggtgcagccaaaaaagaaagataataaacaaaaaccagattttaaaacagctccaaaaaagcaaaaaaaaatcccagcaacaaccattaagcctttttaagatataactcacatacctcagtgtgcatatgccagtcccaaattaattcatgtatctcctactttacaagaccattctccactcccccgttaattggggttt

SEQ ID NO: 497320 - DNA, 148 bp, Homo sapiens
ggagtggagtggagccctgtggttgccgactctatcctcttccccacggtccagtcagcgggttaattaggccatcccctccggagccgggaccttgtctcttatttaaggtcctgggggggccccctcgtccgccatgaggttaatt

SEQ ID NO: 497321 - DNA, 564 bp, Homo sapiens
tggggttcctggtggaggcgatgcctcaccccacttcggctcttgcttggtgggctgcatccactgtctgacaagccccagtgagatgaacctggtacctcagttggaaatgccgaaatcacccatcttctgcgtcgctcatactgggagctgtagactggagctgttcctattcggccatcttggaacctcctgtatcacaatttctttatccactttttgattggtgggaatttgagctgcttccatgtttttgcaattgccaattgtgctactacaaacatgtgtgtggaagtatcttttttgtataatgacttctttcctctgggtagataactcatagtgggactgctggattaaatggttgttctacttttagttctttaagggatatcctcactgttgtccttagtggttgtactagtttacattcctaccagcagtggaaaagtgtttccttttcaccacatctatgccgacatctgtttttttttaatcttttgattatggtcattcttgcaggagtaaggtggtatacatcgtggttttgatttgaatttcctg

SEQ ID NO: 497322 - DNA, 233 bp, Homo sapiens
gtagcaccaggcaggcatagaacgaggcagcaccacaatctttttgtttccgtcttttttcatttcacatcaaagcgatgtccatttcggtcagtgcctgccattgtcagttttccatggcacaaataattctatcccacgtattccattcactcatacgtttaaaggtcgcgggctgtcatccaagtactactcactgtctgtcccatcatatggtcacacgatgcaagttt

SEQ ID NO: 497323 - DNA, 259 bp, Homo sapiens
agcatcagagttcccttggatcggatagatggagtggggatgacaatgcacattatcagactttcatcaccaatgaaaaaataaagcatcttcatagacttcatactgtcattagtgcattcggctataggagaagggatgaaacatgtaaaatacttctacaacaataaaatgttaatagaaatcgtcatgtgctgaggtcattttagtgagctaccattgttggtttaaatacaagaaaagtcatttcttgtattta

SEQ ID NO: 497324 - DNA, 343 bp, Homo sapiens
gacaaaaagccggataagcgggggcaggcctcctagggagaggagggtggctggaattaagggtgttcgtcatgttagctagtatcaggtgcgagatagtagtagggttgtggtagctaggagtttcaagttgcagtagtcaggcaatgcggtagtcagttcaggcatccatcatcaaatagttcacttaagaatggttcatgtcagggttgtccggctcacacctgctcatcatcatcctcatgtgggtaattgaggagtctgctacgattttgcgtaactaggtaaggttcaatccactcaactgcctgctatgatggctaagcattgagagagtgaggag

SEQ ID NO: 497325 - DNA, 758 bp, Homo sapiens
gatgtaataagctgaacaaatcttatgaaaatgtatatctcttgatctttcggtcagaatatgcattccgttagaaaatatttacctcaacttattccattcatacacagacagatggctgtgcctaggaaaagcacgaatatcacatattctggtgcaatatgtgaattcagaagattgcatcttgccagaaacaggtgagtgaatctgggggttcatcagtaagcagtcaccaagatttcgctgtcacagacacatagcatggtaaatgtgatctgtattctcgctgggatggaccaatgtgtcgatggatgccttccgggtttcctgggctttcaggcgtttgcaatactcattcttcctttagccctttccgtcctttgtccattgactgggaaagcaagggtggcttgctagaattatagggggttccccaatcgcattatacccgtggctatttcccaaggaacgaacctcggtcccttcgtgggaatttgccctgaaaaaaacaactttttcccaaatgtaaagggttctaggggtgctatggaaacttttttcccgttggaattttttcccgatttaccccctttataaggggggccccgtccactagacaaagggggcgctttatatagggtgggccttaacggtgtggacctgtcggcagcaggtggaacttgggcagacacgtgtgttactccaattaggagaagaaatttctatgtcggtttgaacaatccaactggggaagagat

SEQ ID NO: 497326 - DNA, 816 bp, Homo sapiens
ggggtgggggcggcgggggggggggcagggggcgggggggagggcgggggggggggcgggcggggagggtgtgcggggtggcgagcgagcatgggagggggcggggggggagggggggggaccggaagcgctggcggggggggcaccctgggccgggcggccgcaggatggagcaggagtgaatggggaccggtctctggagggtcccgccctcggaagatgatcccgggagccaggggcgcgagcgagctggagagccgcggtggagttcgtcgggtgcccatgaggggcggcgggccagcgtgcagtcggtggacggccggtggctctgtggctcccaggtggcggcgtcagcgcgccgagctgtgtggtggagatcgcccgcctgcgattctgtcgtgtccgtagtcggagcccggacctcgtgggcctcatccgggctgaggcggcccagagtcacacccgccgtgaggaggtggtggcaacggactcgtgggccctctgccggcctgtttcccctgccactcccgcccccgtgagctgggaactcacggctcctggaaaaacctgggccgtgggaggctcacgctgcgggcccttgatttgagcccttgagggaggatagggctggcctttgtgaagcccgcagaggctgagaacctcaggcttccctagatcccgagcccctccccatcttcctctctctaaaaaccaccctacccccccttccaccttcactcctgtgtctcccgctgattagcctcagactcttcttttattgtttttcttttgtaaataaaaagcacccggttccca

SEQ ID NO: 497327 - DNA, 139 bp, Homo sapiens
ccttaacctgctcacacagctgatgataacagagtgaattggactgggcagtctgtctctagagtctgtgcctctaactcctcaagggggctacccttcccttccaggatgccagtgagagatggcaggagaagggcag

SEQ ID NO: 497328 - DNA, 1026 bp, Homo sapiens
gggatatctgtggaccttatggaacgcaaagactcttgagaactgtaacgcccagaaaaaccgtgatctatatcttgtcacgctcgccacatgaatataagtataatggacacatgcgagtttgatatgtgcacgatcataatcctgacagtgggagaccctctagtgagtgccggttattaccatcatgtaggattaagtgattgccatactttgcatatacatcacgtctagattgaatacaaagacaacgactacatctatagcagcagctggcgcgcagccgtctgacatgagagaaacctgcatcgacaataagtgtgctagtctgtgcaatataaccggaccagaattcgctagaagcttgagatgagggatagcagactagcgccatactttgcgcattgtggcttgatccatacacatgatcatggttgataaatgcgaatcatcgtcatgatctatcatacgtaccaaagcgtaacttaggtgacttactagtaaaatctatctcattcatgggagtgagggacgacgtaaaatcgatgcaccctctgtatccagcatctggtggacctgataaacccattgtctatgagggctttcgcgataatggccttcttggatgcactgttcccctggaaggaagtctgttcctggacaggcgcacggtggctcaatggagggtgtgtgccctcatcctggggatccgcgatctcacccgtgagtctacctgtacgattgttggcttgcccagtcctatgtggggaggcgacgtatgctgctgctggtgaggcctgcttgctggggacaggccccgaggctccctgaccgtcttgacggtgcggggactggctcctttcccgtctccacaagggacgggctggctaagaccatgggcgtggttgatttaccccgggtcacttctgggtcttcggccagtgttccccggggtctccccgggttctcccaccgtgggcccctggcgccctctcccccccggtgttcggggcccattcttttccc

SEQ ID NO: 497329 - DNA, 841 bp, Homo sapiens
tgtagtggctcacgcctgtaatcccagcacttgggaggctgaggcgggtggacgacaacaaggtcaggagttcgagaccagcctggccaacatggtgaaactccatctctactaaaaatacaaaaattaggtgggcgtagtggcacatgcctgtagtcccagttactcaggaggctgaggcaggagaattgcccgaactcgggaggcagaggttgcagtgagctgagatgacgccactacactccagcctggggatacagcgagtctctgtctcagaaaaaaaagaaagaaaaaaaaaggcaaagggagaagaaaatttacttttatagagtgactactaggtggctcatgcctgtaaccacagcacttgtgggagactaaggcggatggatcgcttgagcctaggagcttgagatagcctggttaacatggcaaaaccctgtctctacaaaaaataaaaaaattagctgggtgtggtagtatatgcctgtagtcccagctacttcggaggctgaggtgggaggatttgcttgagcccaagagacggaggttgcaatgacctgagatcacaccaatgtactctagccgtgggacgacagagcgtgatgctgtctcaaaaaaaaaaaacgcctcaccagggtcaccaggtcccagaggccatcaatttattttctaatcgtatggggcaactcacctttctttcccttttccggataagaaaaacgttaatcccaataggtttaagtacacagaggggggtccaaattcgttactctaaggcctgcggtatatagccggttaagaacccttctgatggggtttgggcctaagctaaggcggc

SEQ ID NO: 497330 - DNA, 226 bp, Homo sapiens
tgaagcctgggtgataaagcgagactctgtctcagtaaaaaaaaaaaaaaaaaatctttgatatttgctggaaaaacttaaattgtttcctttccgtcccagtaattttctcatgtcatttttatccctgaattgccttgttccctcttgcttggttttatccaatctttctactttatatgtcttccaaatgcccatctctctcctttctccagttaggtttttc

SEQ ID NO: 497331 - DNA, 456 bp, Homo sapiens
cggtcaatatggccgggggggtgagggcgatttttttttttccgcgagaaacctaatcaggccgaagtgagctaatagataggctgcaacctgtgtaaaaaggggaactagattaggacacagtcccctgacgattagagggggcgatcaaatatattggtaccggcgtcttcgtgtaaagtatcaacgactaggacgtggctacctcgtatttcacgatacgcgagtggaggagtttgtacatgtggaggctgtcggagggagtgaattcttgcaacacagggtgtccaataaggctcctttcaagggttagaaacgagcttgttgtttcgtgttttcggtaaaaaggccgcctacttgggcccatgcgtaatgtctatactatagcgccgtgcagggataaatcgaccttttttcgcagacaaaggtgctacattggactactgaggtatgggc

SEQ ID NO: 497332 - DNA, 379 bp, Homo sapiens
cggtatatgattcatgttatgcggcatccagaggtataaaatagaggcaaggtttatgtgtgatctatggaccaggtcccttttcctatatctgagcttcaagaccctcaggtatagaatgggtactatggcgccgtagaagatgagacagaatactatagtaaagcccttacacagtgctcaatacatgaaaatcatcgctgtatacattgtatccggcccacaagaggcgctacttgtcagcggggaggaggaaatgcctctttaaaatgacgtcattatcggatatctctacaaaccactgcagctgtcagtacaagtggacagaagcacacacctacctattacacaatcgctgtatctagtaaccatatagttg

SEQ ID NO: 497333 - DNA, 176 bp, Homo sapiens
tctcttcgcgactgggactgtcctcggtggtggtgtggagggcgcagaccaggtgccctccccagagctgagcctgcctgggtcggaagggaacggcctgtgccttgtgggtggaggcggggcagggctgtgtggcaccgccagggagcgggcccacctgagtcactttattgggt

SEQ ID NO: 497334 - DNA, 323 bp, Homo sapiens
actaggaatacggctcgtagcccggtcacggggacgactgcagtggcagggcctctccaaggtcagcgatctccctatgcacatactatgtatggagcagtctagagcctatcactataggcttccatgacatgagagacatttctatcaagctctctgctttcctgagggcctactgggcctcggccactagtgacagccacaatcctccggatacccttggcaatggctactatccgtacacgatcacaaaagctcctgcataactcgagtatccgcaggtagcgtatccccacagaactcaacagaagtcagggagccag

SEQ ID NO: 497335 - DNA, 387 bp, Homo sapiens
  misc_feature (299)..(299): n is a, c, g, or t
  misc_feature (324)..(324): n is a, c, g, or t
  misc_feature (380)..(380): n is a, c, g, or t
atctcaccaatttcaaatctgatctattcggcttagcgactgaagattgacgctgcccgatcgcctcggaagtcccctggaccatcacagaagccgagcttcgggtaactctcacagtggagggtaagtccatcccctgtttaatcgatacgggggctacccactccacgttgccttcttttcaagggcctgtttcccttgcccccataactgttgtggggtattgacggccaagcttcaaaacccctggaaaactcccccactctgggtgccaattgggacaacattttttatggcantttttttagttattccccacctggncccattttccttattaggggccgaaatatttttaaaaccaaattatcttggttttnccggact

SEQ ID NO: 497336 - DNA, 540 bp, Homo sapiens
tcggcgttaaatagtgaactccgccagattcggctgacatcaacatcagcataattccatggaatacatccactggcgaggcccatacttgtgagagaggccactaaacatcaccgcgaccatgaggaacttccagagcagtaatcgcgacagggcgcgaaaaattggcaaaagcgtgaattcgcgtcgccgttagaaagtaaaactatagatgtcggatacccacgtgccaatccgagaaggcatcacgcctcactgtgacgcaggcacgccccatccgcaacgaatcatgagatctttcaatggctggcgtagcggcgacatcgaggcggccacgtctggatgcccggcaagataggcctcgacctcttcactgggtctgacattgtccgatttcatacgggtatacgcatcacggacatcagggttctcgtccatgtaatcggccgttgccagcgcaacacccgctgccacccgctgataaccggccgcatcacagttgatcacgggttccgcgtcaggatcagccgccgagacggg

SEQ ID NO: 497337 - DNA, 335 bp, Homo sapiens
tttcattttggcctggccagtgggtgaaaaccaggcctccaatgcactgtgacctttggcttccccaacagctttcccaaaaaggcagaggggccttccccagcccgggttttcctgctgcctcctgcctgctgcaactgcaggcatttttaggggcaacgtggaggaagggccagggatgcatgggattttaattgtttcatccccccttccccgtggcaaaaaaacagtcagtcctcttcaggggttttttggatttttggtgatggacaaaaaaatctttttccagtttcaaattatgttccacaaataaaaattgccttttttattttgga

SEQ ID NO: 497338 - DNA, 693 bp, Homo sapiens
agcccgggaaaaatcggacacagttctcccaaggtataagtgttaccagagggtcccctcgggcagataattcggagaagaaggaacctccatggataggcccaggaaaatgaaaaaaatgaacaagcttatgcagaaaggagagaaaccccgccctttggaaggaggtaaagccccccagcctgcaggtaatttacggggacaggctaaccaactggcccttaattttagatgggccatacccaataggcagatcaatgatgggatgggtgcatatgcagatgatatggaaattttcatggaggggattagagaactcagaagataccttagggagccgccgttgaggaattgtatgcgtatccttatgggggagctctctaatcaccatgaccatcatgatgaattttgccttatgccgtgactccggccattagtcatgagattaaaaatgtgattgccggggtgtatttttccttgcattttcttaataggcctttactgatccgtttgctgtacaccctatgttatttccatgagacaagtgggtcttgtgctgccagtttatatttgaatattgcctgtccgcacagtgtgaagtttcttgggagcagtagtttcatccataagaattgcacttctttaagataataactcgctttgaaaaaaaaaagtaaagaggattaacaattc

SEQ ID NO: 497339 - DNA, 355 bp, Homo sapiens
aatagtgtgtaagtgttcccctttctccatagcatcttttattatttgactttttgttaacagtcattctgactggtgtgagatgatatctcattgtggttttgcttggcatttctctgatgataagtgatgttgagtgtttgttcacgtgttttttggccacttgtatgtcctcttttgagaagtgtctgttcatgtcttttgcccacttttcaatggggttatttgttttgtttttgcttattgatttaagttccttatggattctagatagtagacctttgttagatgcctagtttgcaaatattttctcccatctgcaggtgaatcttcaataaaatgcttttgtcattca

SEQ ID NO: 497340 - DNA, 148 bp, Homo sapiens
cactagtttcctgcctgctccgtgttcaatcccggtctcagtccctccttcccctaatatatatcgcagccggatcgacctcgacgccacaccgtcccgaccctgtgttgctgaggcccacatgtggtcctactgtgccctcgcggac

SEQ ID NO: 497341 - DNA, 724 bp, Homo sapiens
agcgggggcgcgcgccagcaaatccactcctggagccctgcggacccctggagcacgcgcctgacagcccctgctggcccggcgcgctggtgtcgccagtgccatgctatgcgcccccgatcacttggtggcctgccgatgacctgcggcatcagggacctaccccgcgctacttcacctgggacgaggtggcccatgacgctcagtgttgcgatggacgcgggtggcctactgatctgacccgtaaggtgtacaacaatcagcgacgttcacctgcctggcatccacgtgtggactccctgggtcatcatgcacactaccgccagggcacggctgccacggatcccttatagtggccttccacatcaacaaggcgccttgttgaagatcgcatatgacactctctcccttgattggagaactgtctccagagcatacccagcatctagagcccaccaagaataacgagctgacagatgagttccggaggagctaaccggacacaactgcagcgcataggggctcatgaaggcccaaccaaagtcttcttccagctgtaccctgctgcacatcttgctgctggatgttgcaaccttggctacaccctatgggtcaaatggcacgcctttcatgcatatcatcctctgtgcgagagttgcacagtgcattcacggccaggctgcacggcgcagcaagacttgcccactgatgcctcagcacctaa

SEQ ID NO: 497342 - DNA, 406 bp, Homo sapiens
agcaggttaggccggaggaacagcgccatgtgctccgggctcctggagctcctgctgcccatctggctctcctggaccctggggacccgaggctctgagccccgcagtgtgaacgatcccgggaacatgtcctttgtgaaggagacggtggacaagctgttgaaaggctacgacattcgcctaagacccgacttcgggggtcccccggtctgcgtggggatgaacatcgacatcgccagcatcgacatggtttccgaagtcaacatgagattctggctgcaggaaaggggaacgaagacagtggtctgtgcgttccaggggtgtctctgcggtttttccaaggctgcctcctggactgggagacccgggcccggcaccgccagtctctgtccgaggtgctgacagg

SEQ ID NO: 497343 - DNA, 2117 bp, Homo sapiens
cattgtgttgggcacagctctcactcaccctccggcttcctgtcggggctttctcagccccaccccacgtttggacatttggagcatttccttccctgacagccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcagatgaaacgccaaggagctcaggtgaccacggagagaactgtccagctcaatgtctcctatgctccacagaccatcaccatcttcaggaacggcatagccctagagatcctgcaaaacacctcataccttccggtcctggagggccaggctctgcggctgctctgtgatgctcccagcaacccccctgcacacctgagctggttccagggctcccctgccctgaacgccacccccatctccaataccgggatcttggagcttcgtcgagtaaggtctgcagaagaaggaggcttcacctgccgcgctcagcacccgctgggcttcctgcaaatttttctgaatctctcagtttactccctcccacagttgctgggcccctcctgctcctgggaggctgagggtctgcactgcagatgctcctttcgagcccggccggccccctccctgtgctggcggcttgaggagaagccgctggaggggaacagcagccagggctcattcaaggtcaactccagctcagctgggccctgggccaacagctccctgatcctccacggggggctcagctccgacctcaaagtcagctgcaaggcctggaacatctatgggtcccagagcggctctgtcctgctgctgcaagggagatcgaacctcgggacaggagtggttcctgcagcccttggtggtgctggtgtcatggccctgctctgtatctgtctgtgcctcatcttctttttaatagtgaaagcccgcaggaagcaagcagctgggagaccagagaaaatggatgatgaagaccccattatgggtaccatcacctcgggttccaggaagaagccctggccagacagccccggagatcaagcatctcctcctggggatgcccctcccttggaagaacaaaaggagctccattatgcctcccttagtttttctgagatgaagtcgagggagcctaaggaccaggaggccccaagcaccacggagtactcggagatcaagacaagcaagtgaggatttgcccagagttcagtcctggctggaggagccacagcctgtctgggggaaaggacaagtcagggaccacttgctgaagcacgaagagcccttgtggcaatgttaacattaactgatgtttaagtgctccaagcagagcagaaagaaaacagatgatggaattagagaggtgggctcaaatctaggccctggcactgtcatcaagcaattcactgcatccctctgtgcctcagtttcccattctgtaaatcagagatcatgcatgctacctcaaaggttgttgtgaacattaaagaaatcaacacatggaaatcaa

SEQ ID NO: 497344 - DNA, 478 bp, Homo sapiens
agcgtgaaaatatcttataaaatcttttaaatatatatataacttagcatacacaaaaatagaataatggtgaaatatgtaaaagtgtgaagcaattgcgagtcgaatattgatctcatgatagtgtagaaactttaggtgatgacttcagtattatggttaatcaagcacattttacagttgacatttatttacaggaattttaaggtcaaagcatgagcataactatattggaatgaacgcagcgcagttgctctgaaatgggtgcttccttatatgtgcctagaaataattctcatattagctctgacttctgtagagtaggcatggaactttacaacattcagctaggaagaaatagaatctaattatgtctggacacgcatgaaaaaaaaaagacaaaaagaaagaagggaaactagtagactatcaattcctaaaatgacaaaagcgggaatacacgtgggattaaaggatc

SEQ ID NO: 497345 - DNA, 236 bp, Homo sapiens
ggatgtagagtttgttctaaactttcttcctcctgtatgccagtggaagtgtgaatgcatagagaaaacagtgaagaggacagactctttattgcacttgattctaccttaaatgttaacagtcttaagggagtatttacgttgtgttttgatattgctgaaagaaaaaatagctttaaaatttctaaaaattgagatggagcccagtctggtcttgaagacctgagcaagccagg

SEQ ID NO: 497346 - DNA, 262 bp, Homo sapiens
tcaatctgcaagtacgcgtagtgatacgctattactttgagatccttagaagcattacctgtccatctccagcaccgtggtgcagtgcaggtacatccagaatcgcagccactgtacacagcagcagtggcacccacccttccatggctctgctcggtgcgagctcttgaagtgtctgtgcgatgcggcccacaggaaactgtagggcagctctctgtgaggctgagatactgccttagccgtggcgttcccattcccggat

SEQ ID NO: 497347 - DNA, 165 bp, Homo sapiens
aaagtgaattttgctccttttgaaatttaagcctttttcttttaaaagaccagtgtaatagacatctaaaattcccctcctcatagagcttttaaaatggtttccttggatataggccttaagaaatccctataaaatgccaataaagttactccaatctgtgga

SEQ ID NO: 497348 - DNA, 1084 bp, Homo sapiens
ggaacagaaacatagatgtggctcctctttctgcggcaggagttcatcccggatccagggctaatcgtgaaggagaccgggaagccatcgtggcaggttcgattgatgaggagcttcaatgaccatgtgatgctgttcacgcaaaccatgaagctcgtccaccgcgatgcacatcctcctggggctctctggggactgacacggtgtaatgtagcctcgcaatggaacttgtctacaacgaccgactacggcgtgctgcgtagcgtcctctccgggccgctcttccaaggtatgacacagcattgtaggatcctcgtggacccatctggatgttgggtcatgcccgtgtgaacttgactattagagcggggggtcgaaaacgtgctaatcatactttctcaatgtcctaattaccatctaaacattatgtccaccgggtggggcgaacagcacgtgctggcagggctgggtgctcagtctctctggtgggagaagtatgagcggacgatgctgataggagggttgtctttagactgtctacgcgcccttgtcacggccaggatacttctctgagtaagtcctgctcctcatgaccgcgtaggcgcattgatgatgacttggatgctccgacggtgatatggagattctgccgatagaccgtgggggcatgaccgagattgggaggtgcgaactggtctcagtgcttacagcatacagagtactccggggagaccccgggaggggctgatgctgggatagagacttgagcagggacgctggtttactagtaccacacgcctcagcggtgcaaggcgttactagacaaagcatatgaaggaatctgctcgactctaaagacaatatgtgggacagacctattgttactccgtgggggaatcgaacaggaacgccaatcgtagaccaagtgaaactcttaaaatcgacgtactaatatgtgtgatgtcgacagaattcgttccctacttaggaaaggtaagaacacaagcggttggggaggatggaaagggtcccaagggagccatggaggaaagacacgggtagcacgctattggagaggggcaca

SEQ ID NO: 497349 - DNA, 432 bp, Homo sapiens
tggtatagatggcctttttatctctctactggtctttccttgcctctgccagccgcttatgatgctgttctcttaactacgttggcggggcaagggggtataaaagcagctgtaactttctatgtatggaaactggtctgggtgccttggcttacgggttaccttgtgtcatacctttgaaacaagggacctgtccaggcttccttctgatgggcaacccacctctaatgctggccagtctatttcacacaaagttctaagttttcctggtgtcacagtaacactgtaatctcccttaaattctttcttgaatttttttttaacatagttcctagtggggtgggcttatttgtacctgacccatgcttcttcgagacaaaacaccacacccgcgccacacacatgccaaaaaaaaccccccaggtaaaaagg

SEQ ID NO: 497350 - DNA, 688 bp, Homo sapiens
  misc_feature (550)..(550): n is a, c, g, or t
gcataaattgttcacccctaaaataacacccctgctcgtcaggaatgggggctgatgtccagcctgtgccttgcatattaaaacatagcatgcctataatcctcccagaagtgtccctttaactgatacccacaaatgtcccatagtagccctgaatgaagaacctctgagacctctcttctgtgtcagtttagtgtatggtgtaatataagagtttgattttattcttttgcatatatatatgtatatcgtttcccaacaccattcattgaggaaactatcttttttcattgtttattattggcacctttgatgtgatttcaatcttcttaaatttgttaagacttgttttgtggcctaatatgtaacctatcctggagaatgttcaatgtgcccttgcaaagaatgttctgtatatgtctattagattcagttggtctatagtgttggtcatgtctgctatttctttattgatttttttttttggtatggataatatatccaatgttgaaagtgaggtattgaaattcctctgtttacactgttattntattgctgcctatttctcccttcagttctgataatgtttgttttatatatttgagtgttgtggtgttgggtgcatatttatttacagttatattcacttgatgaaatgatgcctttattgttacataatactcttctg

SEQ ID NO: 497351 - DNA, 996 bp, Homo sapiens
  misc_feature (996)..(996): n is a, c, g, or t
tgggaataacaaaattaaaccctctttttggtttaaaaaaaaaaaaaaaaaaaaaaaggaaaaaccccacaggaaaaaattttcccaccgggacccggggtccccccagaacccccccgcgtccggcaaagacaggccaccacgccactagtggggtggaattggggggtgccccatagaggaatgaacccttctatggagggcgctgcgccttgggggggaggagggcaccaggacaccaccattaatgggtggccggcggggcccaaaagtcactagtggcagcgcagccgcagagtcggcccgtttaaagagagggggaaaattcagaaagacaacttacgaaaagcacaagtaattcagagagcccgggggtgtgtagtgtggccccggcgtgccaacagcgagataactaataagaggcgagagcccccaccacagcgaggggcgccagcaccgcgactatagtggagacgcccctagggagggaggccgcgcccacttggggggttagaaaagcgcaccaatgagctacaacgccccttcgtaaacagtgaggcatcttctgcgaggcgcagtaagagtacgatctgtcccccacagacaaaatctccgtggaaaaacgacaccccctgtgagcccttagagcacgagagcgtcctgggacgaagaaccaaggctcccccccttatgtgtggcacacacgcacagaagtttaaagaggcgcccgagtctagaagactccactgaggagcactcaacctctgggctaccccaggggctgcccgcgcaccagaaagtacacttcagccaaagggggctacgcgaccactagagcagagaggatacaatcgccgtcgggggccaagaacccagcagggactacccccccgtgcggccggagtaaaaagtcgtgatgtccggaacaaagacgggaggtagcaagaactacccacaaggctgctccccccaagtgggggcgaaaccgtagagcgn

SEQ ID NO: 497352 - DNA, 442 bp, Homo sapiens
gcataaattgttcacccctaaaataacacccctgctcgtcaggaatgggggctgatgtccagcctgtgccttgcatattaaaacatagcatgcctataatcctcccagaagtgtccctttaactgatacccacaaatgtcccatagtagccctgaatgaagaacctctgagacctctcttctgtgtcagtttagtgtatggtgtaatataagagtttgattttattcttttgcatatatatatgtatatcgtttcccaacaccattcattgaggaaactatcttttttcattgtttattattggcacctttgatgtgatttcaatcttcttaaatttgttaagacttgttttgtggcctaatatgtaacctatcctggagaatgttcaatgtgcccttgcaaagaatgtgtattaaatggaatgttctgtatatgtctatta

SEQ ID NO: 497353 - DNA, 426 bp, Homo sapiens
ccagtgtgttccttccgaatctgcctccccgagcgagcttgcttcacgcgccatacgatctcggctgtaggtcctcggtagtgccttgcggtctcaggattcttcctaggccgtggtgtcctctctgttgcgtgcgaccctgactggattctggactgttcctgtcacgctggttgccacttccagagacctcgtaaaactcttgtccgaaggctctctgactgatcccttcccagatctcctcggcttagcaggtgaggactgacactgcccgatcacctcagaagcctacaagaccatcacagacgctctaagtaactctcacacagtagaaattaagtccatccccttcttaatacggaagctactcactccacattaccttattttcaaaggtaatgtgtagtgaggttccatcgcggggat

SEQ ID NO: 497354 - DNA, 198 bp, Homo sapiens
gaaatgtgtctcaataataataatagtaatggagaaaaagacacgtctcagggcacgagacagtattacctttaaaaatgctacctactggtcgaggctctggaactacttgtgtctttagatagggattttaaaactatcacttaaaatttttctaataagttgagaacttaataagtatgatgagacagcataata

SEQ ID NO: 497355 - DNA, 509 bp, Homo sapiens
  misc_feature (186)..(186): n is a, c, g, or t
  misc_feature (238)..(238): n is a, c, g, or t
  misc_feature (466)..(466): n is a, c, g, or t
actcttagaggatcccccacaccacctgagtcgatgggtttgccggcggcctgggcctcttcgatcattttgatcaagggccaggcgcgtttgcgcaggctgactggctcctcgacaaaaggcacggactcgcgttcatccaccattgcagacgacacctcatccgataaggcgttcaacatggcnagagcccgaggcatatcctccggctcaatgatgcccggctgctgggcgaccntacccaacaagccaagcagcttgttacccaaatcattcaaaagcagcaaatccgcagtaacgccacaccgcagcctaatcgtcatttaacgtccccgcgagcctcacttgtagataagtctacgctttcggatccagtggtcaatggcttaaagcgtgcggcctcaagcctgtcacgcatggcttcagccaggttctcgagcttcacggtgttataacccagtatttngtcacgcgcctagccaagttgatggcgactgttgcgtgactat

SEQ ID NO: 497356 - DNA, 375 bp, Homo sapiens
atccccattttccagagcgggaagccgacgctcaaccccgcgccgcgacttgcccgaggtcacccagtgggccagcggctccgggaccgaggcgcggggcgggttgaggccggcgctgcaggcagcggcggctgcgcggtgaacgaggcggcctgcgcggcggagtgctgagtcccgatccccggctctgtccggcccacggatcctcaagcccgggccccgggcccggccccagcctcagccctgagcgtctcggggcggatggcgcggggcggcgggggcgggcggtgctgagccctgcgcgggccatggcctcggcctgcggggcgccgggcccggggggcgccctgggcagccaggccccctcctggtacc

SEQ ID NO: 497357 - DNA, 970 bp, Homo sapiens
gggctcggagcgcgaaacatggcggggcaggacgctggtgcggccgtgggggacgatactcaagaggacgagggcgacagcagcgtgtccagggcgggtgtggaggtgtccgggaagctgaaggaccttaaatgccccttcctcgagggtctgtatatccacagaggccaaagacaattcaggaacttggctggttgcagccccctcagagtaccgttgtgagaatcctagaagtgatgttgtacccgggggtcttggccctcactgcagggcaccaggtttcagctcacttgagagggggtcccccaaccaaggagggtgaagatcccaagaaaatgaggaaagtttgggccacgagctgaatgccttggttttgcgcccagtattgacccagggagcctccttcaaggggttgtgcctgcgcccaagaaaggcagataacacttttcatggcccagtggcctcgataccaattcgggaggcctgacccattgtgtgtgggctccgagttggctcgaccctgatggagcaactttcggaggcaacccccaggggcagacggcaacgagcccttgcctgggggagctcttcatatagacccccaacttgaagatgctcctgaatccaaagttgggacccggtgccctgtggatttgcgagcccctcctcaaacaagcagagtggtgactggcagtgggccagtgcttctccaggtccgacgagaggaactgcggacttgccaggcagctgcaggacaatgctgccaattggcccgtataagggagactgcacgcgttccagggctgcgtggccacgacttagccctaacaaaacgctggtctcggccccgcatcttggtctccataccggggaggtgccgcacgcaccccgggccatagcgccaatgttcaacacgcgtgtgcggcactgcggccgaacagagtgtggccccacacgtatatcgcgagcc

SEQ ID NO: 497358 - DNA, 191 bp, Homo sapiens
ctgcctgagcctcctgaatagctaggacgataggcatgtgcccaccatgctcagctaattttaaaatttttctgtagagaccaggtttttctttgttgcccaggctggtctcaaactcccggcttcaagtgatcttctcgctttggccccacaaagtgttgggattacaggcatgagccattgcactccgg

SEQ ID NO: 497359 - DNA, 627 bp, Homo sapiens
gtacttgccacaggacagctcacccacggggcagtgggcaccatagagcgatcacctctgtccttatatgccagagtagagtacggcccagcaaaagggagaagatcagagaacgcagcagcagttttttttctggtttccttaccattttatcctttcagagttaaaagaaaatgggatcaggcacagaacactatgcatttggaaactggtccatgccgggattttttccaaatcatttttatctacagaatttaaacaaaaattagatgtcgggcacgggcggtgtgaaagaagatggttggcatatgggcggcacggcatcagtatcttactaaaattgtgaaaggaaaggactatggtacacggaaaggcttaattgtatctgaaagcacaaggtgatactcatttgaagggtcttcccatgggggcgggttttggcctcttggacatctggtcatcagtattgagagggtgagaagggaaggtaccaggtatacataccttttttaaaaacaataactttgctataatcacagttgttccagaggcctgtcagatacattctaatgaccagaagtggtttaccaaaagaaatacggcgtgggaaagaactttaaatgacct

SEQ ID NO: 497360 - DNA, 204 bp, Homo sapiens
  misc_feature (174)..(174): n is a, c, g, or t
cgggctcacatcattcaatactaacataaaagaacgacgggtcatgcgtaatcccagcacttgggaagccaggtgggtggatcacctgaggtcaggagtcgagacagctgacaacatggagaaaccccatctctactaaaaatacaaaagtagacaggcatggtggcgcatgcntgtaaatcccagctactcggggaggcacag

SEQ ID NO: 497361 - DNA, 458 bp, Homo sapiens
tgatgagaagggaatgcgttagaggatgcagctagaagaggagatatggcgctgtagaaaattataatgagcggtggggaatccggcgggggctaacaggcttagctgcagtacgccaaacgagggaactgcagcgggggctacccaacccggtgatgcgttaagataagggaaatgggcgaaggcactctgactgagaccaaactaaacgtgaatggtgccactaaacaaactggttgatggggccgctgaaacaatgaatatgcaagtgaacaatgcgaaaccgaaaggaggcctctgtagcggggcagctgtggcccgtacggaaataaaaacacattgatggtaaggggtaacgctaaataggagtacaagagaaaggatacaagctcacaaaggggacgcggtgttaagataaagggggggatggaaagcaatgcttataacgagaccagcgg

SEQ ID NO: 497362 - DNA, 428 bp, Homo sapiens
  misc_feature (19)..(19): n is a, c, g, or t
  misc_feature (21)..(21): n is a, c, g, or t
  misc_feature (23)..(25): n is a, c, g, or t
agagaactagtctcgaggncngnnnaaaaaaaaaaaataaggccagttaaagaaaatgtaacgtgtgctttcagtggcactgggatgagtacaattgttgtttctttgcttggagaagcgttaaaacatttttattcgagtctataattggaagagagtttcttgtgattgggcttgtgacagtcacatttagagtttacttttaaccacagcaattgcgatttgtgtacaaatgaaaaatcctttggtgctttaatggcgcaaagacttgtacggtgaattcagctgtcccgaatacatgtggagagcattttttctaagggctctttcagggtctgggttaatatttacgtgaggtattgagctgttctaaggttgcaaaagaggattatcgtttgtggactatataaatgaagagtgctgtcatt

SEQ ID NO: 497363 - DNA, 410 bp, Homo sapiens
  misc_feature (16)..(16): n is a, c, g, or t
  misc_feature (73)..(73): n is a, c, g, or t
  misc_feature (146)..(146): n is a, c, g, or t
  misc_feature (149)..(152): n is a, c, g, or t
  misc_feature (156)..(158): n is a, c, g, or t
  misc_feature (168)..(168): n is a, c, g, or t
  misc_feature (173)..(174): n is a, c, g, or t
  misc_feature (180)..(180): n is a, c, g, or t
  misc_feature (187)..(187): n is a, c, g, or t
  misc_feature (193)..(193): n is a, c, g, or t
  misc_feature (196)..(196): n is a, c, g, or t
  misc_feature (201)..(201): n is a, c, g, or t
  misc_feature (259)..(259): n is a, c, g, or t
  misc_feature (270)..(270): n is a, c, g, or t
  misc_feature (284)..(284): n is a, c, g, or t
  misc_feature (295)..(295): n is a, c, g, or t
  misc_feature (299)..(299): n is a, c, g, or t
  misc_feature (325)..(325): n is a, c, g, or t
  misc_feature (332)..(332): n is a, c, g, or t
  misc_feature (343)..(343): n is a, c, g, or t
  misc_feature (346)..(346): n is a, c, g, or t
  misc_feature (362)..(362): n is a, c, g, or t
  misc_feature (367)..(368): n is a, c, g, or t
  misc_feature (370)..(370): n is a, c, g, or t
  misc_feature (374)..(374): n is a, c, g, or t
  misc_feature (396)..(396): n is a, c, g, or t
accattcttctagggnagggacccacatatacgatccttccccaagaactttgtatgcgaccccgctgaagantttaagcacaaaacacagtgcttgtatcatataagtgagggctttcataggggaaaactgtaatataaatgcnttnnnngggnnnggcgttgganggggnnggcaanagaaatntattangcntgagnctcaaatatccaacattttcctatcttacattttaaaccaaagttaaaagaacctacnggctttatgangggctctcttcgcngcgcacgcggngcgngcactttcaaccaacacacgctcccnttgtgcnatatccttagncgnccacataatatacagntacanncnccgngtcggttcggcatcaggcattnttcaatctcacctt

SEQ ID NO: 497364 - DNA, 395 bp, Homo sapiens
cagctcccaaaatttttaggctgaattataaaacttggggagggttttaataggtttggccaaaaggaaactcttatttctatttttccaaaaatttaggattttgtttcggggccctaatatgtaaaacaaaaagctcctttttggggcctccgggaaaattcccggccactcatattttcatgcggttcatgaaaaattcaaggcccccgaatttaaaaagcttttttttttgaaccaaaaaagttgatttttccagggcgggggcaaaaattttaaatgtgacccgttgggttttaagcccagggaccaagttatttttaatttggttttccccttggaaccaagcccgtccttcaaaaataattcaaatgtttataaccccacctggtgta

SEQ ID NO: 497365 - DNA, 492 bp, Homo sapiens
aaattctctcccactgtgttctaaatgtgccaggatgttcaatagaaaatgtcacaaccctgtgctctgtcaactctaaaaccctctcctctccccaagtcaaggcttcagaggaaataaaaaagtatcactgcttatacaggctgtactgagtttatcacatccattatctttctgacttctgtccttgggattccagttggtcttgaccttgtatagctgccctcacagtatctttgtcagtttatgcatactacttctattatttctctttctcaaatcaatttcattgggtatgttagaaatatgcagaaattctagaaatgaatgtatatgtaaaaagatattaacaaatatggaaaaaagaaatatataacatatatactactctcaagatggtatcaatcctcaagatctcattttcttattaggtccttattgaacttcacttcttagttataaaagtcccttaaaaaaaaaaatcagaccaaa

SEQ ID NO: 497366 - DNA, 596 bp, Homo sapiens
  misc_feature (2)..(3): n is a, c, g, or t
  misc_feature (6)..(7): n is a, c, g, or t
  misc_feature (12)..(12): n is a, c, g, or t
  misc_feature (71)..(71): n is a, c, g, or t
  misc_feature (166)..(166): n is a, c, g, or t
  misc_feature (418)..(418): n is a, c, g, or t
gnnggnnggggntcgccttatggaatggtctcgtcaaaactggcaggttttcctggctgaatcagaacagnctgggtcttgtttcattcaatactcccttggaagccaagcatctctctagggaatgccatctgcagtggacatcaggtatctcaatgccctcttngcaaccatgcaaatatcctggttccatttctatatctcaagagactctgctctttcttcagatgagaaaaatcatgataaatgctagtctttgagaagtctgccttgctgttcctcttccagggaacagttcagttctagccagaacaaatgattcctggagcttcatccagttcagactgcttctatacctagttccagagccaatttataaattcaagacttcccttcctcaactgtacctgaatgtctnaattcacttctagatgtttccttgatcaacaacagcaccaagagcccctcacacagtactcccaggtacactacctcaatcaccaccactgttatcccatcacacagtactcccagcttcacttcttcaatcaccaccaccgagagcccctcaagcagtactcccagcttcacttctt

SEQ ID NO: 497367 - DNA, 86 bp, Homo sapiens
gggcagagccccttaaagctgctgtcactagatgcccatggtccaggcctggtgggcgtgagaggataggtggcagggcagaaact

SEQ ID NO: 497368 - DNA, 314 bp, Homo sapiens
gccatagatggtgtgctgcgtactagctctctctccatcggatcatatatctaccttacacagactcagaaaggtctcacagtatcactcctatgcaatcagtgataattcagcttatcttactgacttactatagcatctaaatatctatacatactttctcttgaagattttattcccttgattgtcctgttctgatgtccccggcccgggttacaggccggtctcagtctcctctggcttctctagtagatattgttaggccggattccattattctcaatggtccctttctttctggcacagtccttggg

SEQ ID NO: 497369 - DNA, 120 bp, Homo sapiens
aagatagagacaggtttctccatgtttgctcaggctggtctcaaacctcctagacctatgttgatcctgccttgcctcgtgcctcccaaacagtagctgggcattcaccagtgcgttgag

SEQ ID NO: 497370 - DNA, 363 bp, Homo sapiens
agcagcggagaggggacggagaaggggcagggagagaccacgccataggacaccaccagccaatggaaacttagtacaagtttggaccgcaatagcatcctgacaggcttctatcttctttggataatttctggtccatagtacaggattcttaacatggaacacgctaaaacagacagacctaaagccaggtctaacagaaagggcaagcctcctgagacatcctccgaagactcctgagcgcgaactgtgcaagcaaagccccacatggatattatcaggagtgtcgtgttcacggccacttctcattacaaaggagaaggtgactgtatctccttccaacttcaccaagtctccggccta

SEQ ID NO: 497371 - DNA, 937 bp, Homo sapiens
  misc_feature (16)..(16): n is a, c, g, or t
  misc_feature (61)..(61): n is a, c, g, or t
  misc_feature (91)..(91): n is a, c, g, or t
  misc_feature (93)..(93): n is a, c, g, or t
  misc_feature (102)..(102): n is a, c, g, or t
  misc_feature (164)..(164): n is a, c, g, or t
  misc_feature (202)..(202): n is a, c, g, or t
  misc_feature (209)..(209): n is a, c, g, or t
  misc_feature (219)..(219): n is a, c, g, or t
  misc_feature (231)..(231): n is a, c, g, or t
  misc_feature (265)..(265): n is a, c, g, or t
  misc_feature (271)..(271): n is a, c, g, or t
  misc_feature (283)..(283): n is a, c, g, or t
  misc_feature (300)..(300): n is a, c, g, or t
  misc_feature (322)..(322): n is a, c, g, or t
  misc_feature (326)..(326): n is a, c, g, or t
  misc_feature (354)..(355): n is a, c, g, or t
  misc_feature (360)..(360): n is a, c, g, or t
  misc_feature (366)..(366): n is a, c, g, or t
  misc_feature (369)..(369): n is a, c, g, or t
  misc_feature (391)..(391): n is a, c, g, or t
  misc_feature (393)..(393): n is a, c, g, or t
  misc_feature (698)..(698): n is a, c, g, or t
  misc_feature (869)..(869): n is a, c, g, or t
  misc_feature (876)..(876): n is a, c, g, or t
  misc_feature (926)..(926): n is a, c, g, or t
ataatattggtaaggngccaattacagaataccctagaatgtggaatacaaaatctcaganacaaaataaaaactcatgaaaatataagancnctttaaaanggtaataatctttaggataaagacagccttttctcaacacaggtactgggcatgtttaatanaaattaaatgagattaaagagagggggcacagccacangctcccngccccggggngattaggggggngatgtttgtgtaggtgagagcgtggggccagggngcaggngggctccgggcnccaacagtgctgcggtnggctgtctccacgtgggtgggntttntcacaatccactcacggggtagggattnnttttntctccngtngcggaggggccttgtgcatggncngcgttggcatgcggggggggggcaacacatccatgttgggggcccctcccatccacagccccagctgccaccacggcagggcatgggctttgggggcaacaaggggggacaggctgtctcctctaggaacaactcattattcagctaaacgaaatggaagagctccatgtgaccaacaaacccaaattgagccaaaacaacaggcgtccccaccccccagagggataatgtgccaccaccctgtgtgcagtgggagagcaggaatggaggaaatattcctggttcagttacactcctcgtctgtnaggacagatgtgccaccctatctcggattccgggagggtggctgggggtttccctcaactctgcagcaaatacttcaatgctactgtcatttgaggcctaattttcttccaagggcactatatgccatgcttcacttgggccagatgttcagatcagtgtgtctgctcgtncccattnagaacacaaacacaattatttatttgtccttccagcacatgtagcagtgnagagaggctgc

SEQ ID NO: 497372 - DNA, 105 bp, Homo sapiens
gtaagtggatcggtgggtttatctcaaggcctgagtagccggtaccaaacgagggttcccgggattggcccccggaagccatggtaggtccagatcccgtggagg

SEQ ID NO: 497373 - DNA, 322 bp, Homo sapiens
tcaagcaattctcctgcctcagctactcgggaggctgaggaggagaatcctgtgaatccgggaggtggaggctgcagtgagccgagattctgccactgcactccagcctgggagacaagagcaagactccgtctcaaacaaacaaaaaaacacccatatctcaaacgagaaaatgcttgcaaataacctgaaaccgcggaacactattctttttaaaacgagatattttaagtaggtcgtgaaagtggccttaatgttatactgccttattccagtgacgaatattcatcatgtgtaaaatgggagaaatgaaatgttatta

SEQ ID NO: 497374 - DNA, 425 bp, Homo sapiens
tgtcccccagctgtcaaagcgttaccccccaggggcggccccctaatgcccggaagttcctgggtgcttccccgggaaccccaaaccccgggattcctaggggggggccctttcctcccctttttccccccccaaagccccagccctttgctcctgcccccccccgcatgttttttttgttgttggggccgggccccctcctttttgggcccaagggggccccctccccccccccctgggccctatggaaggggttttttggccaggccccccttttccagaggggggccagggtttggggttccctttttttttttttttttgggggccccctagggccccggttgggggggggaaggtgggggcttcggggggggctttaatgggccccgggtttttgggtaataattttcctggggtttgta

SEQ ID NO: 497375 - DNA, 109 bp, Homo sapiens
gtggggttacttagaggaccccggtagagcggtctgtcagtgagtgggttaacgatccagcgttgtcgtgagctgtggtgtaggttgcagacgtggctcggatcctgtg

SEQ ID NO: 497376 - DNA, 374 bp, Homo sapiens
agctcgaaaaggggaaacaaagtacgaatgctaactcacttgatgtgtcagttattttgctctgggacttccgaacaagaactctgctctcaagtctggtgtacctctgataacacagtgaaggccaggggtctacagaaccacagacccatcatcaaaggccccgggtagactaagatctgaatagctttacttccaaagtcaatctcattcttcagggcgtatagttaacagcttgtagcagtctataggtaatcttcttattctttcataatcttatacaccatcacagagaaacatggaagcagactagtcagagaaagctaattctgaccaacttgatactatatgaaaataagcaaaaagctatagca

SEQ ID NO: 497377 - DNA, 838 bp, Homo sapiens
gcgacacgcgggctatcctcggggccgtgctccacgagggctggccgtgggaaacaaccggacgcttggtggccccagagtccgcgggccgcccccagttggaggttccaaactgggaaagggccacgcaaaggtgacaagcggcagcgaaaggaccccctccgaaaacaaatatagcgggtgtcgcagcccactagtggtggtcgcaagaagcacgcccccaaggggccgagtgcccccacagcgggcccggaaaacctggggggcaccgcgcgacaccaacgttttccagtttgtggagagccatgggaacacacgggttccccaagaggtttatcctgaacccgcccccttcccgccgatatatgcgcccccttctgaggaggagagccccatccagagaccccaccgcaccctggttggggttcgtggaacaaccagccccaggccacccaagagcccacctgtgaaactctgttattggaagatgtttcccacacgcttcttgttagagaaattctgcacaaggcctgcgccgcataaagaggacctcgctcttcccgaaggaagggttaaaaaaaacttttgctccaattcccaactgccctatgggactatacactcacccactttaaagccactcctcacgcctctaccactgaagggatatataagaaaacaaaatgaaagaatctacaacacttatattcaatctgtttttctttttcgcttggtgtaaacccaccacccccgtctttaaaaaaccataattttcttaaatcacttttgcctcttttttttttgttccaataaaaaaaaaagggaaaaaacccaaaaa

SEQ ID NO: 497378 - DNA, 742 bp, Homo sapiens
  misc_feature (51)..(51): n is a, c, g, or t
  misc_feature (99)..(99): n is a, c, g, or t
ctggtggacttgaatctggtacggatcaataccatatgaccagacccagcncaagcatctgcttggttgctacattctgtttgatgggtcctggtggcntcctctgaccatattagggggtcctcttctcatcagactgcatggtacacagctggcatttgggaggcctctccccttgtggcccatgtgtgcgccccagtgagaaagtttctgaacctggggcacccctgggagatgggcctgggtctcgtctttgtgtcctccatgggatctatgtttcttcccacctgacccccgtggctggtgcccactctttactccagtggccatgtacggtggattagttcttttcagcatgttccttctgtatgataccccgaagtatccagcgtgcagaagtatcacccatgtatggagttccaaaatatgatccccttactcgatgctgagtatctacatggatacccattaaatatatttatgcgagttgcccactatgctggccactggaggccaccagaaagaaatgaagtgactccagcttctggcttctctgctaccatccaaatatcttgtttaatggggcagatatgcattaaatagtttgtaccagcagctttcgttgaagtttagaagataagaaacatgtcatcatatttaaatgttccggtaatgtgatgcctcaggtctgccttttttttctggagaattaatgccgtaatcctctccccaataagcccca

SEQ ID NO: 497379 - DNA, 200 bp, Homo sapiens
tagctaggctcaggattttgataattctaggggagtgcgagtgagtagtacactgtccggcgtgccaaaaggggtcgggattggaaaaccctggggggagtaggggaagggagcctactagggtgtagaataggaagtatgtgcctagcgttcaggcgttctaggctggttgcctcatcgggtgacaaatagactagaaa

SEQ ID NO: 497380 - DNA, 232 bp, Homo sapiens
gttgtatctgtggtgattcttagaggatcccggcgtatcacattatcccaatctcacagcagcgaaagctgcagttcagatttgagatcaagtctccattcacttgcacgtaggcaccacaggcaagagtgtaccggaggcagagagctcttgtatgggtcagcgtttctaagtaagcatgtcaaggtgaaaaagaaccctctagcagtgcactgatttgataatgtgataa

SEQ ID NO: 497381 - DNA, 91 bp, Homo sapiens
  misc_feature (30)..(30): n is a, c, g, or t
  misc_feature (53)..(53): n is a, c, g, or t
tttgagtagaaataagtcatttctttaatncatcaaactgtgggatttcttgnccttgcttctctcctggtcctggcttccccagaggatc

SEQ ID NO: 497382 - DNA, 1171 bp, Homo sapiens
ggtctcgagtttttctttcttctttcttttagcttctagaacctttatttctctgtgaaaagggggaaaataaagggaataaaactaaaaaggggacagttgacacacaaaaaaaaaccaatgatggggaggacggagaggtgtgaagaagtcaactggggagaggggattcccatttacagcagcaggatccatttgacccgggatgcatcacatagtctccctgaccgtgggcggagaagccccatacctcccaggggtcacgggaccgggtccaaccccgggactccccatagacccgatgaggagaggtgtggaacaggtgagaacattattcacaaggacgtgggagacgaaggaggaaccgagagaccttgagaggagaaacagggggcccgagcgggcatcaccagacaaccacacatggacaccagaggggagcaagtgtcgtaagacggacccacaaagcgacaccacacaaaaagagtgtttaattcacacacaaaagagagaagaggagcaatcactagacagagcagagacgacaacaagcacagagacgatgtgcaaccaacacacagaagacaaggcgcacccacaaggaggaaaagcggcagcacacacaataaagaaacaacaaggccaaaagaaagagacagaaaagaaagaacaaaggaaagaacgaaacagaccgagacgaacacaacacacgtgagtagacaagtagagacaaatataggagaacgcaacctcaccaacagaaatccacacgagagagaacaaaaaatggggagacccaccacagagcaatccaacagacacaaacgacgcaggaaaagaagacagcgagaaaaaaacaagcaaacaacaaaccacacaaacaccccacactcggacacacaaagctaagtagcaggctagaagagataaacgatccaccccaaaagccgacaatattagagacggaacacataacaagaagacagatcaaccaagcagcacaaagcaaacaaaagccacaccgatagaggcgacacacgcacacgatagaagcacgagagagcgaggagacaccacattcttgagaacaacaacaacacacaggaggaagactccacacacaaacgaacagaaacgaacaacaagtaggaaccgagcaaaagcagaaaaa

SEQ ID NO: 497383 - DNA, 189 bp, Homo sapiens
gagtattaagatcggtggtcttgagaggggatggaggtgtctggatacctcggctggatgtgcatgtcactcagctaatgggataatggggatgagttcaattcagtctggagtgcgtctgatagtctggttggtgaataaggcagtaaccggcggaagtctggggcgtggttcaggactacgtcacat

SEQ ID NO: 497384 - DNA, 652 bp, Homo sapiens
ctggcctctgtcttagctgtcattttggcggtttttttgtttttttattcttcaggggatttcagtctccacatagttatgggggcgggacttttgaggaatgatccgggaatccggaagtgggctgcccagcgtcatgcacggcgatactaagtggagcagagccagtggagttcttacgggtgccccaggagctcaacttcctagggcatcctcaagaccgtgaagattacttatataggtgccactcctcgtgcgagaaacgatatagaatgcggtcaggaagcagagtctcatttatactcgcgtgatttccaccttcgagaggaaaaatttccccaggtggttcgcagttttgccgggaagagtgtttgaccctcaaagagggtgggcattccgttcgtggcaataaacaggtgggaccttgtattatagcttaaaacttccgcttatattaagattcttcgctatatagataactcgtccaaaggaggttatatcttaaaagacgtttcttaaaatggcgtttaaaattgtgtgtgcgcttagaagaacggcacaaaaagtggactttggctggtggagaactgtgtgggacgaaaggatgtgtcaacacatccaaagggggatttttccaaaagtctccctgagg

SEQ ID NO: 497385 - DNA, 367 bp, Homo sapiens
ccgatcgtcgacacgtacacattctcgctcgctcacacactattaaccgatggcagatcacttcccagtcctacacactgacacggacccatagagcatctagcccctccttggctctgcctgtgatgtggtaggactaccgtggggtacgtgtccaggccacgtggtctggacacttaggtgaacatccaggtagatggctgcagctgatcgtatgtattcctgtaactggagccgcgctagaaccgaccccgtcatccgccattgctataaggactcccctaggatcctcgagtctctcgccagggtgcgatcctcgtctgcagctcacatactttgtaggggcctggctgcacccacacagctt

SEQ ID NO: 497386 - DNA, 275 bp, Homo sapiens
atctcatacacggatcccgttatgctacgcagaatattattgaggatgtaagcccgtgggcaattatcagaattactgcacctggtcaagcttcagcgtggtttggataataatggctgttacataccagggctatgtggctaattgcacagagtatgcaatgagcgattttaggtctgtttgtcgtagagcagatggacgccttgtttctcattttgcctcatcgtgtgattctacaaggttagggcgtcggtctattgtgttttgttctgcgg

SEQ ID NO: 497387 - DNA, 776 bp, Homo sapiens
ggagactcaggaagagagttctgcaggtcactccctggcttctggaggaaagagaaggagggcagtgctccagtggtacagaagtgagacgtaatggaatcaggcttcagctccaaggagacctatctaagcgattatatccctcgggatttagctagaagaaatattgcaagtaggttctaggccagtctgcagaagagcccagattcttgaagcggcttctgaaacaaatcttttcaagatattctgcctagacggtgtgaaggggagatctgctgattgacatcggctctggccccactatcgtatcatgcgtcctctctgcttgtgaatccatttagatggagatcgtcgtcactgactactcagaccagaacctgcaggagctggagaagtggctgaagaaagagccagaggcctttgactggtccccagtggtgacctatgtgtgtgatcttgaagggaacagagtcgagggtccagagaaggaggagaagtggagacaggggagtcgagctggtgctgaagtgtgatcgtgacttcagaagccagacagttgggggccgtgcacccttaccctctggctgatttgcgtgctcatgaggactgtgtttcggatgccacgactgaccagaactccccacctactggagggcagctcaaggaaactcggaagcgtagtgaaggccaagagggtgccgggtgatcattggatgtgtcaagagcatgtactaaatgataggtgagccgaagttttcaggctcccttgggcagga

SEQ ID NO: 497388 - DNA, 1443 bp, Homo sapiens
  misc_feature (960)..(960): n is a, c, g, or t
  misc_feature (1173)..(1173): n is a, c, g, or t
ttaccaacagcggggtgaatcaatgctctttatgttgaccccactttatggggccgcttaattcattattagggggggctagcacacaaccgtattgatattggaagaagaacaaacagggtgtgtgtgtgttgacaccgaacaaaaaaacgacacaagagcgtgctgggtgggtacacagccggggttctcccgcgagaaatggttttctcccgcggggaagaagaccccttcttcttggggggggagttgtctttctaacacacacaaaacgaggggggaccacaccacaccccacacgaaggagggccgcaaatttttttgttgggggggggcgccaactataatcaccaaaagggaagtttgtcttgttccttggaagagtgtttgtgggcgccccctttgttctttcccctctgtgtgtgagacaaaaacccgggggacgacagaaagtatttggttcttctgtcgggagttctctcctcgcacgaagttttgtaacccccgctttccacaacgcgcctcatgctggaggagaaaaccaccccctgcggggttggtttgtgccgcaaaaaaaaaacacgagttgtgtctccacgaaggatttgatgagagccgccaaaccttctctagagaagatggtgggttgtttctcttttgtgtggctcccccgcgattttgtttctggccccccatacacaggccgagagcgcttacacccccggattcgcatcgtggatgtctctccctcgttgggacttggggggacaaaaaaacacttggggctctaaacagaggtttatggaggacacctgtgcgttaaacatgccacagacttggtgatagagacccccacccaccatatggcgccgcacaaacacagagcgttattctcttgaaaacacacaggggtggacactggtctttcttctcccagagatgtggattcacccctcttgntgcgctttctctgtggagaccacacagagaattgtgcccccaggccccacagtttatgggagttctctcaacgaaggcgcaaacaaacacctgttacacacagcgtagaatgtgtgtgggacaatctatctaacacgccacctgtgtgcgctgttagcaccctatacccgcgctatctctggcgctgttggtggctgcccacacaggcgcccncagcgcatctaagaaatctcgggatattgagaaggggaagaatacattgtagatagaactgtagacaagaagatttatccagtgacccagccagcaaggccaggacccacccccgtgcgacactctccctggcctggtttcgctgataggcaccagacatgctgtttgctgggtaacacgggcaaaactggtggcgcagtgtggcaggggaccaatggcacacgctagaagtttttggcagagctttacaaaaaaaaaaaaaactggcca

SEQ ID NO: 497389 - DNA, 224 bp, Homo sapiens
accgtacgttgtactcccaggtcaggttgtactggattataccaatacccagctacgcaaaatcttagcataatcctcaattacccacataggatgaataatagcaattctacagtacaagctgccggtgtagtaccacctgccggtgggagttacaagctgccggtagagtacaaactgaccggtgaagtacatgctgtccgtgtcggtacatccgccattgg

SEQ ID NO: 497390 - DNA, 898 bp, Homo sapiens
  misc_feature (72)..(72): n is a, c, g, or t
  misc_feature (108)..(108): n is a, c, g, or t
  misc_feature (110)..(110): n is a, c, g, or t
  misc_feature (120)..(120): n is a, c, g, or t
  misc_feature (139)..(139): n is a, c, g, or t
  misc_feature (141)..(141): n is a, c, g, or t
  misc_feature (178)..(179): n is a, c, g, or t
  misc_feature (193)..(194): n is a, c, g, or t
  misc_feature (202)..(203): n is a, c, g, or t
  misc_feature (213)..(213): n is a, c, g, or t
  misc_feature (222)..(222): n is a, c, g, or t
  misc_feature (228)..(228): n is a, c, g, or t
  misc_feature (231)..(232): n is a, c, g, or t
  misc_feature (238)..(239): n is a, c, g, or t
  misc_feature (248)..(248): n is a, c, g, or t
  misc_feature (263)..(263): n is a, c, g, or t
  misc_feature (310)..(310): n is a, c, g, or t
  misc_feature (320)..(321): n is a, c, g, or t
  misc_feature (343)..(343): n is a, c, g, or t
  misc_feature (352)..(352): n is a, c, g, or t
  misc_feature (354)..(355): n is a, c, g, or t
  misc_feature (359)..(360): n is a, c, g, or t
  misc_feature (367)..(367): n is a, c, g, or t
  misc_feature (370)..(370): n is a, c, g, or t
  misc_feature (373)..(373): n is a, c, g, or t
  misc_feature (383)..(383): n is a, c, g, or t
  misc_feature (392)..(392): n is a, c, g, or t
  misc_feature (419)..(419): n is a, c, g, or t
  misc_feature (421)..(421): n is a, c, g, or t
  misc_feature (453)..(453): n is a, c, g, or t
  misc_feature (526)..(526): n is a, c, g, or t
  misc_feature (540)..(540): n is a, c, g, or t
  misc_feature (596)..(596): n is a, c, g, or t
  misc_feature (657)..(657): n is a, c, g, or t
  misc_feature (687)..(687): n is a, c, g, or t
  misc_feature (772)..(772): n is a, c, g, or t
  misc_feature (791)..(791): n is a, c, g, or t
  misc_feature (822)..(822): n is a, c, g, or t
  misc_feature (888)..(888): n is a, c, g, or t
ttccttactttatcaaatttataataattaaatattaatcttatattacaaaatttttcattcattataacnaatttccaataatcctttcaattatatttctaaatntncccccaaatnctaagcagattatttaaangnggcaatttaacttatgcacgcttaactatcttaacannctttgattgcaagnnattgaagnnttcaaatctnaccaagatnttgatnttnnataatnnaattctctnctccccacctctaanttgccatccctgctagtcctacctgtggagcaacctgctcattaacntcaaacttgnntacatcattcaaattagatttntaaataatncnntccnntttaacnttnttntaaccccacnttttttgcntaaattttaattttttaagcttttcantnttaaaaagcaatcaatcagatttttgatttcntccattccaatttctgtgctccttcaaacctcccattgattgcttgctttaccttgtcttcgatacccacttnaactattctttgtngctgttgacaaaagtcacattgtgttcacactggcaatgcataactccatcttttntcagtggggggttgaattcagttgtagtacaaagtagatagaaaagaccagttctttgctngaaagacaagtctggaatgctccacttttntcaattctctctccatttcttcagtaagtcaacttcaatgtcggatggatgaaacccagacacatagcaattcaggaaatttgantttccattctcaaaaaaangacgtgagttaacctgaatctttggagtacnctgggatatcctccaggccagaaatagagagtagcgcgacacagctaaggccacggagcgagaaanctcggcccga

SEQ ID NO: 497391 - DNA, 139 bp, Homo sapiens
tctcctacaccgccaccatgccattcggtaacacccacaccacgttcaggctgattacagcctaggaggagtaccccgccctcagcaaccataaccacccacatggccagggtccttacccttggacctctacaggagg

SEQ ID NO: 497392 - DNA, 1005 bp, Homo sapiens
caggagagcaaactataagatcaagtaaggcaataccagatgtctagtgatcagaacgcctgaaactatcaagccttgcttcaagccttcccatgtcagaggaatcttatgacatgcgaccgattacatcccatcgctcatccacatgattagtaccatcgaggaaatgtagttcgtgcaagtaacccttatgctactagtattctgctcagtgtcctgtaatactgagaaaactgctatactcctgggacagatctcaactactcagatgactatgagcgagatcgtcgaaccactatgccggtctaatctcgtgcaggtcaactccgaaactgtattggacctaccttcgctttcggttgcatagtaggccaggtatgaaacctgaaagtgcgtttaattgcacgacatccgatgctccaagtcagagagcacggagttcttgattcgtgcagcttacaggggtgtgaagtcaatcatagccatgcgcaaggccctagggtacacttcacttcttatcccaatttctaatgcttgcaagctaccaaatggccaggccttgagtactctacgttcttctacaatagccaatattccaagcaacagcaggtgagccaagcatctcgaaacgaggagttattgcagcatatactattctgtggtcacgaatccagtagcaggcctggtagcccagatccagcttttggtgtccacaggtcagactaaccagatgattgccgatgagttagccagatgagccaggaaccatcagttacagtcggaggaagcgtagtgttcgatgggagcgctcgaaaactttgcttgcccaggaagagcattaccttctggaagaagcccttgctaacaagggtccagtactcggtccccagaataaaagcgggtaaagggaaacgcggatgatacgatcccgcgaaaagagctgtataggcagtaacccggggcaagagggaaggtgtggcatctcttcccagagcgtacattgga

SEQ ID NO: 497393 - DNA, 161 bp, Homo sapiens
gccctgtggttactgccaaacacgtcagctgccgcgccatactggggctgcgggatccacgcccctgttcaaggctgcccatgctcgcagtactctgctcgaaccctggagccggacggaagaattaccaccagaggcaaggggactcctctagaagtcga

SEQ ID NO: 497394 - DNA, 157 bp, Homo sapiens
cttatgatgcacttggccccacactgactcagcggaagcaggccctgagggcgagaccggtgtcagaggctgggtccagcaggagctgctgctgggaaggccctggggcgccctgaaaggggtgggtgtgacagaccagaagagagggagagagagc

SEQ ID NO: 497395 - DNA, 974 bp, Homo sapiens
  misc_feature (500)..(500): n is a, c, g, or t
gcttgtgcgcaagcgggttggtcgccagcaacacaggtgtcgtgagacagtacacccttgaaaagccgagatatgggtaaaggaaaatgactcgagtagtcagacattgtcagtcagttgcgacgactgtaggattcagggcgataggtccgacacactacatgggctcgatcatgagtcttatagaatgcaggtgtgctagtcgagtgaataggaatccagttgacaagaagtctttgacgaaaggcaggcattgctcgacgcattgggcaaaccgggctcacttcaagagtaatgccgtgggggtcattggactaacacttgagaatggcttgagccgatgaacacgtggttatcaaccacttgtgagtatcttcctatggtggaaaggtttgggagacgcgagcaaagtcactcatgtggagctatccagttgatgccccaaggactacatgagcacgtttatcataacagaacattgcattaacgagtggtaccantctcaagtgcatgcaacttgtgcctcgtccatgtattagtctgctggctcggttgttcggatgaaatttcgataggctggtagtctcgcaaggaaatgggcagagacctgaagtagcattgccactgtacttggctttacaagcacgtgtggtgtgataaacaaaggtaacttgggtgcgagatgttgacataaatggatttccaactgaagccaccgcatatcagaccatgaacgagcatagtgagggaagactctgtgaacggaaggtcagcaccttacagttgacgaacaattgggtacatagcccgtagcacagtagccattgggtgccaagttcctgggtcggacactggtgaccaacatgtcgtggaagccaaagtggctaggcattgccgtagagttccaagggggatgggacatagtcacgcggtaacaggaatgtggcaatgccacagtgtgaacgaagcctgct

SEQ ID NO: 497396 - DNA, 1069 bp, Homo sapiens
  misc_feature (840)..(840): n is a, c, g, or t
tgtaaggactaagtggtcctcatgaattgcattaagagtgtgtactgctcatattacactccatcctctctgttagttgctgaggtgggaggatggttgggccccggaggtagaggttgcagtgagctgagattgtgccactgtattccatcctgggcaacagagccagaccctgcctcaaaaaaaaaaaaaagaacaaagaaaaagggggcgctgggcgcggggggggctttaacaccttgtaattcccagaattgggggagggccagagggaagggcgaggactaacttggggggcctggagtgttggggaacacaggctgtgagcacaacaagagaaagacccttaattcgtcttaattataattttccaaaaaaaaacttttagggaggttttttaacgaaggtttcgggacttgtcacacactatacttggggaaggtttctcaaaaaaattattggatttgtgtggaagtttgcaggtctatgtggagtgaaaattttctaggggtgtggaacacgtggttatagaaaggagttcttatatttcctataaaaaaagggggtttttctcggggaaaggacggatttttttaaaaattgtaggggatagtgttattattagacgcatttgggcattaacttcgggggtgttaacaggggtggggtaacacaaatttaattaaccactttggtttgaaatcccaaggagttcggagcatattggggtgggccggacatgggaagggtacatacggtcgcccagtttaactgattcaaagaaaattcttgtgcttgtgttctaaagggggccggtgattggccgagaaagtaacgggnctcggctctggatgtggtttaaccggggggtataagaatacctgtgttaactagaaaacaaagtgggcgcgtaaatctcagggccattgcacacacgttgtaaggccaatggggtatagagaggggggaacagggaggaaagactgggtatggacaatgggatgaaaccagaaaacgaataagttgtacgttatcgtattattaaacgaggtagtatgagtttgagata

SEQ ID NO: 497397 - DNA, 406 bp, Homo sapiens
cccacgtcgacacgttagacaagagatctatcatggactctgcacttcggtaacataggtagatcgttccatctcggccttttctagtaccatatccaaatgttctcgttctctatctcagaatattcaatatccttattgtcgcttcttaatcgctctagctcgtgtgctgaagatgtaaatgatgactgcatctgtttaatagtcttgtgtgattcatcgaccttaactttccatttatttccttctcgctcaacacttctctgtagcttctgtaaaattccttctgtttctgcaaggacggatttgtatcagacacactctagctgtagcaatgtgtgcatttcatcagcttctttcaacttgtgctctagaaccttaacctcctctgaccctgaagtgtcaa

SEQ ID NO: 497398 - DNA, 929 bp, Homo sapiens
  misc_feature (4)..(4): n is a, c, g, or t
  misc_feature (59)..(59): n is a, c, g, or t
  misc_feature (141)..(141): n is a, c, g, or t
  misc_feature (145)..(145): n is a, c, g, or t
  misc_feature (163)..(164): n is a, c, g, or t
  misc_feature (266)..(266): n is a, c, g, or t
  misc_feature (287)..(287): n is a, c, g, or t
  misc_feature (300)..(300): n is a, c, g, or t
  misc_feature (311)..(311): n is a, c, g, or t
  misc_feature (324)..(325): n is a, c, g, or t
  misc_feature (338)..(338): n is a, c, g, or t
  misc_feature (347)..(349): n is a, c, g, or t
  misc_feature (355)..(356): n is a, c, g, or t
  misc_feature (358)..(360): n is a, c, g, or t
  misc_feature (387)..(387): n is a, c, g, or t
  misc_feature (402)..(402): n is a, c, g, or t
  misc_feature (406)..(406): n is a, c, g, or t
  misc_feature (411)..(411): n is a, c, g, or t
  misc_feature (415)..(415): n is a, c, g, or t
  misc_feature (434)..(434): n is a, c, g, or t
  misc_feature (449)..(449): n is a, c, g, or t
  misc_feature (487)..(487): n is a, c, g, or t
  misc_feature (492)..(493): n is a, c, g, or t
  misc_feature (652)..(652): n is a, c, g, or t
  misc_feature (866)..(866): n is a, c, g, or t
  misc_feature (910)..(910): n is a, c, g, or t
atgngctataaagggagtgaccaggagcaactgggacactcctttacctcccatatccnatgtatgtgtttcacagaaaaacaacaaaattaacaaattcacaaaatacaacagctagaattacaaaatccattcatccangggnggtagaaggcaggatggnnaggtggaagggtaaatggcacagggagaaaaacaaagtgttccatcatccaggcacagggatggcaaatgctagaaaatagctgcagaaaaacctgtggtcntttcagactcacggtgatgtnaaaaatccacacntggtgtagggnacattctgccttnngtgcaccagaganaaaattttnnnttcctnngnnngaagggaatacgcagagggcccttggnagagcgggttctgcnttcnctggnaggngggaggtgacagggaaaanatctgccacagcttnttccaatcccgcccatcccctttgggtggcaggcaacntagtnncctgcagtagccttcagtttggcaggcgacggatgcggtgaagggaacttctctgcagaagtagagctgctcagggccgactgcaggtagactgtcttgtggaagagtctgttgcttaagaagaccaccaaggagaagaggcgcaactggaagagatangctttgccaggggtctttgcttcattggcgctgataatgaataaaggaaagaggatagagaaaaggcagccactgataatatatgaggactgcattgctgtgagaaaagccaagggcaaccaaacccaaagtagtaaggccaattcctttctatgttagacaaccgctggtgcatttcaattcctttattgaaccaacgatattcaaagcagtncagtgagtagagaagggacatatgcaggagactaaccagctgancgacaagatggatgggaaa

SEQ ID NO: 497399 - DNA, 807 bp, Homo sapiens
tataaaacccctcatcaaatagatggaaacttctacaaaaatagctcaaaccaatttctacaaaatgccagtattcaggcgggggtttcaaagccaaagtgatgttttggattgttaaaggtgaaattatttacgttggcggattgaagcagaattatggtgaggaaacgtttgacccaattaattgccgttgaacgctccgatggaaccctgtggtggctacaaaacattgttgaccgccgatagattcgccgtcggaaagtgcgttgaaggagaacactctccgaaagttactttctgtgagaggctttgtgtagggagcgtggataacaatatagaaagcaccccgagtataaacatgtgtataatataaagcaaggtgcttctgaaaaattatctttgtgagtatatctccggatatgtgttatattctctataattgtagaaccttattgtggtgtacgcctctccacggtgtgtactgtgaatatcactctcccttgataagtccgcagtttaatataaccggcatgtgtgtgttttatagacgaaacttgtgggggcaactttcttccacttacgggaggcaattattataacgcggggggggttataggatttgacccagttgtgtagtgggggtgtgccccatgttgttgccccctttctctatatatatgtggggggggagtataggaggggcggctttaatgcggctgtgagcaggtgtgtgttatacaaacagggggcctcgaagacaaaaaaacattcctctttgcggaaaaagacaacaaaaacaacactttt

SEQ ID NO: 497400 - DNA, 875 bp, Homo sapiens
tggaggtagagtctcactatgttgcccagactagccttgacctctggggctcaagtgattctccctcctcagcctcccgagtagctggaacgaactatagttgcaccacggcagctggaagaatcaccttctttataaagcgtcagtcatgcttccagcaagaggcagcatcagtcagtggctttataacagcttcagggtgcctcaaagactgtgtgaggttaatgagagccgtagattagacagttgggctgtccttccctaaaattggttttctccttattcattattccccacggcatttaaaatctagtgagtttatactttttacggggaatggaaagtgtggtgaagatcattcaacacttatgtggtcatttctcccattttctgaatttcttttctaaatttcccccctttcaaaatggttcgaaagcccacagcttatggaaagaattcaggtctagatggtctgcacaacgtgttgggggtgagtgggagtgacggggcaatgtactttttctccctgtagtcgggagtccattatgagctgctgcttcttcttctcacatctttgtccatcctcctggggcaatggttcgacagcgctgaagcttcccaccagcatttcacacacgggaactccacccaggcattggagaatcttggaggttgtcgcccaacggtggtcagaataacgggcactatgacgctaccaacatcaaaggtgtgggcacacactacagcccttgtctggaagaccacctttggtcatctgtaaccgccccccttacttgcacgtctgttgttatcaccggacacggtggccccatgcttaagggacgtcgccgtgtctcgtgacaacacacagccct

SEQ ID NO: 497401 - DNA, 703 bp, Homo sapiens
agtgagtatgacctccaaaggttaaacacctgtcccaacagcgaagtggactcccatccggagtgctggctcacattaatggaatcgtaacagggactccgagtgctgaaggacttggggattcaggatggaccgctaaattgcttcgaagttgtgtgaaggagtccatcacggttgggcatagtgcggcaccaaggggaagatcatgtacgtcgggaacgtccgcggcgccacacagaagcatatccaggaagtggggcccaatcgaatctgatgattgggggcagtccctgtaatgaccgtctatattgtcaaccctactcggcagggatctctaacaaggaacctggccgacgttttcaaaaaggactagcggctcctggagataatgcgcttgccaatggcgggagaataaagcgcgttcttctggatcataggggaatgtggtggccatgtggcgaaagtgaccaagggggacatcttcatgaatatcgcgcgtcctacccattgatgcttagatgcaaaagaaggtgtcatctagaaaacaggcccgcaacttatgggtaaacttccaggattaacgggcggctagatcaactgttactaataatctgagttgaggaatgttggagctggaaaaagcaagtcaggaagtgagacatattcgagtcaattcacccgaggacgggcgattgacaggtag

SEQ ID NO: 497402 - DNA, 1056 bp, Homo sapiens
gacattggccgcaactttacctgcgaagcgacaccttgtcccgccgtgatccccctaatctcagggggacttccacacaacttgctcgcggtctccacgcgttcttacctcaggaagtcctccgcggatcaattcaagggtgaccccaaggggctcataatgtcttgccccccgtcgaaatgatggcccccagtgttcggtaccgggcgttctataccaacagtaccctatgtacatcagcccttcaagcattcatcagccaagtgcctccctgccaccaaccgactccttaagccaactcctggcccaatggttcatgccatgcacaacattgggtatcatggaaaagacacatgacccacacatccaggccatcactgccacacccagaagactgtggaccggcccctggccggcaaactgtagcgtggatgcccacgcggggctctccagaacatcatccctgcctataccggcgactgccaaggctgcgaggcaaggtcataacccgtgagctgaacgggaagctcaccggcataggccttgccgtgtccccactgccaacgtgtcagtggtggactctgacctgccgtctagaaataacctgccaaatatgatgacatcaagaaaggtggtgaagcaggcgtcggagggccccatcaagggcatcctgggctacactgagcaccaggtggtctcactctgacattcaacagcgacacccactcctccacctttgacgctggcgcggctggctattgaccctcctaacgacgcactttggtcatagctcatttcctggtatgacaacgaatgttggtctacagcaacagggtggtgaacatgcatggcccacatcggcactccaaggagtaaagatccctggaccaccagccccagcaagagcaacaagaggaagacgatgagaccctcaactgctggggagtccctgccacactcagtcccccaccacactggatctcccctcgtcacagttgccatgtagacccttgaagaggggagggcctagggaagccgattacccgcttgaccatt

SEQ ID NO: 497403 - DNA, 240 bp, Homo sapiens
  misc_feature (46)..(47): n is a, c, g, or t
cggaccatggttagtccctgcctcctaccaggacggtcctgccatnnctcaagtgtccacaggtctgatgtggaattcggtgtcacctgcactctcctgttgaagcagagtccttttctgataacgtttctcttgaaatgctcctcagctcttttcacccacacctcaccctctcctgcctaaaggttctaacacctccaaaccagcctgcaacccatactgctgccattaaaggagctg

SEQ ID NO: 497404 - DNA, 212 bp, Homo sapiens
ggggtaaccctccctttgtaggggaggagaaataggggggacgggcaaggagcacatatgtgtcccccacctaggggtctctagccggtgtctctgcccggcctccaaccctctatgtcgagagcagacttcatccatagtagcaccgctacatgaccatcacctcggagcggagcttacccgctgacgtataccagatccaggcgaactcc

SEQ ID NO: 497405 - DNA, 406 bp, Homo sapiens
ctagggcctaattcatgacgccaagttttgcagcatgcagagatgattgcacaggactgacagacattatacgctattgtgattggtacattatgcatggagagattgacagtatttagaaactgcaggatccaaacatatgtgacgacactctgactctgaagtcagtgactggacgggacatgtacttgacctagctaggggaccagtgatggtgcatgaagacatcattgactgattgagagatccaagtctttctcatatgccgttgccacattctgttgaggatctcttgccacagcggataagagtcagactgtattatgacagcattgttgcgagggccagctgctggatactactggagcatgctggattacagtcagcatgagtattgactgtgggt

SEQ ID NO: 497406 - DNA, 395 bp, Homo sapiens
  misc_feature (143)..(143): n is a, c, g, or t
tgggcagatcacctgaggccaggaattcgagaccagcctgaccaacatggtgaaccccatctctactaaaaacataaaattagccaggcatggtggcacatgcctgcaatcccagctacttgggaggatgaggcagaagaatngtttgaacctgggaggtggaggttgcagggagccgagatcacaccactgcactccagccggggcaacagagcgagactttgtctcaaaaaaaaaaaaagaaaaaaaagaaacagcatgaaattcttggtggatgggaaatacccgaagggctggccggggtttttcagagagctttcaaaaagctgaatccagggaggttccgggagatgggcacagccaggagggaagggtagcgcggggtctcttccttc

SEQ ID NO: 497407 - DNA, 459 bp, Homo sapiens
  misc_feature (347)..(347): n is a, c, g, or t
cacgaggcgcatgcctcgatgcgagaaacggcgaagcattcccggcaccggccctgtgcagccgcgcccgacggccgcctacctccagcctcgcccgcgccacgcgacccgaccgcgggttgctggtcgcggaccgggcgccggcttgattcaagtcaatgttgtttgccgcctttggccatagcgtgtgcgccgtcaaggaacgtccgcgacgtccgccggcgcgttgtccatcgcgtttccgtccacccggggtttgtcatgaacactccagtcaagtccacccccgcgccggttgccggcggcggtttcttcgaggtcgccgactggcgtccggaagaggcggngttctggcaggcgaaccgcgcctttgccatccgcacgctgatcatctcgatgctggccctgcacctggccttcgccgtctggttcacctggagcgcgctggtggtgcgcctg

SEQ ID NO: 497408 - DNA, 492 bp, Homo sapiens
  misc_feature (17)..(17): n is a, c, g, or t
  misc_feature (50)..(50): n is a, c, g, or t
  misc_feature (54)..(54): n is a, c, g, or t
cgcgtctgctcctcgcnaagcgccggcaaccggaggcctgtgaggatganacanccaaccacacacaagcacagtaagcctgcacgaaagctgcttgttggagttggatggaatctaagtagctatcagtttcgagtatctgcctcctctccgattttagttacctcaggttcaaggaagtttgagtaacaagaaagaattagtagcaacggtatggtctgcggagagccgagttcaggttcagatctgggctttgcacttactagttgtgtcaccgcgggcagttactaacctctcagtgcctgttccctcgtttgcaaatgaggatgatactagtacctatcttgtagaattgtgagcatgtgaatgagttaacatacataaagcacttagaataatgtctattatatataaaatgctctgttactgattagtcttatcatccatatcattatattaacctgtgttgtgatactggaattttccaatgag

SEQ ID NO: 497409 - DNA, 402 bp, Homo sapiens
  misc_feature (274)..(274): n is a, c, g, or t
cacaatgagactccttttcaaacaaaaaaaaggggaagaatatgtaagggacagggtttagccatgtcccccaagcgggtcttgaatgccggggctcaagcgacccctccacctcagcctctcaaaatggctaggattacgggcttaagcaaagtgactggcacaattgattggctgctggcaccttagcacaacccagggtttagtgggttaccaaaccgagcctaattaattaacgatggagtttttcccccaacatgtgcacattggaaanacaaaccaaaagtgtcagattttacctttccactttaattattctttgagtgaaaccaggcaaacaaaaattttttttaattaaagttgtgggccctccgaattattacattcttcttaaatatccgg

SEQ ID NO: 497410 - DNA, 348 bp, Homo sapiens
tgaggagtcgttttgcggcgcctttctaccctgtcgattaggtgcacagcctctcgcgtgacgtgcgacactcctggacacacttccattctaagcttatgttgacatgtatacaaaccaagtgtctagagattccagttgctgcaacgccctactgtgttcttatgttcctgtctaaaagagaagtttacttagaaataattataaataactgaatatactttagtgaggtgactgcaagatgcttctttccccagctcttggggacctggccctcactcgtcctccgcgcgtcgccagctcttcaggttctgctctgtccgccgccactggcccaagctgacctcg

SEQ ID NO: 497411 - DNA, 454 bp, Homo sapiens
acccctcgctggcctatggaagctccctgtcctcccattgttgatcctgatcctctcatcccctgcgactctgtatggactggtcgggactgcgtttctacacgcgtggtcaaggggacaatgcacctggagttctcttcactccgaagagcccagtggtccgaccatgtgcatgctggtggagctgcacacgctgagcaaggaccgttttgtctacacctgcaatgaatgcaagcaccatgtgcacgacacgctggcactgtactgtctgtgaggattatgactggtgtaatcaccgtgctataacactaaaaaccatgagcacaaaatggagaaactagggcttgggttacatgatgagacgcacaccaaccagcaggctggaagccacccaagagcccaggcgcatactcggcgcctgagttatcccgcgctgaatccagtcttctggtcc

SEQ ID NO: 497412 - DNA, 504 bp, Homo sapiens
gtgtgttctgaggatccagagatagcaggaggttatgatttacagacatgtttggtaaaagcaaaaaacaaaaactaaacaactaacaacaaaaggacagatggtacgtgctgaggtgaaatgaaacaagaggcagtctggttgatgaattcttgctctacttaggaacttgtccaggatacaaaatagacggacacactacacaatcaaacacacagacacacacaacacaaacacacacacacacaaaccaggacaaagaaacacaggataccccacagcacaatagtgggtgtgtgccagggcagatgaagatatccaggccagatgatgtgattgaagccctgtcagatgagcgctatatctgtatgacgtgagttcaaaaggcaaagaggagtgtccgcccataagagacagtatggggataattacaccatcctgcaatatagatggtcaattcacccagccttcctgggcacagatacctacaggtgctgcttatct

SEQ ID NO: 497413 - DNA, 579 bp, Homo sapiens
ggaaacggaatcccggcgattaaactgggcaacttttggcaaaggaatttgcctgttacaaacccgattttttaaaatttaaatggggaaaaatggggggggggggggggggggaaaaaaaaaaaaagggcccggtttttaaggttatttaaaaggggttgggccctttaaatttgggttttaaagccttgaaatttccagggtagcccccattttttgacccccaaggggaaaagttaaacctgtttgattggttcaaaccttgaaaggggaccctaatggggaattttgcccaaaaaaaaatcccggccggtaaaaaaaattgttttcaaaagggggggctcaggggccctgggagggtggtttttaggggggaaaagggggagcccccccttttaaggaccaaaggcccttttttaaaactggggggccctaaaaaaggggcccggttttttccccggaaacctttggttttccttttaaaaggcggttttttggcccggttttttttttaaaggggggcccaaaatttcaagtttggccccttttagtttaaaaaaaagggggaattttttttta

SEQ ID NO: 497414 - DNA, 257 bp, Homo sapiens
gaggaggccgcagtgagctatgattacgccactgcactccagcctggacaacggagtcccctgtctggaaaaaaaacaattgcctgggtgcagtgactcacacctgtaatcccaacattttgggaggccaaggcagcaggctcccttgagcccaggagtttaagaccagcctgggaaacacagggagactccatctttatttattttttaaaaatttaagaggccgggcatggtgtatcacgcctgtaatcccagca

SEQ ID NO: 497415 - DNA, 99 bp, Homo sapiens
gtgcagaacggcaggtggcctctgtaagggcacatggaggtgatggtgtttcttagagagaagatcactggaagaaacttctggctttaatgggcttta

SEQ ID NO: 497416 - DNA, 277 bp, Homo sapiens
cattctctgttttttacctgcttttaacgtagtagtagggatatgatattaacatatatatactatttatagactacatcccaacatgggaaaccccatctctactaaaaatacaaagattggccgggtgtgatagcaggtgcctgtaatcccagctactcaggaggctgcggcaggagaatcgcttgaacctgggaggtggagcttgcagtgagctgagatcataccactttactccagcctgggcaacagagcgagactccatctcaaaaaaaaa

SEQ ID NO: 497417 - DNA, 798 bp, Homo sapiens
  misc_feature (96)..(96): n is a, c, g, or t
  misc_feature (98)..(98): n is a, c, g, or t
  misc_feature (429)..(429): n is a, c, g, or t
ggtaagctcgcgccgccggtcagctcagcgctgggtctctcggtcccgcagcgtgaggaggacggtctgcatactcgctgccgcggtccctccccngngtccctggaccgcggggaagatggcctcaggagtgcaagtagctgatgaagtatgtcgcattttttatgacatgaaagttcgtaaatgctccaaccagaagaaatcaagaaaagaaagaaggctgtcatttttggtctcagtgcagacaaaaagtgcatcatgtgtagaacgaaggcaaagagatctgtggtgggagatgtgtggtgtaaccatagatgatcctttcaagcatttgtgtgggaatgcttcctgaaaaagattggtcgctatgtttgggtaatgatgcaaagcttgtgaaacaaaagaatccagaaaagaagagtggatgtntttgggtgggcacaagaaatagcacctctgaaaagtacaatgatctatgcaagctccaaggatgcaattcacacaagacattttccaggcataaaaccatgaattgtcaaggcaaatgggaccagaagaatctcaatcggggtggtattgtctgaaaaagttaagcgtggatccttaattgtgtagccctttgagaggatgccctggggttagaattaattccagtgcccacaaattggaaagcttccaatggtttaaggtgaatcctcttggtatattaaataaaggcaaatatatttagggcagggctcacagagggggacacgctgggcacctttaaaagaacatatttttaaaatatgtaaaagg

SEQ ID NO: 497418 - DNA, 358 bp, Homo sapiens
ctctctctctctctctctctctctctctctctctctctctctctctctctctctctctctctctctctctctccatcattggagcagaggcttgaatcctattacaactactgcaatctcttcaactacatacttaatggcgaaggacctgctccccttgagcgacccaaccagtggctctgagataatatcgatgagtgcatctaccagagagagacatacagacagtaccgctgtaagactgccaagaagtcagaggaggagagagactatcttagaggcaatcacactggaatgtacatagcgtcctcaatgagcatcataccctgggagacagagagactgaggagtgagcgcg

SEQ ID NO: 497419 - DNA, 503 bp, Homo sapiens
gtcgactctgagtgctgttgtttgttttgttttgttttgttttgatgactttgggtgcccttgtgtttgggacatagatgttaagaattaagacatcaatctggtatatttttcctttgaagagtatgtagaatccttccttttctttttattagttttggtttgaagcctatttttgttggatatgcaaatggcttggaccactttgcttcttatgtccatttgcttgaaatactttttccaaatctttaccatgaggtaaagtctattcttgatgttgatgtgtatttcttatatgcagcagaagaatggattggggatctgagaagagtgatatcaagaaatattagtgactagggattgttaattcttgttattttgttgttgatggttgtggcggtggtagtggtgttgccgctgctgctactgatgctgctggtggtgatgtttgtgtgcgtgtgtgttccccttctttgactttgctggtgtgagattatttaatt

SEQ ID NO: 497420 - DNA, 639 bp, Homo sapiens
tgtggtggctcatgcctgtaatcctagcactttgggaggctgaggtggggggatcacctgaggtcaggggcttgagaccagcctggccaacatgataaaaccctgtctctattaaaaacacaaaaactggccaggcatggtggtgcatacatgtaatctcagctaattgggaagctgaggcagaagaatcgcttgaacccaggaggcagaggttgtagtgagccaagattgtgccactgcactccagccttggagacagagtgagactgtctccaaaacaatcacttaaaaatggttacaggggccgagcatggtggctcacgcctgtaatcccaacactttgggaggccaaggcagttggatcacttgaggtcaggagtttgagaccagcctgaccaacatggagaaaccccgtctctactatcactacaaaattagccgcctgtggtgtcacatgcctgttatcccagctactcaggaggctgaagcaggagaattgcttgaccccggaagacagaagcttgcgcgaccccggatcgggccattaccattcagtctggccacaagagcgctccattcatcaatcatccaccacgtacttcctccattatacccttgcaggtgggcagttaccctgcc

SEQ ID NO: 497421 - DNA, 449 bp, Homo sapiens
aatcataccagaaatgggaatcatttgcgatggcacaaacttaatcgcaccagatagcacgaggacgccgagtgttacccccgtactaacaaaaatggctaataacgaaatggctaatgcatggtcaatccccggcccccgttttttcgcattccaagccgcattgaagataatgaagcctatcatcgccagcgttagcacaaattgttgactcggaaaatatactttagcaagtaacccacgataaatagttgtacaacagcccgcacgacaccaatgacgatgtccctatctaagccaagtttctgccacaaactaattcctaacgcgacggcactaacattgccgccaaaattgtgacgtattattaactgctaattcatgcggtacctccatctgccagcaccatttcgctaactgatctgccgagcaatctctgtcggtcatgg

SEQ ID NO: 497422 - DNA, 857 bp, Homo sapiens
taaaccgggggggcggtctcctctaaaggggaccccccccctcgtggtggggcccagagggggggggggaagaaggggggggggggaagaaaggaggagcaccgggggcggggggaggcagcaaaataagtatgtgtgctcgcttgggagagaaaaaacaaccagcaggagtggtacacgactcctgaagaggttcttcttttttcctcgagaagaagggggatgacaaaaaaaaaagcaatactggtgcaccttcacaacctcctaggtgagagttgccacacgaagggggaggggcccacagaggggtgagtaactcctaactatataaggagtgaacataaatgaaaaataaaagaaagaaacaccagtgagaggtaccagaagagaacagccaaagagaggggggaagagagagggaacgacaaatatatgacagaagaaagataagagggaacaccacaagaaagttggggggtccacacaccagagaaaagaaggaatgaaaaagaaaaaaaaaagcccccgcgagagaccaaccacaagggggggggaacaaaaaagagaacttcatggttgtggaagaaaaaaaatatccgcaaaaaaataaagaggaacacagagagaaacaaaaaaacacatggcaagcaaaaaaaaaaactaacacaaagagaggggggaagaaaaaaacaaaacacggggaacaataaaagacattagagttacaaaaaccaagaagaaagaaaaacccccccaaaaatgaagaaaaacaagaaaccccaagagaggccaaggatataaaaaggcgccgccaaaagagtgtggcaaaaaaagataaaaagaggacaacagaaaat

SEQ ID NO: 497423 - DNA, 491 bp, Homo sapiens
agagttgtgcatctcagagaagtattgtcctctgagctctggggactaagattggtctttctgtagttgaaggtcagtgcagagaacttgccccaggctagtctcttggtctgcctaaatctgaccttctgacccacctaagcacgagcacttgggagacaagcctcgagactggttccctcttccgctgcagggaagaacctctctatccagggcctccgctggtggctacagtggctgggcattcaacttcaacctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtct

SEQ ID NO: 497424 - DNA, 139 bp, Homo sapiens
cgcagcccgacggtaagccgggagggcctgcctacgctcaacaccaccatcctgtacccaaatgtacgggctggaatgtctggttccttacccggtggctcagtcatcagccgcctgttaattaatgctgaaccctgca

SEQ ID NO: 497425 - DNA, 191 bp, Homo sapiens
ttcccttttagactatggcgacatacctggagttcatccagcagaatgaagaacgggatggtgtgcgttttagttggaacgtttggccttccagccaactggaggctaaaagaatgggttttacccctggccttgtcttcctaatcctttaaaaagacggttccaaacctccctccttacaataatgaacc

SEQ ID NO: 497426 - DNA, 874 bp, Homo sapiens
  misc_feature (874)..(874): n is a, c, g, or t
aaaaataaatattacaaatacgggaccaaaaaaaaaaaacttaagcggaaagacactctcttaaccaccgcatcagaaatggagagtttgtacagagctctggataaaatggtgttgtggtgttttctctggggtcaatggtcactaacatgacagaagaaaggggcaacgtaattgcaacagcccttgccaagatcccacaaaaggttctttggagattagatgggaataaaccatatgccttaggtgtcaatactcttctgtacaagaggataccccagaatgaccttataggacatccaaaaaccagagcttccataactaatcgcggacccaaaggcttgttttgaagcagctcacccattgctatccccatggttacgattcaatcgatgatcacataacccgctctatatcactacctagcagggcaatgcaaattctgttaaataggactttaacacacatccaaatacagacctagtggactgccctaacgacgcttctttaacgttgctcaatcacagcagatgcttctcaagtgacgtagcaccccgctctctttctcaccgaccatccacctaagcccccacaaattattttacttagtctatcgccatacccaccacaatatattacacctgattcctcacccacagtagagtctctcaacacaaggggccccgtccccgctgcctagtgccgctaactgtcatgctcgtgcagtcacatttaccaactccgttcctaacaatagccacaaactacttgagcccaccatgtgactagtagacctatccatcgacacaacaaaacagcacacgccgcaagcactcctctcacatcaatatacccacctgcatccatcacgaan

SEQ ID NO: 497427 - DNA, 1069 bp, Homo sapiens
gccaattttctatcgaacgccagtacacctgttatccatgatgatctccggcaacgggctttagaggacctcattagctagcctctactacagatggagactccaggtacgccatgcgtcctcagctgcgcacaccgccatgttaccggacttctgggcgacaagactgagaagccgtgagccccatagatgttacctgcgcggcggtagtaatcactagccgcgtcgacggatccacaggcagtatgacgcggttaataagtgcgtacttctagagctataatgagactgcgcgccaattggctacgtatcatgcatgcaagtgagctagctggcaagcagaagctacgtacgcgaccagagcaccaagtcccagtgtgtgcagtgattgcgctaagattgttccaattatagtgcgccccaggcacaggtaacgctgggatgttggcccaccctatggcccatcatgcacgcacaacataacaccgccaacataaagattgcgatggagatagctcaggcgaattctgctgtgtgctgcatgctatacttgaaaggagcagagccaacttgtctggatggagcgaacgagtgacattggctgagcatcacagttgtctgcaccctattgtggtctctataaggcaggttctagagccttctttccgacagcgcctttcccaataccaagcgtgattcctcacctgccattaaacagccccagttccgtgctgtactagcgcgaagtgaccctgttttaaatcattggaccccagtttgatgcttaaacgttttgcagagacccaactaaaaaggacacaccaacggaaaaacaaaacgggttcaagggaagagaagccgaaccccagctgagccggaaggggagcacaaggcggtgcccctgtccttaggagcaatgttatttagacggcgctgcttctgaccaggcagaccttgctcaactgccaaaatctgtgttggtattaggcagattccattgcacccttttgatccattttggccttaagaacggcctgtcatcatattccgaaacacaacactaggctct

SEQ ID NO: 497428 - DNA, 162 bp, Homo sapiens
ggatttgctggtgcagtacaactaggcttaatagggacatgtatcccagaacttaaagtatattaaaaaaagagacagacagaagaaatagataatgaggtactgcttttttgtgtaaagggttaattaccctgaaaaatcccacccattatttactctgaa

SEQ ID NO: 497429 - DNA, 166 bp, Homo sapiens
atttctcgatttgtttttcaaccaaatgcgagtatgggtttaaacattcgatcatacttgtacggtgtggaatatatcgaaaatggatatcgctttacaatttacattgttaggatagcgcaactctaatactgtattaaatggcaagtcaacatatccagttcag

SEQ ID NO: 497430 - DNA, 711 bp, Homo sapiens
  misc_feature (10)..(10): n is a, c, g, or t
  misc_feature (63)..(63): n is a, c, g, or t
  misc_feature (66)..(66): n is a, c, g, or t
  misc_feature (97)..(97): n is a, c, g, or t
  misc_feature (101)..(101): n is a, c, g, or t
  misc_feature (125)..(125): n is a, c, g, or t
  misc_feature (150)..(150): n is a, c, g, or t
  misc_feature (156)..(156): n is a, c, g, or t
  misc_feature (181)..(182): n is a, c, g, or t
  misc_feature (188)..(188): n is a, c, g, or t
  misc_feature (197)..(197): n is a, c, g, or t
  misc_feature (201)..(201): n is a, c, g, or t
  misc_feature (250)..(250): n is a, c, g, or t
  misc_feature (268)..(268): n is a, c, g, or t
  misc_feature (275)..(275): n is a, c, g, or t
  misc_feature (290)..(290): n is a, c, g, or t
  misc_feature (293)..(293): n is a, c, g, or t
  misc_feature (310)..(310): n is a, c, g, or t
  misc_feature (313)..(313): n is a, c, g, or t
  misc_feature (323)..(323): n is a, c, g, or t
  misc_feature (340)..(340): n is a, c, g, or t
  misc_feature (359)..(359): n is a, c, g, or t
  misc_feature (369)..(369): n is a, c, g, or t
  misc_feature (373)..(373): n is a, c, g, or t
  misc_feature (384)..(384): n is a, c, g, or t
  misc_feature (394)..(394): n is a, c, g, or t
  misc_feature (405)..(405): n is a, c, g, or t
  misc_feature (449)..(449): n is a, c, g, or t
  misc_feature (468)..(468): n is a, c, g, or t
  misc_feature (509)..(509): n is a, c, g, or t
  misc_feature (572)..(572): n is a, c, g, or t
  misc_feature (634)..(634): n is a, c, g, or t
  misc_feature (639)..(639): n is a, c, g, or t
  misc_feature (698)..(698): n is a, c, g, or t
ttttcccaanaaaacaaagcaataagttaacattctcaatataaaactaaactttgacatagngancacaaaacacagttgatttcaattgatcccntttnccaaatttcacaagaaaaatgtcnagattctcatttcacaaagcatggngttttncagccacacacaacagaacgcaaannggctangcttgtgcnacangtttacagaacaacaataataacaataataataataacaataatatgtncagtcattagatcctgcnctggggnttgtgcgttcggggnggnggctggcattattctgnggncgggcctctngggattgttgtaaagcngattttgtcttattttaangcccactggnattngggtgcttgtnctcgcctgtnttctctctccnccccatttgccctcgctccctctttctacccagggggggaatcngcattttccttcttgtccnggcgaagaaccagggttcctccggaatgggaaaatcatgtnggcttcatttatcgttcttttcttttaaaaattatttattaaataatgtcgggcatgtaaaanatgcaaatcattcggctccaaactctccataccagggaggtacaaaagtcactgtataaatnacaantcaccacgtcctccttattcgtttctccccgtgcgcttaaagtaaacagtgcgtttgancagtgcgttcctt

SEQ ID NO: 497431 - DNA, 1072 bp, Homo sapiens
agacgatccgctagccacattaggcgctcgtgtctctgcgtccgccccgtcccgtgctctcagagacttgcagctccccaggcccgaggcccctgtcggcccatcctcgagcccagtgtaggctcagcagaacgctctaactccagcctgctagtcagacccactcccaggtccctgctcgtccccgaagcaaccctgctgtggctggccgcagcttggcccattccttttggctaacgctgcgaggcctgcagggttgtccggcgtggaagtcctcctcgggttgccctccgcggcgcctgtccatgacggcgagagggcgggagctgcctcgcgatgggtgactgtgccgagcgcctatggcaagcccccaacgtgcagtcgcgtccctacgttcgacggtgccctgcacggtgatggggcggcctgggttgaatccattcgtggggggcataacccgcggcggatcccggcatgcgtcctttaaggcaattggggttccaaggggccgacaacgcaaattccaaatccggtccttaagaaggcgcaaaaagctcggcagggggcgaggcggcggtttccattggccccggaaatactcagttcccctcatcccaaatttggcgccatgggaaaccccgggctttatctcccatagcgccggctcctatggcctctgggggcacagaaagggctctggggtggtacgccccaagggtccgttatggcacgcaggagcccttcccacgaggggcgcttatctggggcaacgtccccttgtgttcggcacacgccaagggccacagatgaccgaggccccgataaacttttggcccgatgggcatggggaaaacgccctgaaccgcaatgggcggaactgccaaatgaggttcccctgtgtaccctgagaggaaacaacttgatagatacccaaacccaagtggggtactttcccttggcaggatggttcacgctcccctaggaggtagccccattgtaccgtgggtccgcaccgaaattgcacgagactttgcaactccgtgtgaaacacccgccgactggcacataggaa

SEQ ID NO: 497432 - DNA, 942 bp, Homo sapiens
  misc_feature (153)..(153): n is a, c, g, or t
  misc_feature (314)..(314): n is a, c, g, or t
  misc_feature (326)..(326): n is a, c, g, or t
  misc_feature (328)..(328): n is a, c, g, or t
  misc_feature (333)..(333): n is a, c, g, or t
  misc_feature (337)..(337): n is a, c, g, or t
  misc_feature (364)..(364): n is a, c, g, or t
  misc_feature (373)..(373): n is a, c, g, or t
  misc_feature (384)..(384): n is a, c, g, or t
  misc_feature (480)..(480): n is a, c, g, or t
ccgaggactcgcgcggaggcgagatgctaccagtcgcgtgactgagatcggctgcctctcctgcagccccgtgctgctctgaaagtggtgactgaaaggaagaacctcgaaggagaagacatgtgacataaatgttaacagttcttattggangtaaacaagtcagtgaaggtacagataatggtgatctcccttcttatgtgtctgcattcatagaaaaggaagttggaatgaccttaatctttaagagacttgataactcatagaacagaggacagtaagtaaaatgcagttagaagaacaggtacttacantttcatcagagntnctaanaganttcgaagtgccttaaaaatgcagagantcaagcatntcttatcagtntctggagcaggaactcatctcttcagcgccattacagccattgctgactgcgcaaccttggatggacgacttggaccatgattagccagattgagngatcgacgtcacttgcttacctaaatggattcacaaattgatgaactaagttgataacattcagcaatatctgatgaccaataatgtaccggaggcaggctccactctagtgtctatggcagaaacttgacattaaatttcaggaatcatcttgtactcatcttcttggttccatgacgagcacagttaaattcctgggcttagaattcttccagggccaagcttaccaagtgagttccgagggaaatttgagacacagtacttgagccactcgataagagccccgactaaatcaccagactgttgggctaagctcgaactgcacatagtcccgagagaattacagtaacctgggcgacacggtagccgtccactcacacaacagaagctacaagaagatagcagaggagaaagacacgctcagaaaagatatactagggccccaataagtaagtcaccggg

SEQ ID NO: 497433 - DNA, 256 bp, Homo sapiens
  misc_feature (32)..(32): n is a, c, g, or t
  misc_feature (194)..(194): n is a, c, g, or t
  misc_feature (209)..(209): n is a, c, g, or t
  misc_feature (212)..(212): n is a, c, g, or t
  misc_feature (225)..(225): n is a, c, g, or t
  misc_feature (236)..(236): n is a, c, g, or t
  misc_feature (252)..(252): n is a, c, g, or t
ttggctcctgctggcagcccgggacccccagncccacgtggtatcaaatattgaaatgcatccgtgtaacatataaatctgttgttaaaggattgttgtgattttgcgcatgaaatatgtgggcaactcggccggacgccgaatgtcacgcctgtaatcccaggactttgggagggagagatggaagggtcagntgaggccaggagttnaanaccagcctgggcnacataggaagnccatttctttagaaanactt

SEQ ID NO: 497434 - DNA, 256 bp, Homo sapiens
caaagggatccgttttcacaaggatccagaagtccaggagctacctttaagaattatccctgaacgaaatgcattcaacaaactcttctcaggtgcatcccctgggtcctcttgagggctagcaagcactgcgtgagttgcttatcttctaactaggtaactccgatagcgccatgcttgcgcaaacatcaggcaccaaggttgtgaactcagctagacagtatggtctacgaactatatgctgtatggatatatc

SEQ ID NO: 497435 - DNA, 210 bp, Homo sapiens
tcagacacaccaggagttctgcccccacagaatctttattgagtaagttatgctgatggaggagagtaaacagcgacagaacccaaacaaatacatcccttatggacgcaccatggcatagcgaaggagaggtgagacttgctggaatgacactatacttacgacccaactacagctagctatacagaacggatttcatccttacacata

SEQ ID NO: 497436 - DNA, 1095 bp, Homo sapiens
  misc_feature (82)..(82): n is a, c, g, or t
  misc_feature (836)..(836): n is a, c, g, or t
gctggagctcttggccataaagcctgaggcggacggcagcgagcgcgagattggacgtgtttggcagaagctacgagtgagnagattccgctggcaaccagatacttgtgaccttctcggcttctgtcctccgtttagtctcctccttcggtcaggcgagccactcgacgcacgtcagtcccgtgtcctcggatgccccacatgtcgcatgacgagcctgcgtttgaaggatgacctctaggaagaaagtgttgctgaccaggttatcatcctgggagattctggagtcgggaagacatctctcttgaaccagtatgtgaatattgatattctgcaatcagtacaaagccacaataggagctgactttctgaccacaggaggtgatggtggatgacaggctagtcacaatgcagatctgggacactgcaggacaggaacggttccagtctctcggtgtggccttctacagaggtgcagactgctgcgttctggtatttgatgtgacttgccccaacacattcaagaaccctagatagctggagagatgagttgtctcatccaggccagtccccgagatcctgaatacttcccatttgtcgtgtcgggaaacaacgattgagctcgaatcaccaggaccaagtgtgcacaaagcgggccacaggcctggtgctacagcaaaatactacattccccttactttgaggacccagtgccaaggaggccatcaacgtggagcaggcgttccagacgattgcacggaatgcacttaagcaggaaacggaggtggagctgtacaacgaatttcctggaactgttaactggaccacgagtgacncgggccaggtcctcgccgacaagcttgcaaatgctgaggggcaggacacagtttggcacacaagtcccttccgaaacccaggaacaccggttagcgctccaagatattcccctcttcatttgccaacaaccatccttgctcttcagttcggtgtccaggatacccccgttaaaagagttacccccatatctctgacagtcacaccgtcaacacacccacgattgaattacaaccgctgccatagccttaggtttcaccc

SEQ ID NO: 497437 - DNA, 320 bp, Homo sapiens
  misc_feature (1)..(1): n is a, c, g, or t
  misc_feature (103)..(103): n is a, c, g, or t
  misc_feature (109)..(109): n is a, c, g, or t
  misc_feature (220)..(220): n is a, c, g, or t
  misc_feature (223)..(223): n is a, c, g, or t
  misc_feature (244)..(244): n is a, c, g, or t
  misc_feature (256)..(256): n is a, c, g, or t
  misc_feature (259)..(259): n is a, c, g, or t
  misc_feature (262)..(262): n is a, c, g, or t
  misc_feature (277)..(277): n is a, c, g, or t
  misc_feature (279)..(279): n is a, c, g, or t
  misc_feature (281)..(281): n is a, c, g, or t
  misc_feature (283)..(283): n is a, c, g, or t
  misc_feature (285)..(285): n is a, c, g, or t
  misc_feature (288)..(288): n is a, c, g, or t
  misc_feature (305)..(305): n is a, c, g, or t
  misc_feature (307)..(307): n is a, c, g, or t
  misc_feature (312)..(312): n is a, c, g, or t
  misc_feature (320)..(320): n is a, c, g, or t
ngaaacagggagtttaaaagtggaagtatacattgaaaaagtacatttatatcacaaagcatcaaccacataattggaaatatcgatttgctggaatgtgtanatctanacgtagaatactaaaaacaaaccaattttcatttctacacagaaatattaacctccgtatcagtagtgatagatattttgtacattttcaaaaaaaaaaaaaaaaaaaggnaanaataatttataaaccaaaaanaaaattaagatnttnatnaagtcgtctgcatcnananantnaanaaaggatatttatttcncnaaaanaatgaagn

SEQ ID NO: 497438 - DNA, 453 bp, Homo sapiens
  misc_feature (72)..(72): n is a, c, g, or t
  misc_feature (96)..(96): n is a, c, g, or t
  misc_feature (116)..(116): n is a, c, g, or t
  misc_feature (258)..(258): n is a, c, g, or t
  misc_feature (306)..(306): n is a, c, g, or t
caagaaaaaagcaagcaaaagccagcacaaagatccgggggaaggcagaaaaagaaaacaaaaaatcagcangggcaatgacaaaactggaagagnaagagaaagtaaaattgtcnttacccaggaccagcaaatttgggagtaaagccagaattgaataggaaaaacaggactatttctgaagttgaaagccgatctttaagaagaccctgtctttaaaatgaaactagcaggcaaacacctaaataatcgaaaatnaccaaagaacaacaacgaaacaagaaaacctaaagatttttacttccnattcttattccttaacaatattactgtgacaccccttgcaatgctcagttgcctgtgtgtcaaaaaaacttgtggacgttggaaattatttgaaaatgtattgtgtggaatgtaataaaatgatgatatttttacacaaaaaagaga

SEQ ID NO: 497439 - DNA, 286 bp, Homo sapiens
  misc_feature (100)..(100): n is a, c, g, or t
gtgattccaggatttatagcgcgatagcccccgagtcccctgtttgggaaccagcagccaaaactgggtcctgagccggacgcggtggctcacgcctgtnatcccaacccagcactctgggaggccggggcggacagatcacttgagaccaagaatttgagaccagcctggccaacatggtgaaaccccgtctctactaaaaatacaaaaattaacggggtgtggtggcacatgcctgtaatcccagctacctgggagactgagctgagagaatcactttaaccca

SEQ ID NO: 497440 - DNA, 581 bp, Homo sapiens
  misc_feature (63)..(63): n is a, c, g, or t
  misc_feature (168)..(168): n is a, c, g, or t
  misc_feature (189)..(189): n is a, c, g, or t
  misc_feature (283)..(283): n is a, c, g, or t
  misc_feature (317)..(317): n is a, c, g, or t
cagaccacttcattctacagtcgatcggataaagacgcagtggagctgcaggtcttcaaagangcgaactgcgacaggaaaggaagacacagaagaggccacgggcagtgatgatgaagaaccaccatcaaaaaaggcacgcgcacaaccagatgtgaagccgaaacngaagaagggcatagctgtcangaagatggctgctaagactgccgtcaaaatggaacctgtcgaaattgacgaggaggaggaggatgacccacggccagcgaaaaagtcaaaggtngcgcccaaaaaggcgagcccgaagccaacaccanctgctcaagagactgagcccagtgatgtagaagatgaagagcccagcaaacgcaagactggccccaagagagcgaagacggcggcacagtcgaccaagactgctgaaataacgccagacgcggaagtcgaaggagagaaagcaagcgataatgattctgtctcagaaagccgagtcagaagaggaggaagagaagcccgaagtggcagccaaggcccgggcgaaggtgcaagcacactgaaagcgactggaaaggaagcatatc

SEQ ID NO: 497441 - DNA, 404 bp, Homo sapiens
  misc_feature (32)..(32): n is a, c, g, or t
  misc_feature (145)..(145): n is a, c, g, or t
  misc_feature (333)..(333): n is a, c, g, or t
  misc_feature (358)..(358): n is a, c, g, or t
  misc_feature (391)..(391): n is a, c, g, or t
  misc_feature (399)..(399): n is a, c, g, or t
  misc_feature (404)..(404): n is a, c, g, or t
cttctgggaaggtggctactcccctctttccnaccccccttttctgggatcttgacaagggattcctacccctgcccccagctgtcaaaagcctgcagcagctgcccaaaaaacctcaacacaggcatactttggaccctacatnatgtgttgatgtcacagatgctgtacccaggcatttgactccttgatctaaagcccaggattcctagccaacatggcgaaaccctgtctctactaaaaataacaaaaattagctgggcatggtgataggcacctgtaatcccagctacttgggaggctgaggcaggagaattacttgaacccaggaancgaaggctgcagtgagcagagattngcctctgcactacatcctgggctatggagtaanctctgcancacan

SEQ ID NO: 497442 - DNA, 886 bp, Homo sapiens
  misc_feature (886)..(886): n is a, c, g, or t
tggtggtggtggaaacggggccccacggggtcccccacacgggagtgcaggggtgcaattacggctcactgtaacctcaaactccgggactcaagccatcctcccacctcagcctttggagcagtctgaggctggcgttgaaccaccacaccagtctaatttgggtatttttggtagagatagagttccactatgtggcccaggtgggcctcgaactctggggctcaagcaattcttgggcctcctgaagttcgggcataacggggcattgacccaatgtgttgccccagcccaaaagagggctttaaaattaagggtaaaccccccccattgggttcaccaacacttagttaaaagaaaacacaaaaaagacaaagcaaaaaaaaattgtgtgtgggggggcacatgaggcgccctagggaaaaagagtttagcaacaccaatcggtgggggggcgcggggcccataaggtataagaacacagcgccaacaaggggttccaacaggggaaacaccgctgggaaaaaaagggggggggggttctcaccaccaaaaaaacaagcgggcgggggacggcggcttttgaacacacccagaggggtctgtgaggcaggcatggagccattctacaggccgaacagcggaaagaaaaccctgcccgcggggggtgggaacacacgcagacggaagcagagccgaacgaagcaggaaaaagacagaacgagtaaggacacaaacacgcaccagaacgagagagaacaagcaaaacaacacacacgacaacaagcaaaacaacaagaccgaaaggtgaacgcaacacagaaacaccgacagcggaacacaagcgaagacacagaacgaagacacgacagagacacatgtatgn

SEQ ID NO: 497443 - DNA, 200 bp, Homo sapiens
cggaccgcgctagcggcattagtgaacgaggcagggaaagactggaagattttataacgtcttaattaatcattaaaataagatttcacttgttgcccctttggggaaaggtaatgcgttctccctctctcccttcctttcttccctctctttttcttttctctttccctctccctccgttcacttaatgccgctagcgc

SEQ ID NO: 497444 - DNA, 587 bp, Homo sapiens
  misc_feature (179)..(179): n is a, c, g, or t
  misc_feature (250)..(250): n is a, c, g, or t
  misc_feature (252)..(252): n is a, c, g, or t
  misc_feature (257)..(257): n is a, c, g, or t
  misc_feature (302)..(302): n is a, c, g, or t
  misc_feature (358)..(358): n is a, c, g, or t
  misc_feature (366)..(366): n is a, c, g, or t
  misc_feature (377)..(377): n is a, c, g, or t
  misc_feature (388)..(388): n is a, c, g, or t
  misc_feature (400)..(400): n is a, c, g, or t
  misc_feature (451)..(451): n is a, c, g, or t
  misc_feature (475)..(475): n is a, c, g, or t
  misc_feature (571)..(571): n is a, c, g, or t
tgcttcctccatcctggtattttttggagcttccagtcctggttcttccaaagtgcccggacccaaaacaggaaagtgttgcggagataggaacatgggagagaaacaatctgggtaacatgaaagtgatgctggttgctaagggaaggcaacttgattctgtgggaagggctgtagcngatccatccgttgtctagatttgagtatgagcacaggggaagaggattctgacacagtaacaggagaaacngngaacnctgtgactttgactcaggacacagaagggaatctcattcttcacngcccgcagaatgaagcggaggaaatagacgcagaagagagtattgaaccgccacanaaaaggcnttggttgtccnctgaggaggancagagtattgangagtcgactccttgcatatcagttgttgcacttccacgttcagaaaatgancagagcgttgaagtgaccatgacngcaaccacagaaggagcagaggaggagggtacggaggggacggtgacacagatacagagtttgcagaatgagcaacgagatgaaatagcgcccttnggtaacgaggaagttt

SEQ ID NO: 497445 - DNA, 755 bp, Homo sapiens
agcggggcgtccagcggctctgcttgttcgtgtgtgtgtcgttgcaggccttattcatgggctcaccgtctgaggttcgacgggcgggctggtacgtggatcaccggcgcgggggcaggattggggcgcgagcgtatgccctggtgttgagcagaaagaggagactgttagtgtagatcttgtggaagccctgaagccagagtatgtggtatctcttgtccttgggctgttgtcacgagagtagtgaggagaatggtggctgtgtgtgaggttggacgcaggatggattggacacagattagcgctgaggagcggactcttgcgagctattgtaacgacacaagaatcagcccaatgactcctgaggcagtcaaggctaacctggaagacgatctgtgactgtgagaatgccagcaagcctcagagtatccaagaatcgacgtggccgtataatgagaagttctgagtcgaatagattcatgaaggaggagtgacagcaaagtcatagctagtacgtgcaagcgtctagaggaacatcaggatttgctggagctattggccatgaaactccctccattttgcttgagtgcttataacggaacctggaagctatcatgtatgccgttggagtgggagcgtcaatcaaggatccaccagatcttgaaatctactaagtgaaggaagttctgattctcctgtcctgccaccttcggagtcatcataggtcagagcctctatgacgggtgggaggatca

SEQ ID NO: 497446 - DNA, 236 bp, Homo sapiens
atggtagtggtggtggtggcagtagtaacagtggtaggcgggtggtggtggtattattattaataatattatggtggcagtggtggcagcagccgcagtggtggtgtgccacacaggtgtgcagagggccctgggtagccactctcaatggtggagatcgtgcacactcccttgtactggcccacactcaccatgtgcgcctctcctgtgtgctcccgtcgtgtgctgtcacacca

SEQ ID NO: 497447 - DNA, 345 bp, Homo sapiens
agaaacaaaaaggacaccataaaaaagaacaagaaataaaaaaaaaaaaaaaacaaaaaagtgttggaagcagtgtatgggatagatagttagatgaagtaattgaatgagagaagaggattagaaaagaaagaagaggaattaggtatatgggggatgatctaagtcaggccgaacagtattggcccatgtcaagtcatgggattgctcgcgatccgcacggtcggctccgtatcacctccgatgactcacgcggtcccatatcaacaatatccaatgcatctatacgaattataagtaccggcgccacaaaaaaacaaaccgaaaccactcataatcaaaacg

SEQ ID NO: 497448 - DNA, 205 bp, Homo sapiens
gcttctctttcttcccgggataccggctattcttctgcctcagggtaaccccgtctctgtgtatttaccggcgcccgcctctatgcccggtctgttatcttgtctttttagtatagacggggtatcaccacgttagccaggatggtactcgatactcctgacctacgttagagccaccgtagcccgagctggatataggaataaa

SEQ ID NO: 497449 - DNA, 185 bp, Homo sapiens
tcttctctctgagcatgcagaggagagtactcagcattgggatagatttatgtggtccagattttaaagcaattctgacttcaaatatatcccaaagagtacattttaaatgtaaatttaccacatttgatcaacaagtgttaaatgtgtaaatggcatacccgtgttgtattcagaataacgtc

SEQ ID NO: 497450 - DNA, 219 bp, Homo sapiens
  misc_feature (26)..(26): n is a, c, g, or t
ggaagattctaggtcagaacaaaaangcggtggatggtggaaaccgaccgcagccaccgcagccacgtatacccgcagactaggcgagaaccacgagtgtatgagcagtaacagaacgcggatccttcgcagaaagcgtattgaccagcgctcgcaaatttgcctcttgaccttgaaacgtccgcgccatccgctgcacgtgtacgaccagccagtcca

SEQ ID NO: 497451 - DNA, 372 bp, Homo sapiens
acagcatataattaataaacggctggatgaagactacaaaaggaagcaagaagcctaaagacaatgtacctggagcgaaacacaatacaaaaaggcccccagtaacggcagaaggtcatgctagccctcccctccgtgcggcaaatcaaagccacgatcgacaggttataagaccttcatggctcatcatgtggtccctatactcggaaaaaatgcccagccacgggtttttaacccacctgttgctcctgaggtagtcaatatatcaacagtcacaaacccaatggcaataaaagcactgaagatagctggcgcgagagacaccacacaccattttcagaaaacgttacaattaaatcttaccccgctgcc

SEQ ID NO: 497452 - DNA, 996 bp, Homo sapiens
acgcgtggattgagtattgttgcttaataggagatacaaagtctaccgagagagaattagcgtccaggaggcagcactataaactgccagtgcacctgatcagcgagctgggtgcctacacggcgagctctgtggtccctggcagtggtagaccctgtcacagtagcaaagccaggagccagccgtgtgccatcagttacaacccttgtaaatgcgcatgactgaagggacatggtatatccctttggtcaaggaagcaaccacattgataaaccattgtcaacgttgaccaaatgccaacaaaatatgtcgcataaggtcaaggtcccttgtcatcggggtgggaccgtactgatgacaaaagctccaattacgtgccaagcacatacactgatgtcctcaggagggactctgaggtgactcaggagcctccgtgcaactcgtttccaccatccggaatgggagctcccacgctgaggaggttgagtcccttaggggaccccatgccctgtgttataacccgacacaaatggatatgctagcccacgacgtactcagtggattgctgccataaatttaacacgcttcgcagtcgatagaactataaatttaaaatggggagttaacacaaccagaagctcccataaacctaaatatataaaaaactcctaggagttagttagctcttgggccgagatatgatcaattatcttatatagcgctggatccccctcattcagagcgcaggatggttattagggcaaacacttcattgcccgatagtggaagtagcctctttactatcatggtcctgtagtcgagaccattgcttgacctgttgggatggtcacgccccccatgagtggatcgtgcctggcttggaccaccagctgaccccgggtttgtcccgtgtaaatggtgaccgcatccaatggtgggggtcagtggatccttgcttactggcccctcctgtgaaggaactcacaagacccttgg

SEQ ID NO: 497453 - DNA, 413 bp, Homo sapiens
gataaaggagatgatgaatgagcacatgcaggacaaatcagaaaagcaatgtcatagaatgtattaattacgtccataagttatacttactatataccatgatacggctatacactctagaaaaactttgtccccaaaggaacttaaaatctgtaaagtgcctttaaggcttgaacagtattctttttccattacttttccaagtacccagggtcttctagatgcacccgaagctggtaagagatccaggacaggtagagactctgaatgtagaaaataataaagtaggactaacagtaaataacacataattgtcatggcgtacgtctaggatgatgagtaccaaatatcccaactgaaaatctctaatagctatcttatcagaaagccttaaagatactgaagacatgctc

SEQ ID NO: 497454 - DNA, 534 bp, Homo sapiens
  misc_feature (34)..(34): n is a, c, g, or t
  misc_feature (483)..(483): n is a, c, g, or t
  misc_feature (534)..(534): n is a, c, g, or t
aattcgcggccgcgtcgaccgacagaaggggctnggagaagagccatgaagacagtttttggtgttgagccagacttgaccagggaaggcggcagtattcccgtgaccttgacctttcaggaggccacgggcaagaacgtcatgctgctgcctgtggggtctgcggatgacggagcccactcccagaatgagctcaacaggtataactacatagagggaaccaagatgctggccgcgtacctgtatgaggtctcccagctgaaggactaggccaagccctctgtgtgccatctccaatgagaaggaatcctgccctcaacttcaacctttccaattgcccaggaatggagttccctctttccttccctctgtcagtcatccagacttagagaacagacacagtgtatccagtgttccacggtggagtaaccgttgggcttaagatgacctggatgacagtgagtcaacctgggtaagtctcanatggtcaggatggcttacctgcagaagataccaaggtcccacagttgcggn

SEQ ID NO: 497455 - DNA, 104 bp, Homo sapiens
  misc_feature (54)..(54): n is a, c, g, or t
  misc_feature (58)..(58): n is a, c, g, or t
ggttactcagggccttggtacctggatactgccacagaattgagttttgtggtngagnggcctatgggaaaataaaataactgttcaaagttgggggtttttta

SEQ ID NO: 497456 - DNA, 324 bp, Homo sapiens
  misc_feature (196)..(196): n is a, c, g, or t
  misc_feature (207)..(207): n is a, c, g, or t
  misc_feature (215)..(215): n is a, c, g, or t
  misc_feature (242)..(242): n is a, c, g, or t
  misc_feature (269)..(269): n is a, c, g, or t
ttcttcagcctcattggcattacctgagagctccacagtctcagagtacatggtgtatggggacttggcttccagagggtcgcgtccagggcttggccacattcagtgaaggagagggcggcatcagcataattcacagcttggccaaatttctcgaacagggcatcagcttggcgcttcagcttcttagcttctngcatgtaatantcagcatngtgaaccgagtcatcaaaagtgagctngggtctccggacattagtgctgctgcnggatagaaggggcagagccgcccaggaggccatctccaggtgacggctaggggta

SEQ ID NO: 497457 - DNA, 298 bp, Homo sapiens
  misc_feature (273)..(273): n is a, c, g, or t
  misc_feature (296)..(296): n is a, c, g, or t
ttgtggggtattactcaagacatctttgttcagtttaatttcctggagagtttcaccaatgttttttttagtagtttcatagtttgatgtcttagatttgtctctaatccgttttgatttaattttttttagatggcaagagatagaggtctagttttattcctctgaatatggatattcagtttttgtaacacaatttgttgaagagactcccccattatattgaggcaggaaaatagagtctgggaggcaggaaaacataagaccacttcnacacttcacctttccatagggcntg

SEQ ID NO: 497458 - DNA, 261 bp, Homo sapiens
tgtgttgagggatacatctgcgcttgcgtggggccgaatcttctctttagtgtcatcctctggcaccaggcctttggcctatagatagaataggtctcaatctagctcctggagtggtgatgttggactagggcagcctagctgtgtcctgggccatactgactgagtaggccatacccaggacaacttttcctctggcatctggatctcctcctacaccgatcttcttaccaatgggtgtttcctctacaccgaagatgt

SEQ ID NO: 497459 - DNA, 244 bp, Homo sapiens
ttgacatgggcacagaaattattctgtatacaccataatagtgaatacatgtcattatacatttgtccaaacccacagcatgtacacacgcagagagaaccctagtgtaaactatggactttaggtcatgatgtgtcaatatcggctcatcaactgtaacaaacataccactcttgtggggaatgctgatgataagggaggctgtccctatatggagaacatacatgggaaataactgtgccca

SEQ ID NO: 497460 - DNA, 395 bp, Homo sapiens
aagaggaagcaggtgttgtggctcatgcctataatccgcactttgggaggcaagacaggtggatcacctgaggtcaggagttcaagaccagcctgaccaacatgtgtgagaccccgtctctactaaaaatagaaaattagctgggtgtggtggcacatgcctgtaatcccagctacttgggaggctgaggtaggagaatcgtttgaacccaggatgcagaggttgcagtgagctgagatcgtgccactgcactccagcctgggtgacagagtgagatcccatctcaaaaaaaaaagggaactgtcattgatactgcttttggtccctagtgtaaggtcagtgtctctcaaccttggcgctactgacatctttgactagcatttgtcgggggggtc

SEQ ID NO: 497461 - DNA, 462 bp, Homo sapiens
  misc_feature (333)..(333): n is a, c, g, or t
  misc_feature (379)..(379): n is a, c, g, or t
  misc_feature (460)..(460): n is a, c, g, or t
atctttacttcactcagtgaccactcagaacaataacagctgccactcgcttcctgagcttaataacaatggctcaaccgttcacctcccggatgcttgtgacggaacagcttttagaaagttgttttgttttccctctccaaaagccatgttgcccggagatacgtgacagccaccgtcagggaccagggacttgagtcacaagtgtctcttctttagaactcaccggaatggctcagaccactggattttttcttccaaatcgggaaagaataatgaaagggtctatgagatagatattttctaactcttcacctaaacttgcatgcctgngagtgtggctgggcatggtggctcacgcctgtaatcccaacacttntgggaggctgaggcggtggatcacttgagcccaggcgtttgagaccagcctgggcaacatagtgccctatctctacagaantc

SEQ ID NO: 497462 - DNA, 132 bp, Homo sapiens
tatagggataaggaacgtaactagggatagaggaacgtaactagggatagcggaacgtaactagggatagaggaacgtacactagggatagaggaacgtacactaggagatagcaggacacgtacaactagg

SEQ ID NO: 497463 - DNA, 208 bp, Homo sapiens
  misc_feature (110)..(110): n is a, c, g, or t
  misc_feature (152)..(152): n is a, c, g, or t
agctgcataagagagacgcgatcagcaggagcgtgctgatgtctcggtgcatgtctcatcaggattgtgataagcttacagcgtcagtactgtctgtcatctctcggatngcagtgtccttgtctcggctgcttgcttgaatgttctcaggngtggagcttgtgaactgcattatctgcatagcagctgtgcgagtagactacacgta

SEQ ID NO: 497464 - DNA, 1164 bp, Homo sapiens
gacccagtacagtgagatgcctaaaatggtgcttgctaactgctctctcatgtgcagcaccaccatgctgttgttctgcatcaaccatcacactgctcactggccagcaacacacgatacatctcaatgcatgcagcacactggccagtgtccactttcgtcacatgcaaaaccactccattcaacacaccatcacacagtttatgcaccaaggaacacattatcatattgtatttggtctcaaccattgatcacaaagcttccaccttaatcacatcatcagccaccgtcgtcattccaatcctcgtgtggggttacaatcaaattggcaaacacaacacaattggtagcatccgaatcaatggtaaaaggtttaccgttgggagaagcattttcatattaaatgcagtcgtatttagtgaagagcaagtgggtagtgcaacacattggtatcgttcgttcagcagaataaattagttgttaaggcgtttgtttggaaatagatttcattggcatgaggttggacattggggacaaaattccaatttcccaaaattcgtggggattttggttacacatggcagagttggagcgtcccaatgggcgataacacagaggggcacccaaggatagactattattacaataccaccttgaaaacagtttacttccttggggaacaaaccggttataccacatttaacgaccaaaaaccattcggtcatacatagggtaactccttccccttgggcgtcattccttcattcacattcaacaggcaattacccgaaaaaggcgcgttaaaacagcagaaccacagtggacttgaatatgggcaaagacacggcaatagaaacagcttccctaagcccccccaaaggggcggaaccaaatcttctactactgggcaccaaatcttggggacacacaacgggggggcaattcacctcccgaaggccacagtaccaacgggtggctaccaccaattccaaaaaacaccatcggtggacccaacaattacaatcactcactcccaaaacagccagggggaaagtgaacgaataaccacataacatacacactaggggccccaacgacgcgatacagacacaggaaagagggaaaacactccacaacaccagcgaccagtagcacacgagggac

SEQ ID NO: 497465 - DNA, 1241 bp, Homo sapiens
tccctttccgcagtgctaggagatgcgcgcggcgcacaccgaaggactgatgttgtctcgtgctatgttgtcttttgccgccgattgttgatgtgttgctgtccctctcctcttttgtggttcttgtcgctcgtccgtcttcactatgggtgtgcctactccctgaagcgtcacacacgttgttgtgggccacacataattagcgggtttccggctgtgccagaggttctttccccctctggtctcccctctctatgttgtaggtgttttccctccccgtggcccgatatccccggggtgaactcaggggcaaccatcgggcgccctcttggccccctcccgcagatgggattcccagccgggtgtcccgccgtgcgggcccctcgctgtgtgcccccgccaatggctctttagcggactcaccagatgcgttagcatttcctcgcatgggttaaattgggaattgacatttgccccccggcgcaaggcaccccccctcatgctacctcccgaactggaataagccttcgaaagaaattgtcccgaagcttgtatctgatatccgcacctggattttagaacttgttcctcgatttggaccctgtattgaagttaactgttccccctggtatttgtttaataaccccggacatatctttgagttccaacctttagtacctgtggcttggtcacttcgtggcctaaggtaagtaacagtgtcttgctggagagcaccaagtctctggtggccttggtgagtcctgtgtggccccgccagccttcttgaatcttcgtcgcccgggctacttaacggtgctccagggcttgaggtgttcttgggactttctctttatgaggctctggccagagaccccgttgttttctgtcttcgcggcgtctcgtcacgggttggaaccgtcccacccgttggagcccacctttcctttttctagctgagtgtcctttggcccggaccccctgggctgttaacttgctttgaggttggagatccggtcttgcactttaacgcctgtaaaatgtagtttcacttgcttaaattataatgataacggtcttgtttgttgtagcgcacacttcctcgattcttctgaatgagatgacccacccaatcttctggttctctacctgcttatgtcgagaaccacttatggcccaccaggccacaccgtccattgatgtacagagaaaaataaaagtgctgccgtttaaataaaaataaa

SEQ ID NO: 497466 - DNA, 545 bp, Homo sapiens
caaaataataaaagaaagttctaggatagaagaggaaatcacaccagatagaaattctgatacccaaaaagaaataaagaacataaagagcatatagaaatcatatgggcaaattaaaatttgtatataaaagtttgcttttatactatatataatatatcctctttttctataaaagagacaggttattctctagtcatactaggctggagtagcagtgtcacaatctacggctcactgcaacctactgaccctgggatacaagcgatcctcccacctacagccacccaagtaagctaggaaccacgggcatgcaccaacaggcctaggtaatttaattttaaattataaataaagacaggatataaaccatagctaggaccaggctgatactatgaactcctgagctacaagcgatagcacctagtcttggtctcccaaagtcctgggaattacagacatagagccactatgcctgagccatactaacctctttaacttataaaacaggtctactctatcccaaaagcctgatgtgatttcct

SEQ ID NO: 497467 - DNA, 446 bp, Homo sapiens
ttacctccaggccaggccagagactgtctctctccaggccagggcaggacccctctcccagacccctaccccactctgccttggaacccagaaggtgttgacggcctcgctaaccacaggcagactgccctggctccagccatcacctcccccaacttctctggacccctgacacggccgctggctgcccggggtcagggcttggtacccaggatctattagccaggcagctgtcgggatttccagcacggggggacctctggggctgacacctctgtcagcatctctcttgtctggaatctgctggccaagtctgcactcttctggggtctatgtctggaccctagagcatctgccatgagaaaaaaggacacagcaggaaacaggtggccttggggtggcttgaggcagaagaccagcacaggccttgaggatgtgccttgagc

SEQ ID NO: 497468 - DNA, 170 bp, Homo sapiens
tagtgctccagccgtcctattcttgcacgaaaggggatccaacaaccccctaggaattacacctcccattccgataagatcgtcttccacgcttactacacaatcaaagacgccctcggtctacgtctcttcctactctccttagtgacacttgcaatcaggggctctca

SEQ ID NO: 497469 - DNA, 126 bp, Homo sapiens
ctggcgggaaacactgactaaagggtcagcaagcgctcggcgaggcgaccgttggccgccagttcgagaaactcgtcgcccaggcggcggctttcgtccatcgccgcgtgccagtatttctgccgg

SEQ ID NO: 497470 - DNA, 725 bp, Homo sapiens
  misc_feature (725)..(725): n is a, c, g, or t
cctaggctgacagctacgcttgcaggcatggcttgaggcccagtaggactgaggacaccgcataccataggagcagttaaggcatgtcccatggcggttacccatagatgcttaccgagtggcccatcactgtattaatgcaggtactaattgactacagtttaacgagggacacatcttaggatgatgagctacgactacgggcaagaagactgcactagctgacgattagcgttatgtgcataggtacgcaagcgcataacgtccttcgccttgatggaagttatgattgctgaagagagaactggaagcaggcctgcagcagacactgttactaataatggtagatgctgtgaagtagcgtaggagatgtactaaggacattgatatgaagcgtgctatgctgacataccgacgactgctagaagcccatcagactggacatatctgttaccagtactctgtcaccagtagctatgtcatgaggagtatcagtctggcatgtatgcctaagagtatcaatggctgcagacctttctgctgagcttcataaacaggcagaggtgtgaactagctagcaagattcatggtcatgctttaaagaggtttttaacctttttacctcccttctttagcttcgcatgcatttatactactgctatcaatctctccacttcctaactcctttacatagtcctggtctacactctgactccttcattggn

SEQ ID NO: 497471 - DNA, 282 bp, Homo sapiens
gtgtctagaatcggagagcagtcggcgtcatccactcagtgtatcactctaactggttctcggtggcgctccggggcacagtgctcatggggcacatggtcatcgctcttcagtgttttgatgtctgcacttggttgcttctcatctcttaaaccttaacatgcaggatcctcatctgcttcacaatggtgcttttacccagatttctctcaggcaccccagacagacagccaggcggtgcgtggccccgtagacctgcctgccggacgagacctggctgcg

SEQ ID NO: 497472 - DNA, 382 bp, Homo sapiens
cgttccctacaagacgcctttcgtcgacaatagtacttcaccccatccatccccacagcaccatcgagttcagctgcggggaaagagacggggtcgcacagaccactcgaactacccgctcaatccgcatacctccttagacggaaccaacaatccccccccccttaggcctttgcgtccgtcactatagcactaccgccaagcgatatccccgctctctacaatattactatatctccttccttaagctcgagtcgcgtcggggcccgaatcaaaagttacacgcggaacaccgatacgcgcaagaagtatccctagaacgccgcttctcccaagaaacgacctcctaaaacattagcccccaccttcctcaggctccgtg

SEQ ID NO: 497473 - DNA, 175 bp, Homo sapiens
atagcatcatctcaattatgtatctaatgggcagcaagttcccacagcacgctatcctgaaaggagtttcgtatgcagcctcgaccggcactccaatttccccgccaagaggcggggagcgtccgcggccgacacagcttactattccgagaggacttagcagggcgcgacgcat

SEQ ID NO: 497474 - DNA, 1293 bp, Homo sapiens
  misc_feature (197)..(197): n is a, c, g, or t
  misc_feature (353)..(353): n is a, c, g, or t
tcatgcggctgttccagaagagcgatgacatccagagccggtggaggtcttgactgactcttggcaagcgtggtacaggaccaagctgaaaaacgtggggatgccgtcttgtggtcgtacttgtggccgagcgtcgcgcagccggacgctgtatcaccgagagaagtgtagggattatgagcccgtggatctgaggntgacagagtgcgctcttggaggacctgtgatccactgatggagaggagagggctgaagagtgctctaggacaaacgatctgaacgagtcttactcaaggtacctgtagtccgtgaggtacatgccaagagcaggaatttgtaacattaaaccatgnactgcccttcattaattaccttgccaaatttcattctcgtaattcatgagggcacccacatgtgttgagtaccccttctactccgggtggtccgacagcgtcaccaagggcaaagctacgggtaggacctcgtcctttgggttgacacaattgggtagggaaaaggtcggtacattaattccaaaaagcccgtatcccttggaagcagttcgcttgcttcgcgaccatagtcagagacgacctgggactcccaagagatgatcagcactttcgcagggtactgcattggaaccacagttgtggtttgtgagaccatttcactcttggaaaggaattgttcccgaaacaggacttctttccgttggagagagggaaaatgactcaaagtatagggcaactagcaacaatatgtgttgttgcttccttcgcgagagggccaaatttacctggtaagccgagctttgtgcgaaattgcaagacttgatcctatgtcggcaccaaagtcctaattagaggtgggcgtgggccaccagaacgagaagggttagtaacaaggccccacgccaagggaagggggaggattgaattaggtctttggggtacaccccgtccaaataactgctaaaaacggttgggcgggtcttgggagcccacgcctaaaagaggtctccctaggggggcggccctaagtaggccgaaatccgttgggcctgtttttggccttagctaccaagttcaaggaacgcgaccaagtcggtttggcctagttttttacacccagggcgggaaaacaagagcggtggcgccaaatcctttgtaccttggctacactcgcctggggggcatcttggggaatttgtgcgccagcgttccacggggttcaacgtttggctggttttgccgacacttttgggaacaatccccatatccgtataaacct

SEQ ID NO: 497475 - DNA, 195 bp, Homo sapiens
  misc_feature (6)..(6): n is a, c, g, or t
aggcantgtccgtcccgggacctacgcagctgccatggaagctccgggtttcgcaggagactggaataagatcggaataattccaacagatgctccaaccatccctcatggaccacacgcactcttggatgctgaagagcaggctggggtctggggcagcctttaggggctcttgggaccccaaaggtgtccagc

SEQ ID NO: 497476 - DNA, 1093 bp, Homo sapiens
gtcgcagccgccggaagctactgcaaggcaacaagccggagctggacgtgtcttcttgaacactgctgctctttcacttctcaggcgtcaccgagcagctcagcacccaggcctgaactctgtaccattaggcacagaatggaagctgatgcatctgttgcacactgttttccaaagctcctggacgcatcagactgactatcagaactaccaacactggtggaagaaccattgggacttctgacacattccaacaacctggatcaagactggatgcaggattcgccctttggacacagccttacacgaacaaagcagactcccacggacactacagtgcacacgctcacaacacacgcagaaaccaacgacactggacttccctatacgggaaccatggggcaaatcacacgaggtaaacttccacttagtgtgacaccgcacgcacttagcgttcccacagcaaagctcaacacggacacacggtgcaacacttggtgggattatgcccacttagctagcaggagccacctaccaccactttccaaggctgctaacaactaccgtaggaccagaacccaattctgcgccacaattaacttggggtcccaaaggaaaaaacgacccctccgaatgaccccacaaatctcgagtgcaccgcgtgtgaacttggtggcgacacaaacagcaacacctatacgccatttagggacagcgcactcaccgtggcgtcaactcacacaagggtaagttttcgcacagcagacaatacgcacaacctcggccctacaccactaagtacaatggggctaaacaaacacacacaacacgacacgatcaatgcctacggatcgggggcatctattaccccgtagaaagcccttatgaggatcagacctttaccacaaatttgtcacgtgtctcaacccccactcacaagacacacacgctttacagcacaaactgatgcaacagaactatcacgagagtgacactctctagtgcagccattgccgctacacaactcatacacaccagctaggtgggtaaccaactatgtaccagccgggcacgacccccaccacgactgtgt

SEQ ID NO: 497477 - DNA, 544 bp, Homo sapiens
  misc_feature (8)..(8): n is a, c, g, or t
  misc_feature (16)..(16): n is a, c, g, or t
  misc_feature (54)..(54): n is a, c, g, or t
  misc_feature (169)..(169): n is a, c, g, or t
  misc_feature (227)..(227): n is a, c, g, or t
  misc_feature (271)..(271): n is a, c, g, or t
  misc_feature (463)..(463): n is a, c, g, or t
  misc_feature (499)..(499): n is a, c, g, or t
cggggaantggagcgngccggcggtgcagtcacgggggagcgaggcctgctggnttggaacgagggactcggcctcggagcgacccagaccacacagacactgggtcaaggagtaagcagaggataaacaactggaaggagagcaagcacaaagtcatcatggcttcangtctgctccgtggaaaccaagataaagatgcccattttccaccaccaagcaagcaganctgttgttttgtccaaaatcaaaactgcacatccacaagagcangagatctcaaaagattaatgcgaagaattgtcaaggaagaaagtttcctggaagagaagctcttgcctttttctcttgtaagcatgctttgtcacccagggactaagtctaccaaggttattttgggcagctaattctaagatttgggatcattgcccaaagtttgcacgcactgcctcccttacctgtgangaatgcaaaattaaagcatggattaaagttgagaanggagactctcagccttcagcttcccaaattccggtgtccgtgact

SEQ ID NO: 497478 - DNA, 825 bp, Homo sapiens
cgaggcgaggctcccaaccgggtgaattaactcctgggaagccgcaagccgtgtagaaacaacagagggccggtggaaaaccgggtgtacaagaacttcaccacttcttatgggagaacagggaccccccgggaagaccttttcgacaggctgaccacggcccagcctggacaagcacccccaggacctatggacgggctgacgcccacaggtgttccggacctacaaccctccattcactctgcaggagcccactcgggcccctacgcgcccgaggacacgcatagccctaagatcttatcctcaaccgagccaaccgatcgtgccattctcggcaaccatcagcgagccacccccagtacgttcgagaagtcgatgcagaatctcccgacgaagatcccggcccagaaggacaggtggctgaggcccgggcagaacttgaggagggcgagggctgagcaccaagcccacaggggatggcaagtcccggagtgtcctggagaagaagaggcggctcctggagaactgcaggagcaactggcgcagctgagtgtgcaggcccggacaaggaggagaaccagccggtggccctgggcacgtcccagctcaactacctggacccccggatcagccttgcctggtgcaaacggttcagggtgcccgtggagaagatctacagccaacccagcgggagaggttcgcctgggctctcgccactggcaggagaagactttgaattctaacgacgagccgtgttgaaacttcttttgtaagtgtgtgtgtttttttcactattaaagccgtactgggggattttgtaccata

SEQ ID NO: 497479 - DNA, 1837 bp, Homo sapiens
  misc_feature (900)..(900): n is a, c, g, or t
aaaaaaaaaaaaagaggaagaaaatcttaagtgatgggatgctgttttcttttaaaaaaaaaaaaataaaattcattttcttggggttagagctagaagaaaaggccccaaagcttctaatgggtttcttctaaattcttatattggcttaaaagtcatggagttatggtccacttaacccggggcttctggtttcactggtggtcaatctaaacatggggtaagtaactggtttacaccttaaattacacctcaatggggcatgtgtgtgtcaaagggcctattattggagttcaatatctccatattataatggtgttctcaaaatcttggttcaaaaagctccaaaaatttttgggggcctatattgggtaatatggccatgtggtggacacattaaaacgctattttgggtgtcacacaacccaaaggccttttggtaataaactaaaacactggggaaaacacacacaaaaggcggtgtgtaacaatttaacccatcgtgggtgatccgtgaggaaatcctggaggccaaggtccaaagacacacatgcttttttgtcagaggaaaactcttctgtgcggtgaggtgggactctcccctataatattgtttttcatttcagaacagaggtgtggggaccagggggacaagtggccaccactttaaagattttctccacaccacagagggttctcccacaagagacaaatagtgggcgtacttcaccagagcacaattaatatttttcgggagcatatggaccacctggtgggttctcattgggggtcaccacaatatacccaacacgccaggggggtcaatattgagcgcaccctttcatcatagcacatcatatcgggcatacaggctccactgtggccgaggccacacctttncaacaagacggtgtgtggggcaaaaacatattaaatagcgacacaccacataccttgttgtgtggtggcacccacaaataacacaaggaaatgtgtgcccccaatttatgtcaaaaacaatttttttctccagggacaaacgttggggttaacgaacaagcccccaaccaatttttactatccagtagtttaaacccgcatgcgagaggaggacccttacaataatacaccgtgtcggtatcaacacttatcttcgagggagcggaggaatatgcaaacaccgactgttaatgtttgatatgatgggaaagccacggcgatgaacaggcggcgatggcggacaacttaacgatagtagcgcagaactggagctaaccatttatagaacaatgagcacacagggggcttcatatatagaaacatttatcacgagtttgagacacagacattaagtatcaaaaaagattactccacccttgtgcaacattgttgaattctattcgacagacgggcgttacatggcgaaaaaacgatgtctccttttgctcgcgacgaaacaaacgtatacaacaggtggataacaaggggctcactgttgggatcactgagtgtatacacccaccacctttgtgtctgtggtgaaacgagtgttaaaaacaaccattataccctacgcccgtgagaaattactaaaccattaccatcagtggtagagaactatttactaccaggtatatagctagcgattattacttaatatgcttccacaagagaatcaaccactagtgacggtctgtaatagaaacacattaaggtcggtattagttagttataccaacaggcatactcacaaccatagacgattatagtaagcaaacagaagatacaacacactattcgattcaagcagagcaacagactaatttgtacgtcgaca

SEQ ID NO: 497480 - DNA, 115 bp, Homo sapiens
ctgattctgaacatcgtcgtgttgactccgatcaatgggcggttgtgcaaccgcggcgtggttgccggcctgttcggttgcacgatacggtgtcggtcttcgcgctcgaccgtgg

SEQ ID NO: 497481 - DNA, 139 bp, Homo sapiens
gtgatatgagttggaggtaggatgcagtccagagcctcaagcagcgtggatccactggcattgccatccttacgggtgactttccagtcccttgaaccaaagcatgttagcactcggctccagctcatatcaatacatt

SEQ ID NO: 497482 - DNA, 89 bp, Homo sapiens
aggatcccactgtaaaattggaaatgggcagttctgaattatcacgcctgaaatgtaaaatataaacttcagtcaataaaaaaaaaaaa

SEQ ID NO: 497483 - DNA, 181 bp, Homo sapiens
cccctttttgaaaatccctcaaaggtgttcaacagggaatgatccctcccctccttttgacagggtgggatcctcctcctgaggtttaggggttcccttctccctgccctgtgaaaatttgaaagcccatatttaggacaagtattagaaagttttcatacttcaggaaaggattttagga

SEQ ID NO: 497484 - DNA, 145 bp, Homo sapiens
ctgctcatggtcccaacccagggtactgtgagagccagcatccaaccccccgcttgcagtgactcagaatgataattattatggctgtttatcgatgcttcccccagtgtggtagaaagttttgaataaacccttttgccttcca

SEQ ID NO: 497485 - DNA, 567 bp, Homo sapiens
gagacaccaccagcaaattgcaaattccaatggcagctagatttttcacccgatctatgcaatcaaggtaaagcttttagaagttgattctgtctagagtgactcattagacatgatcgtgaatgctcttgcaaattcagtttaaaagttcagcacgaaggcaaaattgtttgtttttgcagtgatgatagacacagaaattctgtggtaaaagcaatgttctcattaaagtcagacaccaaatggggtagagacgagcttgtggtgacgctcacagaattcataactgcggctgtgaccaggtggcaaagcagaggctgtggttattcacctttgccactgtcttccggtgtgcccagtcacaggagctgcacggcaatgcatctgagaccatgcggtgtcaccttcacagaagtgctctggcacagagactcccaccttgcgggcctctcgcctcccaagcacagaagcctccagaacgctgcttcaaggacaagcccaggagacctgccatgctcatgcgtgtctttggcaacaggttctctaaattttgccagtggtttgtta

SEQ ID NO: 497486 - DNA, 330 bp, Homo sapiens
aaagctgaatattccatcctctcgtgatcaagtggagaggcaatagacagagttgggtggcaaggagtattgtatatggcaggacacagaactgcatgacatgctgggaaaaagagaggccatgtgcctcctcccaccaagttcctatggagaagctgcctcttagattacctgactttggtctgactgtgaaagtagttaatttttaggactataaattgtactttcagcctttgtagcctcagctgttaagaacagatatcttattcaggtagcattctcttatgtgtgaatactcgtgaaaaatcaagatatggcactgccctctca

SEQ ID NO: 497487 - DNA, 367 bp, Homo sapiens
  misc_feature (78)..(78): n is a, c, g, or t
  misc_feature (152)..(153): n is a, c, g, or t
  misc_feature (203)..(203): n is a, c, g, or t
  misc_feature (218)..(218): n is a, c, g, or t
  misc_feature (324)..(324): n is a, c, g, or t
ctctgtgccaggctgagtgagtggagatctcggccactgcacctccgcctcccgggtcaagcaattctcctgcctcangctccgagtagctgggactacaggcatgtgcaccatacccagctaatttttgtatttttagtaaagagatgganngctttgccatgtttggcccaaggtcttggtcttcaaaacttttcctgacncctcaggtgatccancatgccttggcctccctaagtgctgggattacaggcatgagccaccatgccctaccaatgttaagttttctagtagccatattaaaagaagtaaaaagaaatgggntcgaagttaattttatataatatattttatttaacccaatata

SEQ ID NO: 497488 - DNA, 212 bp, Homo sapiens
  misc_feature (2)..(2): n is a, c, g, or t
  misc_feature (20)..(20): n is a, c, g, or t
  misc_feature (46)..(46): n is a, c, g, or t
  misc_feature (50)..(50): n is a, c, g, or t
  misc_feature (63)..(63): n is a, c, g, or t
  misc_feature (66)..(66): n is a, c, g, or t
  misc_feature (69)..(69): n is a, c, g, or t
  misc_feature (101)..(102): n is a, c, g, or t
  misc_feature (121)..(122): n is a, c, g, or t
  misc_feature (166)..(166): n is a, c, g, or t
  misc_feature (176)..(176): n is a, c, g, or t
  misc_feature (196)..(196): n is a, c, g, or t
cngcggcccattgcccagtngcactcgctgcggcccccggaccganttangctgctgctgctnccngantcccaccccaagcccccggccaagtctggtannctagcccctgtccccagtnncccgtgaccggccaaagccaagtccagtccccacccttatgtgngcctctgtgnggtgaccccccccccacctnccaccccaaccatctg

SEQ ID NO: 497489 - DNA, 330 bp, Homo sapiens
gccttaggaggctgcagtgcacatgcaatagaaacagtttataattttttaagtaacagaatacttagctgaaccttctactcacttttttaggtcttgatggtcctttggaaagccatcccttgttcggcttcagtccaaggttttgatggcaatggtactgatcctacttctgagctccagagttaaatataagacctaggcctgacaagaatgttccatccttttggccaccagacgactccggggtatggacaaatgacagaagtcagtaataagagatgccatgttgggacttaagtggaactattagagaagaaagattccctt

SEQ ID NO: 497490 - DNA, 106 bp, Homo sapiens
attaccataactattgctaaccgcgatggcacccgctatgtccagagaggagaatacagaacgaatcctgaagacatctacgccagcaaccctactgatgatgacg

SEQ ID NO: 497491 - DNA, 332 bp, Homo sapiens
attcgagctcggttccctgaaagacatcagaatgtagagaggcaatactgtgtaaaaatgaaaaacaaaataaaaaactttatttctattttcccaggctgcacaaatctggctttgatgaagaaactcagaagatcctgatgtctgtggaagaaaaaattccccatctgaccatttcacatggaccttggattgacgaggaatacaagatcaggggtgtgctcctctgatggggaacaccctgaagtagtcgtctcacaaaggctttccttggccacagtgggaccttcacctggcacctctatcctgtaattgcacatcatggcagcagg

SEQ ID NO: 497492 - DNA, 484 bp, Homo sapiens
aagtgtcagagcaagaccctgtctctttatttaaaaagcagggtgaggggcaggcgacgaaattatatagacatatgactaaatccaaaaaagaaaaaaatagtaaaaaggactaaaaaatttaacaaaatgttaacagcagttatttagttcggaatagattttttttcctgctttttctattttgcaagttttttgcaaagatgatgacgtactttgatgattaagagaaaaacagggaccaggcgcggtggctcatgcctgtaatcccagcactttgggaggccagggcgggcagatcacctgagatcggaagttccagaccagcttggctaacatggtgaaacccggtctcaactaaaaatacaaaaattagccaggtgtaatggcgggtgcctgtaatcccaactacttgagaggctgaggcacgagactcgcttgaacccaggaggcggaggttgcagtgagctgagattgtgccact

SEQ ID NO: 497493 - DNA, 558 bp, Homo sapiens
ctcccgtgctctccagaaatcccagccatagtaaaaagaatctgttttttgaggtggagtctcgctctcgcccaggctggagtacagaggttgctgtgagctgagatggtgccactgcactccagcctgggtgacagaccgagactcggtctgaaaaaagaaaaaaggccaggtgtggtggctcacgcctgtaatcccagcactttgggaggcagaggcgggcggatcacaaggtcaggagttcgagaccggctaatataaaaattggccagggtggtggcgggtgcctgtgatcccagctacttgggaggctgaggcaggagaattgcttgagcccgggaggcggcggttgcagtgagctgagattgcatcactgcactccaacctgggagacagatcctgactccatctccaaaaaaaaaaaaaccggggaaacagtctctctagtagggtgggaggaagggggctgaatccagagaccgggaccagtgagggggttaacaaaagaaaaaaatccactttctcatgaataaacccccaaagttcggtccttcaaag

SEQ ID NO: 497494 - DNA, 191 bp, Homo sapiens
atcgtgagagagaactgcagaaggaaacctgtctctaaaaacaaggtccagctaaaatcagtggtccagctccaccacaagcgcagttcctggcgctgttgagtttatgcctctaccattccaatgtagtctctgctccatgaccaagtcccaccactctggacagtcatgtccagtccaaaccacatgtc

SEQ ID NO: 497495 - DNA, 87 bp, Homo sapiens
  misc_feature (11)..(11): n is a, c, g, or t
  misc_feature (15)..(15): n is a, c, g, or t
attgtacagcnaagnttccgccagctcgccgctcgctatggcgtcgctcaccgtgaaggcctaccttctgggcaaggaggacgcggc

SEQ ID NO: 497496 - DNA, 928 bp, Homo sapiens
  misc_feature (1)..(1): n is a, c, g, or t
nctacatgacaaaaaaagaccaaaagaaacagaaaagcaaacatctatccctccctctcatctgttcctcgagttgcgtctttctccttttctgacaacgcccggtggccgtattttttctcaacgctctcgcctaaaacttttcccgcctgacatatatcaattcgggtttgatgttcccgtaattctcagtactcttatatcgtatttgcctgtccaccatcaagggatgttggcgaccacagggtggccatgtttaatagtcctcagcagctcttgcatgtaaccttcgtgcccaaactctgggcctgattctaattccaaccaatttttcttcccccgccagaaggccccgttaagattaatataaaggggggacaccccaaaagaggacctgccccactctgtaggccccgtcccgaagacatttctatctgttgtcattaatcccggttagggtgaactcttccttttttagagacgccaaactcacgctgcttggccatccagcgcccttaatctccctgtgagctcttcttctgccactgctgagaacgccctcctgtaaaaagcgatattttcggaatttcccggggattaaacctgcagtaagcttcttcccgcggggggacgccaccacctattgtcggataggttcccccttgggggagtagatcccctgccccatcttggtgatcctcgcgttatgaccacgctataatttttttcttactcccgcacgtcggttgctatacgccgacggaacggtcccactcccccctcttgataacagggataagatgtgggctttctgtcatcaagaaaaataactccttctttcttattagagacatagtatagtatttgggggcaacccaacttcctaattgcaaaccaaaaaaaaacccatttaacaacccacataaca

SEQ ID NO: 497497 - DNA, 277 bp, Homo sapiens
tatgggcttgggtgagggaggtaggtggtagttggtgttataatattttaagtggggtgatgaggaatagtgtaaggagtatgggggtaattatggggggccatacgggagctatttagtgggggcatcccggataggccgagaaagtgttgtggagaaagaacagttagatatacgccgatgaatatgatagtgaaatggataagggagtaggaacggcctagggtgtagcctgagaataggggaaatcagagcatgaagccatccaattgcatga

SEQ ID NO: 497498 - DNA, 673 bp, Homo sapiens
gaggctgcagcgccggatcgtgcgggtaggcgtctgcgctcggttgagggctcgggcggggtttcctgtgccttcttctgtcgcggttgcagctcgggattcgggctgacccaggtccccatggcttcagaagagctatagaaggatctagaagaggtaaaggtgtcgctggaaaaggctagtaggaaaggagtacgtgatgccgcttacagtggaaaaatcgcaagattgagacaagaaatcagatggaaataatgatgcaaagaaatcgcagaagaaagcagaagtgcttgataatgaaagaacctagtgtgtggtttgtcgcattacaaagggggtatagggtgaaaatcagtaattatgggatgggatcagtcagataggttgggtgaaaatctacattagcttaatggagttcagtcaagttcccactgagaatgtgcggtgcatgtcacagagaggtcatttgatctttgggtaaagaatctaaatgggaagagttacttccatgatttgtgaaggatctctgtgaaaccattctctgtggaaggcagttcagaaaaagtcaagactgatcccgttcttatatggtgtagaacgaaaggggcaccacaggggggttcctgaccaggttgaaaggggtgtagaaaagagaagctttatgacttgaaag

SEQ ID NO: 497499 - DNA, 123 bp, Homo sapiens
attgttgttcgttgagcttggactgaggcgtgagggttggattctccaacgaggccagaggtggtggagcgggcaggtgagagtgttgtgcctgttgagcctgagctgctgggaaaggtagtt

SEQ ID NO: 497500 - DNA, 439 bp, Homo sapiens
cagaagaggcaaggataaaaaaagggaacaggacagagaagtagatcacaaggacagaaagaggggtggaagtgggaaagaagagcaaagagagagaaaaagaatgagaagggagcacaaagaaaaggtgaggaagaagagaaacagagagaactggaaaaagagatatgcaaagaagagaagaagggagagaagaagtgtaagaagggtagaagaagaaaaggagagaaacaataagtgcaggaaggaatggaaaaaggaaggaaggaggaaaaaaaggaggaaaacagagagagaaaagaagagaagagagataaggaaagagaaggaagacgagaggaaaaagaggatcactgtagatagatatatatatatatatatatatatatatatatatatatatatatatatatatatcacctagtgccgaattcctgca

SEQ ID NO: 497501 - DNA, 1161 bp, Homo sapiens
  misc_feature (206)..(206): n is a, c, g, or t
  misc_feature (212)..(212): n is a, c, g, or t
ttgttcgggaagatctcaattccccgctggaatgaggtaatggaggtgatcgtcacatcagttccaggacgaatgagctagaggttgaagtctttgacaagggtacttggacaacggatgattgtatctgggcacgtgtgtacaaggtgacgtcgtcagcacacatgctacttaagagcacgttggcttcctgtgaatgcagtggntgaccnctggacggactgtctccatactggcctgcctgtcacttcgcgccgtggcaagtcgggtctcaacctcaccgttccgcgaacgtagcgtgtcgtgacgtttaggacgtgacgtgtgcgtggacacggctcgtacatacgttggattccaagggatcgtctaggaaagcatggttgccggaggactcgggccgtggtccgagcccccatgtcctagtgcacattgctagtactcgcgaggacgcgtgccaagaggagacacgtccctcgtcgtcgcgtaataaggcatccaaacgcatcactcaaaggcccctttcatggctaacctcctcaacgtggatgtgagacctagtaagctgtcctacattaaataaccgcaaatgaccgtaatgtgaccgcatggaacttttcacgggccacattgtccgtagcgggcacttggaggaaggatagcgctccccctattcctttccaaatcgacgaggagcatacgccaacgatcatcgtcgaagaacggcccttaacgacagctcttgcgagcgtgctttccggaggtgattgcacgggggtcacattgagcctggttgccctgggtcgcttcgattgtattccgcgtgggcctgccctttgcgtccacgggaggccttcgcttccggatgtgcccttggtagccccaaggcggtcctgcattttggggacaccctggtcctgcgtgttttagcgagcgttccggggacagcgtcatggacattccaaagagtggtgcctatcggtggttggccattatctttgaaagaaagcccaacccatgcacttaaggggcacttcccatgtggtcttgtttccccccaagccatctttcatatgtcaaagttgggcgacacggtcgtccaattaatggccactctgagactttcctggctcacacaaggcattccatcaaattcggctg

SEQ ID NO: 497502 - DNA, 133 bp, Homo sapiens
atcatgagtctcacagtaagagttctgagtgtcaatcagttgtgttggttttctccgcaagggaagacgttcccataactggagcaactgttcaccaacctgaggttctagttcctgcccatccctgcttatc

SEQ ID NO: 497503 - DNA, 149 bp, Homo sapiens
cttgattggggcatctactcctgcatctaatttggaagcgccaccctagcattatcatccattaaccttccctctacacttatcatcttcacgattctaattctactgactatcctacaaatcgctgtctcctgcaatcgagcctggaa

SEQ ID NO: 497504 - DNA, 313 bp, Homo sapiens
  misc_feature (43)..(43): n is a, c, g, or t
  misc_feature (48)..(48): n is a, c, g, or t
  misc_feature (54)..(54): n is a, c, g, or t
  misc_feature (56)..(56): n is a, c, g, or t
  misc_feature (62)..(62): n is a, c, g, or t
  misc_feature (85)..(85): n is a, c, g, or t
  misc_feature (88)..(88): n is a, c, g, or t
  misc_feature (103)..(103): n is a, c, g, or t
  misc_feature (105)..(105): n is a, c, g, or t
  misc_feature (114)..(114): n is a, c, g, or t
  misc_feature (119)..(119): n is a, c, g, or t
  misc_feature (126)..(126): n is a, c, g, or t
  misc_feature (148)..(148): n is a, c, g, or t
  misc_feature (159)..(159): n is a, c, g, or t
  misc_feature (162)..(162): n is a, c, g, or t
  misc_feature (184)..(184): n is a, c, g, or t
  misc_feature (208)..(209): n is a, c, g, or t
  misc_feature (260)..(260): n is a, c, g, or t
  misc_feature (263)..(263): n is a, c, g, or t
  misc_feature (286)..(286): n is a, c, g, or t
gggagtcatcaaggacaaatacggcaaggatgccaccaatgtnggggntgaagntngctttnccccaatatcctggagaacagtnaanccttggagctggtgnangaagccatngacanggcttgntacacggataagatcgttattngcatggatgtngcngtctcagagttttatcgtgatngcaaatatgacttggacttcaagnnctcccactgagtcctgtcccgagtacatcacgtggggaccagactgggggnacntcgtaccagggacgtgtgtcagngcacgtagtccgtggtgggtcgtccat

SEQ ID NO: 497505 - DNA, 127 bp, Homo sapiens
ggtccactgatgggcataaacatgcatctccatgtgcttcacttgtattttcctgattactggagagaatgaacatcttttttattgttattggctaagctggtatcctcttctgtattgcctatgt

SEQ ID NO: 497506 - DNA, 831 bp, Homo sapiens
  misc_feature (63)..(63): n is a, c, g, or t
  misc_feature (90)..(90): n is a, c, g, or t
  misc_feature (103)..(103): n is a, c, g, or t
  misc_feature (106)..(106): n is a, c, g, or t
  misc_feature (442)..(442): n is a, c, g, or t
gactccctctttccctccctcctcctccgtccgcccgtccgtccgcgcgtctgtccgttcggnccggtccggcccgaagcatggcctggngtcagcttcagcngtnccaccggccttggtatgtctgctggtcggcttatctgaatcgaagagtgatccggaagcaggatgagcagtcgagctcgatgtggagtcatcttgataccaccagtatgaataagaattgtggcatccgaattgtacccatccacatgactctgccagacactcagcggaagaacgcgcgcggcctgtgcagtggagcgtattcggggacacctgttgattgaaccctacgagagcgtgcatagtacttcggcattcattgccagcttgtcgcaacggacttcgccccatagactttgcttcttgcacgaaacaataacagtcgcatacaatctanaactttgtggttggaagcagaacgcattcgtgccattgattgcctctgttcacagtggcggcattagttagctaattgcccaggcagttgcgctttccctcgtgttggcatcgataggttcatatcccatgtggtttgtgctcgacccgtatagagatccgcttggacacttgcttaagcccatgccgctgtgggactaccgtacccaataaggcacttgcctggtgagttgcgcaaatccacgcgcgccctaggctatgggcctccgtcttaaagacacgctggccttgcgcatgcagaaactctctcccttatggccccattggttgcctttgccttccatgcaaattggctagcgctttgcggcaagttagagtattgcgcatgca

SEQ ID NO: 497507 - DNA, 174 bp, Homo sapiens
  misc_feature (138)..(138): n is a, c, g, or t
atcgtgtgtttgcagctgcatgtttccagttcctgcaagtcaactatggtctccacacattttctcaaggtccaggttcattgacttcagggttgtcatcacaacatttttttcctggttttatggattttccactgnagcaacgcagcttctccttcaatcgtcgttctcagc

SEQ ID NO: 497508 - DNA, 569 bp, Homo sapiens
  misc_feature (63)..(63): n is a, c, g, or t
  misc_feature (90)..(90): n is a, c, g, or t
  misc_feature (103)..(103): n is a, c, g, or t
  misc_feature (106)..(106): n is a, c, g, or t
gactccctctttccctccctcctcctccgtccgcccgtccgtccgcgcgtctgtccgttcggnccggtccggcccgaagcatggcctggngtcagcttcagcngtnccacctgtcctggagactgcttggctgtgcttactgatgtgagtgtgactcctgactatggatgatgctgctggcctgactgtgtgctctgtacacatatgaatgatggctccgatgacctcaagcttgcagcatcatggatgaagtggggcttgcagtgagctttctgggacactttgagaaccagaaggtgatgtactggcttcttgcagttgtcaatggactcccaatgcttgctctgccaaaactacgtgctcatcaacttggtgtgtgtgcgaagatgtgccttgatgccctgcaagtgctgcttgtgccagccactgtggctaagtgtggcagagttcttccagtggtgtcgactgtgatctgtgaactgccagcagcgtggcaagacatagacgcggtgtgccatcgggcagctggctctctaacgggctggcgcgactctccagccctgtgctgc

SEQ ID NO: 497509 - DNA, 316 bp, Homo sapiens
gtgtacacaacctagggtcagtcttgcaggtgtgtagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 497510 - DNA, 125 bp, Homo sapiens
ggctgccacgaggaggatgtcagcgtgaccgtctcaccatgggcagagaagaaaatgaccaggagtgtcatctccacgaattattggggtcacatatgtcccttcccagtccaattgccactctt

SEQ ID NO: 497511 - DNA, 241 bp, Homo sapiens
aggattgtcacagaacagtacctatcgctggaccgttgtgagatacagaggagggaaggcaagctctggatccgctccctcaggggatccaggagtctctaaagcaactcttcccctggggattgtagagtgaagttgtcaaggatggaacctcgaagatgcgacaggatggaaatcaggtggattactgttgagctatgagaataagagtctggagactgggggccttcagttcggcctc

SEQ ID NO: 497512 - DNA, 256 bp, Homo sapiens
  misc_feature (14)..(16): n is a, c, g, or t
  misc_feature (18)..(18): n is a, c, g, or t
  misc_feature (37)..(37): n is a, c, g, or t
  misc_feature (52)..(52): n is a, c, g, or t
  misc_feature (61)..(61): n is a, c, g, or t
  misc_feature (63)..(63): n is a, c, g, or t
  misc_feature (93)..(93): n is a, c, g, or t
  misc_feature (225)..(225): n is a, c, g, or t
  misc_feature (242)..(242): n is a, c, g, or t
ggagatactgattnnncntaatcacagtgtgagatanttttttctttaatangtgtaatantnaggaagtgggcccagaggaggttgtgcctnggagactctcatgtttgtccttcccctgagatgcatgtcctgtcaggctcagatacctttttataaaagagctgaaatcattatggtatatatctaccttaacagagctttcttattacagtgctaaaatgnttctgataaatggtccnaactcaactagaag

SEQ ID NO: 497513 - DNA, 1232 bp, Homo sapiens
gcagccccgcggctgcgggcggccgggcggccgagcgcgctctgaggttcgtccctcatcgctgaaccctgcgtcctccctgcctgcagctcctcgtgtggagtgtgtgtggctggtctggtgccttgcgcatgatgcctgcctccgtccccgtccgcatgctgctggtgttgagtgccgctgggttccgcgatgaggcgccgaacctcacagtcgcgctcccgcccgccccgtcctgcccgcccccccgccgtcgccccctgcccctcgccctcccgccccctctcccccctccccccccccccacccccccccccccccgcctcgctcccccgccccccccccaccaacgcccctccaccccccccacccactcacactgagccctccccccctcctccatccaccctctcacctcctcaccacacccctcccctaactacacccaccccatcctccccccccaccttccccacctaaccaccaacatgcaaccaaccaacatgataacacctaacctacataacgcacctatccactacactcctcaacgccatctccacccgtctctctcactacctctatcatgctactcctactaactccctcctacccccctcattaactgcctcttcacacccccctcctccgcatcccctcgccaccttcccacgtcaacctcgcccccactcccaccacacccacctcccccgcccccccgcccctccacaccaccatcccccgccaccccgtgacacgccaccacccccctatacatacccctacacaacatcccctcccactcctcccccccctccacagaccccctcccgcccgccccgcccaccgcatccgcccccccacctgaacctcccaccctccgcctcctctccctctcacccgcaccccgccgcgcccctccacccctccctctctcactcccccccacccctgtctaccacaccacccactccctcctccctccctccctcccccctcccgctgcctcccgcggccctcccgccgccccccccccccccctaccgcccgagcgcccgccgcctctccgctcccccccgctccctacaacactcaccacttacgccctcatcatctccctcccccccgccccctcccccttctgccctcccccccaacatatttccccttatggtaccccccccccccctccacaccactcttccccctcccctcccccctctctccctcct

SEQ ID NO: 497514 - DNA, 607 bp, Homo sapiens
  misc_feature (38)..(38): n is a, c, g, or t
  misc_feature (80)..(80): n is a, c, g, or t
  misc_feature (125)..(125): n is a, c, g, or t
  misc_feature (129)..(129): n is a, c, g, or t
  misc_feature (134)..(134): n is a, c, g, or t
  misc_feature (177)..(177): n is a, c, g, or t
  misc_feature (186)..(186): n is a, c, g, or t
  misc_feature (192)..(192): n is a, c, g, or t
  misc_feature (214)..(214): n is a, c, g, or t
  misc_feature (220)..(220): n is a, c, g, or t
  misc_feature (223)..(223): n is a, c, g, or t
  misc_feature (225)..(225): n is a, c, g, or t
  misc_feature (270)..(270): n is a, c, g, or t
  misc_feature (286)..(286): n is a, c, g, or t
  misc_feature (300)..(300): n is a, c, g, or t
  misc_feature (324)..(324): n is a, c, g, or t
  misc_feature (351)..(351): n is a, c, g, or t
  misc_feature (369)..(369): n is a, c, g, or t
  misc_feature (373)..(373): n is a, c, g, or t
  misc_feature (425)..(425): n is a, c, g, or t
  misc_feature (440)..(440): n is a, c, g, or t
  misc_feature (450)..(451): n is a, c, g, or t
  misc_feature (454)..(455): n is a, c, g, or t
  misc_feature (460)..(460): n is a, c, g, or t
  misc_feature (464)..(464): n is a, c, g, or t
  misc_feature (467)..(468): n is a, c, g, or t
  misc_feature (474)..(474): n is a, c, g, or t
  misc_feature (482)..(482): n is a, c, g, or t
  misc_feature (489)..(489): n is a, c, g, or t
  misc_feature (511)..(511): n is a, c, g, or t
  misc_feature (515)..(515): n is a, c, g, or t
  misc_feature (522)..(522): n is a, c, g, or t
  misc_feature (525)..(525): n is a, c, g, or t
  misc_feature (591)..(591): n is a, c, g, or t
gggggagcaggaaccaggcggggacgacgaaacggaangggccaagggggacagacagggcggggaccgggcggcccccncggagggggagggggggggcagggaggagggagaagaggcagggngccngcggngcgggcggggcagacggggggaccgggccagcgccagcagccntcggggccncggcgnggaggacaccccccgcaacggncgggcncanancacgaacagcaaagcgacccaaagggggagaggcggagaagcgcncaacacacaggggcgngccaggaaccagancaacaagggcagcagcaccagacngcaagaagggagggccagcggccagcngttgaccagaacggcgancaancggggccggcagcgcagcaaacgggcaggccaggggagccgcggggcgcaanccaagacaggggcanagccggcgcnnatnnggccngganggnncagganaatcaccngagcagngaagccagctgcttccattggngggncattttngcngtcaccagcaacgttgccacgacgaacatccttgacagacacattcttgacattgaagcccacatngtccccaggaagagct

SEQ ID NO: 497515 - DNA, 340 bp, Homo sapiens
  misc_feature (1)..(1): n is a, c, g, or t
  misc_feature (37)..(37): n is a, c, g, or t
  misc_feature (88)..(88): n is a, c, g, or t
  misc_feature (91)..(91): n is a, c, g, or t
  misc_feature (191)..(191): n is a, c, g, or t
  misc_feature (282)..(282): n is a, c, g, or t
  misc_feature (301)..(301): n is a, c, g, or t
  misc_feature (335)..(335): n is a, c, g, or t
nggcacgaggatctccgttgtctcagctaccaagggngtgccagctggaaacagtgacacagaggggggccggcctggtcggaaacgngcntggggagccacacagccaccacacagaagaaaccttccatcagtatcaccactgaatcactaaagagcctcatccccgacatcaaacccctggcggggcnaggaggctgttgtggatcttcatgctagatgactctcgcatctctggaggatggagacagagcgttaatggcgatagatggggacccatgnacaaaggggcttgaaaatnttgccggacagttcacttcaggttagttacctgncagtt

SEQ ID NO: 497516 - DNA, 1435 bp, Homo sapiens
  misc_feature (457)..(457): n is a, c, g, or t
gagagagagagagagagagagagagagagagagagtcaacgggtggggggacaagtccgttgaggctgtccaggcgagtcagcgcctttgtggagctcgcgtgactcggctgggctgtgccgtgaagatagacccagtctccatctaggaattatgagcgaaacaaaggatgtagatgcccaagagaccgctgtcaactcttcccgccccagccctgtctaacgacggcccgtgcgggtgtctctccccggcccggagacgacgaggagtggttgtgaaacacctccgagctcctagcgcggcggcgaggaacatctggccgggtgaggcgcccagaggatcggatccctaccaccggaggacaggactcccaagatactactggaaaagacgcagaacataggggacttggtgaccgacctaagagtggtgtggatggacccaaggtgcccccttntcatccggggggacacccttttacccaaggttcgccgatcggtcggtagatgtcccctcgattgtggacaggcaacagccctcccggagagaataacgacgcgctcgctagactagatagcgttgacaattgagctgcctgggtgttgtgctttcgccctcgaaggagcgaaagaaaccaatccattccgttccctttgcccacacttcccggtgcagagcaaaaccgtatgggacaccaacaaccgcctaggagggaacaaatttctgcgccccacagaaacaagcccaaacagctaccgcaaggaggggaggaccaaaggcgacaggtgagttcaattggccttgagagttggcagaggcgcacaccgaccgctgctcggttgggtaccccaatcagacagtgcccctcccccaagtgaacctcacgcaaaggaaagcgccgcgtgagttcggtttccggttccacacagaagagaagcgctacgcgcgtgagccagagccggaattagctgttggtatgtgagtgaggaggacagaaagcgtaattacataaacgtaaggttggtggagcattgtaaacccagagttatgggaatgggtttacaaagcaatctcataagtgtcggcgtgggagagaagatgttgggaagttctccatgatcgcacagttctattgccgttcaggatgcgaagactcctagttcagttgccgaattcctgtggtagtggaagccacaacccgtggggcgcgacagagtaacttggcaacgattttgtaagcgatggagccgaggtttcggtgaaacagcaagcggagtggcactataaagagggagtctacaatcggtgtagtccgatctttacgttacaacggccgtgacacatctctcaacagtatgtaacgggatggggggctatctgcacaaacgagaacacacgtgtaaggcagaccaaagggacagccacggaaacgaca

SEQ ID NO: 497517 - DNA, 1296 bp, Homo sapiens
  misc_feature (205)..(205): n is a, c, g, or t
agaattggaagactgtggatagtcaggacaaaagtcacttctggggcccataccctctagtggcattatgaattgtttgcgcagtatcaacatggacgcctactgtacctcttgctgtttctcaaagtagacagcccgtgcaccggtttgcgtctataagaaatgtggatcatctctctggccagtacactgagttgtgaagtgngatccaccaagatctctcacatgatagtctcaccttgatcgatcatcacaggtagaacaatctcatttctctacagtgtgatgtccgttacgcgtgcgcatgacagcaagtcgttgacgctcagtggggttaagactttgacagagacctctgatcagtggcagcgatgaactgctttcaaggaagcaaaagatgactaggcccatgatcggaaggacaatgcggtaacaggatccagcccaagtgcgtaagcacaaccacgttcctggtaagagttgtgcttgccaaactcaggttttcctagcaatttcttacaagtaaccgaggttcgataggggcaagaaggatcgtgcaccatttgctctacccatgtcccatgttcgggaagtcaaacgtaatactcccgaacctaggtcccaagctttggggggaaccattgtttgcgactccattgttacaattactaatctcggaatgcgtcctattccaacttggcggaaaacttgacatagctggtcgatgagggcccaccttctcctatctttcttagaacccttataaccaaggggggccccgcgtcccgttcttacaccaataggaattcccttggactgtcgttgggggggcccacaatcccaacttatcgcggtaatccgaggggtgtcttgcatagtggttacctagcggtgttggtcccctttaaatgttgagcaagaggcattggaccaaaatagaggtgtaagcgcgtatatggagggcgtacacacatgtgtttaccacaaaaggagccaaagctaaatagcgcagaaagattctgaacctcagcacaggcggctttcccgggagcgcaaggaggataaggcatagacatatggtggtggggggggaacgactaaataggtgacgaaatttgtatataccaacagggaattattttttaaaaagccttgtgtaagtgtgcccttgtttttaggataatataacacaaagttcgtagttaaagagttgataacaacaaatgggcatgagagacttatattttgtgggggcatagaagaggtgcatgagataagaaagagcacaattataag

SEQ ID NO: 497518 - DNA, 437 bp, Homo sapiens
agtagttagaatcagatcacttcagtaacgtacgtgatgagcatgcgctaggaaatctttgtaataacccagaagccaaaagacatccccaactcatggggtgtgttctttgggacggtacagcttatatcttcggtttatacagtcttagacttgagggctttgggtcaaagcatcatcatcagatttcaccacaactctcaccattcacatcagtgtcaacacacaaaaaggtcaccatgtcgacaaacaacatggctgggaaagcacaaatcatgctccaactcattccacaagtgggtataagttcattggctggagtgggtcatgactcatggctggcatttttcctttcctttggttatcacttttctggtggtttaaccaccctggtgccagccactggggctctgtagcgggggcatcctcgaagcagt

SEQ ID NO: 497519 - DNA, 135 bp, Homo sapiens
catccctccattatgctcatccctccttatgctcatccctccttctcatccctccttaactccaggggataggcaggtagagcttatgaaaagccaaggtttatatgcctatccccaggagtaaggagggatgag

SEQ ID NO: 497520 - DNA, 81 bp, Homo sapiens
agtgatctcttattgttctctactacctggacgccacctccctgacctccctgacctccctgacctccctgacctccctga

SEQ ID NO: 497521 - DNA, 284 bp, Homo sapiens
acgattttgaacactggtccaatgtataaataacgtcttttatatatctaaatgtattctgcacagaaggtacactggtcccaaggtgtacagctttaagagtcatatctattacatgtttaatctctgctgaaactcagtgcaaaaaaaagaaccaacgataaaacaacagggccacaataaaaacaccatgtatttttgtacacaaagtttttaaagttatactaacttatattttctatcaatgtccaggcgtgaaccgctctgccaaaccccagctgcgg

SEQ ID NO: 497522 - DNA, 478 bp, Homo sapiens
  misc_feature (284)..(284): n is a, c, g, or t
cccaacaatgtcagacagccgtttgtgacttccacctcgtggcctcaagatggcagtcaccttcattggcaatagcacagccatccaggagctcttcaagcgcatctcggagcagttcactgccatgttccgccggaaggccttcctcccctggtacacaggcgagggcatggacgagatggagttcccccaggctgagagcaacatgaacgacctcgtcttttagtatcagcagttccaggatgcccccgcagaagagaaggaggatttcggttaggaggccnaaaaggaggcctaaggcaaagcccccatcccctcagggttttcagttcccttaaccgttttaatcaactgcccccttcctctcccccaaaatttgggtttgctgcctctatcttgttttttgtttttttttttggggggggtctaaaacagggcctggcccatagtaggcgccccataaaaacttgtttgttta

SEQ ID NO: 497523 - DNA, 294 bp, Homo sapiens
agagatcgtggaacggggggccagataagtgctggccggagtctgtacacgggcctgcgctccatcaggcgcagtttggtcgtccccgcttacgagcccttcttcaagctccctgcaggaggtccacccacaggtgcgcaagatcggggtgttcagctgcggccctccaggaatgaccaagaatgtagagaaggcctgtcagctcgtcaacaggcaggaccgagcccacttcatgcaccactatgagaacttctgagcctgtcctccctggctgctgcttcctgcttatctcct

SEQ ID NO: 497524 - DNA, 548 bp, Homo sapiens
gcgttcgggctaccagcaggtagtttactgcatcgctgcggtgtttgccctgggagcagctgagaccacgcaatgctccaactgtaatgcccggtctctgcatatgtgactgtgacgtgcacttgatagttcacatttggcagccgccctattcactgctcacacggtaaaatggtatatcacattggataaaactaccgtttaccacatcaagtaagtatctaacccacaaaggatacaacgaatgaaataccctcatcttcatatacacacaaccactatgctgtctggagctcgttgcggcactgtgaacagggaagttacgggggacacgggaactgggtgatgccgcgttgtcatgcaagtcctttaacaccatcctctttagggataccctggtcaagcggctcacttgttcctaagagtgttgtgagcgggccgtatactacaattcctggagaatatctcacaattcatttgtcctcttatccccatccctctacccctccacttacaccgcctgcttgagagtgctacatgcgtgtccg

SEQ ID NO: 497525 - DNA, 551 bp, Homo sapiens
  misc_feature (1)..(1): n is a, c, g, or t
  misc_feature (95)..(95): n is a, c, g, or t
  misc_feature (107)..(107): n is a, c, g, or t
  misc_feature (122)..(122): n is a, c, g, or t
  misc_feature (124)..(125): n is a, c, g, or t
  misc_feature (133)..(133): n is a, c, g, or t
  misc_feature (136)..(136): n is a, c, g, or t
  misc_feature (140)..(144): n is a, c, g, or t
  misc_feature (151)..(151): n is a, c, g, or t
  misc_feature (157)..(158): n is a, c, g, or t
  misc_feature (164)..(164): n is a, c, g, or t
  misc_feature (170)..(170): n is a, c, g, or t
  misc_feature (172)..(172): n is a, c, g, or t
  misc_feature (180)..(180): n is a, c, g, or t
  misc_feature (185)..(185): n is a, c, g, or t
  misc_feature (197)..(198): n is a, c, g, or t
  misc_feature (206)..(206): n is a, c, g, or t
  misc_feature (214)..(216): n is a, c, g, or t
  misc_feature (220)..(221): n is a, c, g, or t
  misc_feature (224)..(224): n is a, c, g, or t
  misc_feature (228)..(228): n is a, c, g, or t
  misc_feature (231)..(232): n is a, c, g, or t
  misc_feature (236)..(236): n is a, c, g, or t
  misc_feature (243)..(243): n is a, c, g, or t
  misc_feature (245)..(246): n is a, c, g, or t
  misc_feature (252)..(252): n is a, c, g, or t
  misc_feature (254)..(255): n is a, c, g, or t
  misc_feature (257)..(258): n is a, c, g, or t
  misc_feature (264)..(264): n is a, c, g, or t
  misc_feature (267)..(270): n is a, c, g, or t
  misc_feature (272)..(272): n is a, c, g, or t
  misc_feature (274)..(274): n is a, c, g, or t
  misc_feature (278)..(279): n is a, c, g, or t
  misc_feature (281)..(281): n is a, c, g, or t
  misc_feature (284)..(284): n is a, c, g, or t
  misc_feature (287)..(287): n is a, c, g, or t
  misc_feature (302)..(302): n is a, c, g, or t
  misc_feature (332)..(333): n is a, c, g, or t
  misc_feature (341)..(341): n is a, c, g, or t
  misc_feature (357)..(357): n is a, c, g, or t
  misc_feature (368)..(368): n is a, c, g, or t
  misc_feature (380)..(380): n is a, c, g, or t
  misc_feature (383)..(383): n is a, c, g, or t
  misc_feature (388)..(388): n is a, c, g, or t
  misc_feature (429)..(429): n is a, c, g, or t
  misc_feature (434)..(434): n is a, c, g, or t
  misc_feature (438)..(438): n is a, c, g, or t
  misc_feature (440)..(440): n is a, c, g, or t
  misc_feature (447)..(447): n is a, c, g, or t
  misc_feature (454)..(454): n is a, c, g, or t
  misc_feature (467)..(467): n is a, c, g, or t
  misc_feature (482)..(483): n is a, c, g, or t
  misc_feature (517)..(517): n is a, c, g, or t
natacagtcaaggttagttgggtcaaaaactgatgttgattatgattaaaaagatacaaaactcagcacctccttcattaaaaataaaggttganaaacttgataantaaaaaacttaaaanannctttatanctncctnnnnnacatttnaagccnnccacanacacananccttatanccatnccaccccagctnnactaaaantaaacgcnnntcannatnaatnaanntttncccgcgncnncgcccncnncnnacaccnggnnnnanangggnngnggngcngggggctgggactanggggaggaccggggggcggggaacggagtnnggatgccnccgatatacgagaccngctgcggtaangctttttagagnctntttgntcgtgttagcctattactacggcgaggggatgagcttctcnttgtnggcnanatccacncccccgncatgagatacctncgcctaagccgccgnnagcgcaggggaggaagagagacggggcttgtccnattctcagtagcattactccggcgtattatcagg

SEQ ID NO: 497526 - DNA, 178 bp, Homo sapiens
cgttcccctgaagttatattcttatcctaccaggcttcggcataatctcccatattgtaacttactactccgtcacaacaaagaaccatttgtctccatcggtatggtctgagctatgatatcaattgccttcctagggttcatcgtgtgagcacaccatatatcgacagcaggaata

SEQ ID NO: 497527 - DNA, 125 bp, Homo sapiens
atatgtatgtcttccgtgttacaaatgtgcttataagtactttttgtctaaaattgttatatttaaagaatgtgaattgaaataaatgttttgattgttttcagatccaaaaaatagtaaacatt

SEQ ID NO: 497528 - DNA, 255 bp, Homo sapiens
gccgtgggtcaaaaaggttagtttcctggttcgttgtcagattggtggtaataaaggaacaaggtcacccttttgtcagggttcctgaattgggggaggaaaataactggggcctttgcctttggaatggggtgggtgccaaaaaagtcaaggtcctgggggtgtttgcttgcctggttttgttaaccaagggtggtgtggtttaaatgagaaagtgaaactttaggaaggtttgagaagccctttttcctccca

SEQ ID NO: 497529 - DNA, 131 bp, Homo sapiens
ctaggtctcgccaactggtccaggacgatgacatgctgtattggcacaagcacggggatggactggaacgacccccgtccccatggaggtacggatccctgctggacacagacatgctcatgtcggaactt

SEQ ID NO: 497530 - DNA, 1590 bp, Homo sapiens
  misc_feature (270)..(270): n is a, c, g, or t
  misc_feature (725)..(725): n is a, c, g, or t
  misc_feature (933)..(933): n is a, c, g, or t
  misc_feature (1062)..(1062): n is a, c, g, or t
  misc_feature (1458)..(1458): n is a, c, g, or t
attgctccctggtatctcggagctgcgtcatactgaggaggacccacacgctgtcttgcgagttcagcaggtcacttcctagagcatctgtccaccctggtcacgacaagcactaattggtcgacatggaagaccgtcgcctgggactgttcatcagcataggagattagcataaagaggcgtggaaggtatccgaagaagagtacaagggagaaagtaaataaagttgctctccgcttcgctccgccgtccccgattcccggatcaggncgccttatccctcattacacttcctggccgtacttcgtatctcgaatgtcgcagaagtagttggcgtgattagctacaaataggacaggccttcgtgggcgacccgtgggaggaaacgtcgcgcgtaggatatacgcgcaacgcgcgtaagtgtttgatccatgtccagtggatcgcgcatgtacatagcaattaggtcgctcgttatccgtggactctcccatgggtaaatccaatcctacttcatgggcgttcgcggtacgaacccacccacgaggcccacaattgtttagcaccctagggaacccactcccgtttgtgccccatggaaccatcggcggtaaacaggggaatggaactaaaacacgacaggctatcttcacaattgctactgaagagggagtcgaagatacccgagatcagaccaattcttgtatggagcctcgccattggancaagggaacctaccagggggaaagctcgaagatcccctcgacttggcagaggcgactcgagcaaggccccctaggttatgcatagtgtatctactgcacgagttattcccccccgaggcaaattggtacccccagtatagtacgattacccgaaaaagggagccgcacattcaaagcaacgttgagccgagagagagttaaatagcgntggggaataagtgccgcaccgcattgtcgcgatgtgcgagagagaagagattggggagaagattagtaatctcgggacaagagaggtgacggattacatgatatggaacgcccgcagaacacgtaagtntgtagcggccatatgccaaaagggcgatagggagtaaaaccggtatatggcgacataacagtactaatcaagagacgcgtgtgggattaacgacaataaagatatcggttaaggttcaaagaagagggtggttggagtaaagttagggatacaagtataatatatgatgagcgctatctatataaattttgccgcttattctacgtgtgggtatagcacacggatcaattaacttactatagatacacaaagtggacgggggtagcgtacgagggtacacacccagaatgtaacgaaagtacccaactgtacccggccaagcgaaacagtcaccccgatcaacaacaacaaaaagaatactcaacacagacaactctacagcggcgaagtgaaggnccacagcacatatcatatacaaacgatataccagaacgacacgcgaacataggtgcgcgcacccaagcaacaacccaagtacaggagctgaactgaccagcggccacggcgaacacttagaatggagtgcac

SEQ ID NO: 497531 - DNA, 195 bp, Homo sapiens
  misc_feature (41)..(41): n is a, c, g, or t
  misc_feature (66)..(66): n is a, c, g, or t
  misc_feature (111)..(111): n is a, c, g, or t
  misc_feature (137)..(137): n is a, c, g, or t
gctggggaaagggaagagagtggctcagctgcaggtaagcnaggctagaaaagccaaggccaaagntggaggggagaggacagtcagcatgtccagcctggggtctgggtntagggttatcccttctccctgtggcnatcccatctcgtccatgagcctaggtcttggagccttgtgttggaggctgagccactc

SEQ ID NO: 497532 - DNA, 388 bp, Homo sapiens
ctctggctattgctgctgcactgtccacctggtcttggctcctgtacagcctcttcgggcagccccagcctttccagctcccacctcctggcatagcccccaagaaacatcagacccaggggccaggcagttaagaagggctagagagagggcactgaggctttctgggaggtgtgggagtttcccacagcagcttatcacgcccctacagtgaagcaactcaggtgtcatctcactggatcccacagttgccataggagggatgtgttgttgcctagtttacatagtgaaccggtttcacaaatgagtaaactgagccccagagaagatgaatgcttttctcatagattgcactgccagtgagtatgggcaggaggggtctctatat

SEQ ID NO: 497533 - DNA, 156 bp, Homo sapiens
  misc_feature (67)..(67): n is a, c, g, or t
tcatttggaagatcatgaacattttccaagtgacagtacgtgatgtacaagatcatgcatggctcanagatgattcgaaagtgtaagacaggccagtggattttaatgtattaacaatataagagtgcattaagttttcggagtcgcgcttgtcgt

SEQ ID NO: 497534 - DNA, 611 bp, Homo sapiens
  misc_feature (37)..(37): n is a, c, g, or t
ctaatttgtactttgtagagacggggtttcaccatgntggccaggcctgtctcgaacttccgacctcaggcgatccgcccgcctcggctcccaaagtgccgggattacaggcgtgagcaagcaggcatggccgtatgataaaatctgattgagtattctgtatggcgtggtaactggaggaaggagtgataaatagtatcatgatgtggctctttgcaagaaaggaattttgtaagaattaagagatagggtagtaaggtcgtgagagaacaaaacacagaataagatagtctaaggttgtgactgtgcttacgacattgcagtaatttctaagaaaaaaatctgcatagagaactaatcaagattcaggagatgttccctgcagaagtaaattacgtcctgactcaaagcctccagtttgttggtttatgttattttgggaagacagagtctgtgttctggtcgccaaggcaggagtgaagggggggttgatctttgtgtaattgaaacctcccgccttccgggattcaggggatttcaagttgagctcccgagaagtggggattaaaggtgttgccaccaattcaagaaatggggaataaagaaagggg

SEQ ID NO: 497535 - DNA, 685 bp, Homo sapiens
gcgcagccaccgccgtccgggctgcagccgcacgcggagcccggcggctactcggggccggaggacattatgccagtggacaatattaccaggcagaaccaattctacgatacccaggtcatcaagacaggaaaacgagtcaggctacgagaggagaccactggaaatggagcaggccggacaggccgtatcgtcgcagataatgaagagcagagatgaagcaaggagcacctcaccatgcattcctcccgacctgaaagacttctctaaaggcgtcaacgtccagatcaggcagcagattccagagtctgaaagaggccttagtgagagaaaaccggggacgggggtactgtttgaggactaccgagaggcataggagggggccgcgtcgtccgtcagctcctccctgactgaagaggtatgcacagcagtgcactcttgaactggatgaccctgggctctgccttatagaccatcctaactcaatcttgggactccttcacagcgttacgacgcggtgggctcctgacggattcgggagtaaagatcggcgtaagtcccgcgttcaccaaattggaccgggctttatgctataaccttgtgcgtcaccggagccctgttgtccgagctaatggcgcgtcagaccggggccggtgtattgcctttccgaagactcgcccgatca

SEQ ID NO: 497536 - DNA, 409 bp, Homo sapiens
gatggagacatacagccccacctctctggaacagtgaaagatgactggcgaggaaacacagtgacagcatggagaacaggagtcacagaaggacacagggagtagggctgtctctccacctccacacattaaggctaacagggacgcagacacattcaggtgcctttgcagaaagagatgccagaggctcttgaagtcacaaaggggaggagtgaagaaatcctgcatctcagtccctcacaagacagctgtctcaggcttttacaagctgtgagagacacatcagagacctgtggcacagtcgcatggacgcagactgagagtacctccctccttatacacctgagctcttcctcctacacatcacagtcacgaccacagatccgatgaccacaactactaaggtaac

SEQ ID NO: 497537 - DNA, 154 bp, Homo sapiens
gggcccccctcccccggaatgacttttcctataaggggttctcttggcatagtcacgaggcccccccccccccctcttcctgggtctcccgcaagttttaaactctaatatttaaagggcttttttttttcgcccaaaaaataataaaacgttt

SEQ ID NO: 497538 - DNA, 536 bp, Homo sapiens
  misc_feature (8)..(8): n is a, c, g, or t
  misc_feature (79)..(79): n is a, c, g, or t
  misc_feature (84)..(84): n is a, c, g, or t
  misc_feature (109)..(109): n is a, c, g, or t
  misc_feature (111)..(111): n is a, c, g, or t
  misc_feature (118)..(118): n is a, c, g, or t
  misc_feature (128)..(128): n is a, c, g, or t
  misc_feature (207)..(207): n is a, c, g, or t
  misc_feature (220)..(220): n is a, c, g, or t
  misc_feature (225)..(225): n is a, c, g, or t
  misc_feature (229)..(229): n is a, c, g, or t
  misc_feature (232)..(232): n is a, c, g, or t
  misc_feature (254)..(254): n is a, c, g, or t
  misc_feature (341)..(341): n is a, c, g, or t
  misc_feature (377)..(377): n is a, c, g, or t
  misc_feature (380)..(380): n is a, c, g, or t
  misc_feature (383)..(383): n is a, c, g, or t
  misc_feature (407)..(407): n is a, c, g, or t
  misc_feature (421)..(421): n is a, c, g, or t
  misc_feature (424)..(424): n is a, c, g, or t
  misc_feature (461)..(461): n is a, c, g, or t
  misc_feature (505)..(505): n is a, c, g, or t
aacaaatntccaataatcctgtaaataatatttctaaattttcccccaaattctaagcagagtatgtcaattggaagtnaactnatgcacgcttaactatctcaacaancnttgagtncaagaaattnaagagttcaaatctgaccaagaagttgatgtcggataagagaatcctctgccccccacctctaagtcgccagccctccnagagccacctgtngagcnaccngcncagatacatcaaacatggaganagccctcaaagtagaattataaagaagaacatgtccatgtcaacattattataaccctacattttgtgcataaagtgtaagtgtatnagcatatcaatattaaaaggcaagccagccgaattnggnatncatccaatccaaatccggcaactncaaacctccatgangcngcttacatgtctcgatcccactcaactatcttgggcngtcacacagtcacatggttcacacggcaggcatactcatctctntcagtcggggtcaatccagtatagtacaaga

SEQ ID NO: 497539 - DNA, 116 bp, Homo sapiens
ctgggataaggcgtgagccaccgtgagctgccttatttttccccttttatacatttgctttgcttaattctttcccctactgtgtgttctctctaacgtcccatatatatgggtat

SEQ ID NO: 497540 - DNA, 168 bp, Homo sapiens
gcggccgcctactactactaaattcgcggccgcgtcgacgccaaagtaagaggatcacttaaggttaggagtttgagaccagcctgggcaacatagtgaaattccatccctacaaaaataaaataaaataattttacaattagccagatgtgttggtgcacatttgta

SEQ ID NO: 497541 - DNA, 735 bp, Homo sapiens
tacggctaggtacgaggctgggtgtactcaatggcaaatgggtcccctttgagtggcgatgatatacatcctgtaggttcgtccagcattgatccttttgtgaggaccttcctggaagaaagaaaggtgagcaacatacagtgtgcagtatcaagttgcccgacgtgtatggtgtattccagtttaaagtggattacaaccggctaggctacacacacctgtactcttccacgtcaggtatccgatgcagtgcctactccagcgacagcgcagatatgagtcgcttcagtccccatcggcacttacaccactacatactgccagacgcctttctccatgtatgctggaggctcttcactcttcagactatcgtcttcttgcacatgaagagacaagagacgaagtccgactgagagggactaagagaccactcgtccgacacaggcgatgagatgacggggacaggcgacggggggttaattaggactctggtggttctctgtctcttgctctctgtttcaaagccgtgggaaaagtggcacaacatttacctctgtgggacgatgcaacagctgaagacgccgaaggggtagaggacgtctgcggactacacttttctactactaacacagaacgttttttccagcttctgaaacacatacaccaaccacacacacaccaacccttccagggccctttattgttcggtttcccaaaaagaggttctaaagtggc

SEQ ID NO: 497542 - DNA, 244 bp, Homo sapiens
gcccccaatgtagctggattacaggcacatgccaccatgcccaactaattttggtatgtttagtagagacggggtttcaccatgttcgccaggctggtcttgaactcctgacttcaggtgatccgcctgccttggcctcccaaagttctgggattacaggtgtgagccaccatgcccggctgtcaaaataggtgtatggttgtgttttttttttttggaaagggaggttggctctggggggcca

SEQ ID NO: 497543 - DNA, 233 bp, Homo sapiens
ttcttgattgtactgcctgcctttcttttcctttttttctttcgagacagtctcactgtgtcacctaggctgaagtgcaatggtgcgatctcagctcactgcaactccgcctcccgaattcaatgcgattctcagtgcctcagccctcctgatgtagctgactacatagcaggcttgttgccaaccacaccgcggctaaattttttgcattttttggtaacagacgaggtttc

SEQ ID NO: 497544 - DNA, 723 bp, Homo sapiens
  misc_feature (177)..(177): n is a, c, g, or t
  misc_feature (179)..(179): n is a, c, g, or t
  misc_feature (321)..(321): n is a, c, g, or t
  misc_feature (355)..(355): n is a, c, g, or t
  misc_feature (435)..(435): n is a, c, g, or t
  misc_feature (505)..(505): n is a, c, g, or t
  misc_feature (509)..(509): n is a, c, g, or t
gcccggggcgctctcacagaagtggcatgtttcacgttcagccagttgtggcggaatcgtgtggcttccaagagacttttacacgccgcctcggctcgctcgcgatcgccgtgcgttgctgtcgtgcgacggaatcgtctccgcggtcatgtgatgcataggcgctcgtttcctgangntcggcatccgtccgcgggcgcatctctccgtgcttcctgttgcttcttgtcgtcgcgagacgtaggactcatctggcgcaacgtcttgcgggctcgtggcgcaagccgccgcggtgcactgttgatgattagccattgcagnagaacactcttaaggaattgagcgcaggaaacangccgtagatgacgcaagcgagactaagggcgcggctacactcacgcgcaacagacgcatgctccggcgtggcattcaagncgatgtcacgatgcccttgagggatagacattaagataaactcaggagtgtatcctggatagatcctttntganctccccaggatttggcgagcaaatagtttgtaacacgaaacatagtattcaccacatctctttcttccgaactcacattcaatatttatcctcgaggttctcgtctggctgaagctttgaagtacgcccatgtggcgacgagggagtcccacttgaccgcgtttcttagtttccaccggaacgtcacttaagtcgccagggacagcaggggaaa

SEQ ID NO: 497545 - DNA, 198 bp, Homo sapiens
gtgattgacaatgagaatatttatttagagtttattaagcagagtggaaatggctttaggcctttgggtggcagcagagatactttcaataggttagagcaactgtagtatgcagtggtcaggataagttttgatcacgtatgaacattctgtagagcccactgtattctccgcagtgctcccttctgtcgtcttctc

SEQ ID NO: 497546 - DNA, 397 bp, Homo sapiens
gactgatgtctctcagccctcggcctgcaccccatgactcctctccccgaccctgcaccactcctgcagccacactgtcaccacaactgctccgggcatctcccacattaagaaccgttgcactggattctcttcccgtctccaggcgttccttcctcgcctccttcgaggctctgctcaaatgtcaccaatttccctatttaaaatgtaccccctctggccaggcgcagtggctcacgcctgttatcccagcactttgggaggccgaggcgggcggatcacgaagtcaggagatcgagaccatcctggccaacatggcgaaactccatctccactaaaaatacaaaaaattagccgggcctggtggcaggcgcctgtaatcccagctactcgggag

SEQ ID NO: 497547 - DNA, 1085 bp, Homo sapiens
tgaaaaagccagttgattaattggctcggggggcagggggctcaggagctctggggggggcgggttccgattcctcttcaccattcacaggcttcgtggctgcccaggattggcccgtggcccgtgcggattggctgccagtgcgcaggtcggggcggaccctgtgtctggcggactcagtgtgtctgatgctgctgaccgttggcccgagcatcctggtgagatggtgtgggccctgcaacataggagagtgtgcgccagggctctcccgctgggccgagaatcttccggtataagtggaccacccacagaaccctctttggcctgtacggagctggcccgggttcccaactgcccaacaggtcctcggcgaggggagaaatcagggtcctctgtgtgataccgctgagaaggggaatcggggggcgccttctccaaatgtatattggggcgcctcaacggcgctgtgaaggtgtcctgcgggtatatctaccctctttggactcagggggaaacttggtgacgccagtgtccccaggcaggagacccactccattttgcgcaagatttgccgccaaaaactttggcgcggggggcgggtctcccacttcccgaggcaaggagaaaggaagaaaccttgagtgtctctcccgaggggatttatgttgtatattatctatatttttgtaacagagatctcccacacattgtctgtttatatataccggcacaaaaacccccctttgtttttgtgtctccccccagagtgcttctcaaggggccggattttcaccccctaataaaaggggcccccaactagtgtgttccccccgtgggtcccccaagcctgtgctccccttgtgtgcccccctgttggcccccccgctctgtgggagagccgccagggtggttctcctctatttgggcgcgcgtggtgtctcgccggtttgccccccacagaggggttgtccccccgggggtgtgttccggcggccccctcctgcggcgctctagcgcggcgccccttcagcgggttgtggtggtcacccccacttgcgggggacaaccaccctgggttgttcgtg

SEQ ID NO: 497548 - DNA, 320 bp, Homo sapiens
caggatcgacctctagacggactccccttgaatgggcaagaaattagtggagattacacttaatacaaatgcttcctgatgatgaccaaatctagagaaaataaggtcaacaagggacagttatctggaacataacttatcagtatacctctgcagttattaagtgctgaactactgatcatcctaaagctaacccactgaaaagtcttctctaatccagttttacaaacggaaagtcttattaaccatttggtttgataaaatgtttgccgaagcaatactttacttaggcctgttttacttatctgtgcccattacaa

SEQ ID NO: 497549 - DNA, 599 bp, Homo sapiens
atgaaagcagtcctggactgtacaaccgcacgctgcggatcatgtactttcattggagtagctgctggtagcaacggattgactgtttttccagaggagctagtaatatggacgtactatcaatggaacattctttggcggacgggtgtagattctatcccaaagctggtcactgactatcagaataagaaatccaatctggatgcactggtgacccataccctgccttttgacacaatcagtgaggcatttgacctaatgaaccaaggactatctgattgaatgagaacctggctgcgtaatatattacctgattcgatgaaccaaggaaagccatgcgtttaaacaaatatttacatttaatatgggaacatacaagagctttaaatattatagactgtgtacctgctgtatatatgagatattccctatgttagatagtaataataactagtgtttatgcatagaggcatatcatctatagaaattgcttacaattagatcttgtgaagttggtggcgaatgaagagatcgtaactataactagaattggcatatgttcatgatacctgtagattgacgtatgaatacatgggttt

SEQ ID NO: 497550 - DNA, 399 bp, Homo sapiens
  misc_feature (6)..(6): n is a, c, g, or t
  misc_feature (41)..(41): n is a, c, g, or t
  misc_feature (48)..(48): n is a, c, g, or t
  misc_feature (89)..(89): n is a, c, g, or t
  misc_feature (97)..(97): n is a, c, g, or t
  misc_feature (147)..(147): n is a, c, g, or t
aaattnatcctcaagtttgaatccccaactaagggcagccnaggcccnaaaaaacccactaagtcaagttcattcctgataatttaaanaattcaanatgaacctgtcgcagtggctcacatctgtaatcgcagcacttttgggagnacctaaggtgggtggatcacttgaggtcaggagttcgagaccagcctggccaacatggcgaaaacccatctctactaaaaataaaaaaatcagtcgggtatggtggcaagtgcctgtagtcctagctacttgggaggctgatgggggagaattgcttgaatctaggagttggaggttgcagtgagccaagattgcaccactgcactccagcctgggtgacagagcaagactccatctcaatttaaaataatt

SEQ ID NO: 497551 - DNA, 250 bp, Homo sapiens
gatcgacaagggaatggaattagtacccttgggttccaccttcatgacctaattacctcccaaagtctcccctcctaataccatcaccttggggttaaaatttcagcgtgtgaatttggagggcagacacaagcattcagtccatgacactgttcatttatttaacaaatagttttctatgcctactgtgtactcagagctgtgctagatgctgggggctccatagtgagaagaacaaacatcgtcgacg

SEQ ID NO: 497552 - DNA, 241 bp, Homo sapiens
accggtctgttgatttcatcgatcctttcttctgcttcatggaatctgctgttgaatacctccattgaatttaggatagttcagttacagtatttaccacatcttagactgtctattgggtactattttatcctttctatctcttagtcagcgttcttagttggttatagcctggttctttggccttcagtgaacatctttatcaccatgatcttagattctctgtcaggtaaatcacata

SEQ ID NO: 497553 - DNA, 238 bp, Homo sapiens
aagcagccagatataccgagaaagaaatatacaaagacagggatagccagatcacagccaatgagaagactttcgaggatgcccagaaatcaatctcacagcattacagcaaaccccgagtcacaccggtagaaggatcatgcctgatcatacccagaaataaaagatgtgaatcaaatccatgatgctcagagatgaatctatgactcagaacccagaaccccaagagacacgcagt

SEQ ID NO: 497554 - DNA, 482 bp, Homo sapiens
cgattctgactcatagtgattcccattgaggaggacaagtgattctatttagaaacagaccatcctttttaaggcaaaagtgctttaacatctttgactgaaaaacatatatggatccaggaagaatctccctgtaaaatcttctagcttaattatccgggaaggctcccacctggctcccacattccctcaaggcggggccaccactcttatgtgaaagttggtggagatcacatttagcctacgcgttatgcagggggttcagatggacaccacacagcttccctgacacagaagctgattaccctaggagggaagaggtctaccacgtggggtcgggtcctggctggatctgagagctcccatcagcctcttttatttcttctggggctggaatttccaatgggcttggtacagctgattctgtgtatcacggggccttctgattcactctgatcaaccagctggtttttactcacaag

SEQ ID NO: 497555 - DNA, 354 bp, Homo sapiens
  misc_feature (196)..(196): n is a, c, g, or t
ccagaaaaaaatctttcaggaaagttctccccggcagaattttttttccttgttaaaaatcaggaatataggccgggtgcggtggctcacacctggaatcccagcactttgggaggctgaggcgggcggaacacctgaggtcaggtgttcgagaccagccaggccaaaatggtgaaaccccgtctctactaaaaanacaaaaaaaaatgagccgggcatggtagcaggtgtctgttatcccagttaggaggctgaggcaaaagaatctcttgaacctgagaggcggaggttgcagtgagccaagatcgcgccattgcactccagcctgggggacaagagtgagacttagtctca

SEQ ID NO: 497556 - DNA, 173 bp, Homo sapiens
gtgtgtgcttggtctccacactggccagcagtaagggccaccaactcaatttctagcacagcttgtacaagatgtggggaccacatgttctcaaagatctctggtggttctgaggattccctgtaaagagagaagtgaagtttcacctagagaatatagggacgagatgtgag

SEQ ID NO: 497557 - DNA, 492 bp, Homo sapiens
  misc_feature (492)..(492): n is a, c, g, or t
tgtacctatgtgaaagcgacgtctaggtgggaggatctcttgacgcctgggaggcgaggttgcatgtgatgctgagatcacgccactgcactccagcctgtgtgtgacagaagactgaaaccctgtctcaaaaataaaaaaacccacagccggggtgcgctggctaatacttatattctcagcccttcaggagggttgggaggtggttcacttgtggccaggatttcacgacctccctacccaccttggtgaacccccatctctactacaaatacaaaataaaatttagctaggtggcgcgcttgtattcccagctatgtgggaggctgaggcttgagattcgcttgaccccaagaggagccgtgctcctgtgagcgagatcaggccactgcactccagcctgcttgacagagccagaccctgtctcaaacaaacaaaaacacacaagttctggcccccgtggcacatgccgggacccccgggacttgggan

SEQ ID NO: 497558 - DNA, 513 bp, Homo sapiens
  misc_feature (362)..(362): n is a, c, g, or t
ccacgcgtcgcggacgcgtgggtcgacccacgcgtcggacccacgcgtcggggaaatccagctagcggcagtattctgtacagtagacacaagaattatgtagatgcttcttagaagaagaatctcatagtacatgttaatcctgtggcatccagtaaacattgtactatacgatgctattcacgaggtatcggtcttgcgtggctctcgtaaaagccctctggcctacgagagaagagagtgataaccagggcagtgaacagcatcacgtaggatactagtaacggacaacttcatcggtggaatcgataccttggatggtgatgcactgagtattcgaggcgtgattgggtgcaccctgnagcctgttcacggaggcggtatgcctttcacgcgggcgcgaccgaggaacctggggaggggttatcccataccatcgcaacgaaagccgcctcaagacgctgcagatacatcaggcccacagaaatcaccttgtgcacagctggtcctgat

SEQ ID NO: 497559 - DNA, 374 bp, Homo sapiens
gacaaattaaatctgtaaacagaacaaagacagaattccagtctgcagggcaacgtcgatgaatctcaaagcgaggtaagagctggaagatcaggctgggtgtggtggctgatggctgtaatcccagcactttgggaggccaaggcgggcagattgcttgagctcgggagttcgaaggccagcctgagctacatggcgaaaccccttctctaccagaaatacaattagctgggcctggtggtgcacacctgtggtcacagctactcgggaggctgaggcatgagaatcgcttgagcctgggaggcggaggttgtagtgagatgggatcatgccactgcactgcagccgtgggtgacagagcgagacctagtctc

SEQ ID NO: 497560 - DNA, 199 bp, Homo sapiens
tcacatcaatggcctggctggaactggcttccacggacccaggatcataggcctccctcagagccgggccgggtccctgagacatcagtaggaacgacagcgtccgcctggctgtgctgatgtttacacagacaccacctggctgattaactctgaacagtgtgaaagtgacgcagaaggctagtggccccaatgttca

SEQ ID NO: 497561 - DNA, 610 bp, Homo sapiens
  misc_feature (12)..(12): n is a, c, g, or t
  misc_feature (71)..(71): n is a, c, g, or t
  misc_feature (97)..(97): n is a, c, g, or t
  misc_feature (101)..(101): n is a, c, g, or t
  misc_feature (103)..(103): n is a, c, g, or t
  misc_feature (106)..(106): n is a, c, g, or t
  misc_feature (126)..(127): n is a, c, g, or t
  misc_feature (135)..(135): n is a, c, g, or t
  misc_feature (166)..(166): n is a, c, g, or t
  misc_feature (188)..(189): n is a, c, g, or t
  misc_feature (294)..(294): n is a, c, g, or t
  misc_feature (332)..(332): n is a, c, g, or t
  misc_feature (364)..(364): n is a, c, g, or t
  misc_feature (371)..(371): n is a, c, g, or t
  misc_feature (378)..(378): n is a, c, g, or t
  misc_feature (390)..(390): n is a, c, g, or t
  misc_feature (400)..(400): n is a, c, g, or t
  misc_feature (409)..(409): n is a, c, g, or t
  misc_feature (428)..(428): n is a, c, g, or t
  misc_feature (431)..(431): n is a, c, g, or t
  misc_feature (439)..(439): n is a, c, g, or t
  misc_feature (442)..(442): n is a, c, g, or t
  misc_feature (445)..(445): n is a, c, g, or t
  misc_feature (460)..(460): n is a, c, g, or t
  misc_feature (484)..(484): n is a, c, g, or t
  misc_feature (526)..(526): n is a, c, g, or t
  misc_feature (533)..(533): n is a, c, g, or t
  misc_feature (555)..(555): n is a, c, g, or t
gtgcagtttgtntcttgatttgtgtctccttctcagaaagtgtgcatatatctgcatgggaggtgaatgtntcagcattaaactctttgggaacgtntgtntnatngacttccagagctgaaaagnntggtcgcntgttcacccagggttctgtgcagcatttggngactctgtcacttactggcgtnntctcatgcaacacacataactggttcaggaccacggatagatagtcttctgcacagggcattctttttgcttcaggatgtttacaacatttgctgcccacttttnctaggtttcttgagacctctacaagagttggagttganacttggggtactttcttggtgtaacgaactantagcgcnttctggnatttgtactctncaagctgctnaaaaagctnacaattttgtttgattaanttntgaggctnttncanaagaggtttaaattnatcgaacactttggactagcattnatgaggatctgcagcggcacagcacttctctagagtggtttnatatgtnttggcaagtctcagcagcagcncgacagagtaatcaggatgccttcttgcatattcatacaaaaacatgccagggag

SEQ ID NO: 497562 - DNA, 118 bp, Homo sapiens
cacgatggcgcggtccagtgtgaaggtgtcagaccacgagatcctggcatgctccgtggaatggccgcgtgagaccgtagtgacctaaggatggggcagctcttctcagactacgtgg

SEQ ID NO: 497563 - DNA, 1076 bp, Homo sapiens
ggcgtgatgtctcagagatgagttctcagatcccagcacatggcgtccctcccgcttcgtggctcgaagacgcagtggcaggcatcgtgggaaggtgaaaagcttccctcatgggatgactcgcatccaaggccggtcctaggctcgagcagcaccttacctgggtatacgaaggctggctagtgacatcactagtcgtgacgggaaggtcagactgggacctgggattcctcaggatgaggcaacgatagggaagagtgtctggaggctagtgaaccatgttgttcgaagagagcatcgaattgagtgtgtggtgggcatggtgggctacggtggaaagggactccgaggggactccggaggggttcatagaaatatgtacttgagctagatcacagtacagggagactgatgtgacaaagaggcagttctttcataaaagaaaatctgcgacattaggagtcgtaaaaggagaggaaaaggccatgttgagggcaaaagttgagcatggaagagaaaatggagcacggatagagagtatggggtagaggaaagcggagcgtagttgatgaatggagatcttgagacgagccattgaagaggcaacgtgacctgatcaggagatcaatgcaggaagtacctatgggcgcgacaagcaacttggaatcgacgcaattgtctttacgtactcgccgacaccatgacacgacatgtgtggccacacgtggaactgggaggaaatcccatgcgtagaataggaggcatgggtaacgggttgcgctctgcagaaaggcctgggcacatgaaggcctgcgggggaggaacaggccttattcatgtcacgacgagaggacccctgatgacaccacaaacgtctgtaatggggcctgggtaccggaaaaatgtagtccaaagatccatcgggaaggttgagtccattacgcagcgagaaggcttcacagagaccgggggtctccccatcccatcttggggcctcccaatggtaaacgttggcttgcagccaaagaaacacggcgctgggccctggcctgagcgccgccgggggaatgggggcc

SEQ ID NO: 497564 - DNA, 113 bp, Homo sapiens
gaggatcccctaccagatttggagggaacgtgttcctgatccagtcccgtgaatgcatctgcagctgtcactcgtacaatttttgccttctactgtgcattgttttcctttgt

SEQ ID NO: 497565 - DNA, 307 bp, Homo sapiens
gaacttgaaaattcaaaagggacatttgggtaggttactgtacatcaatctaagcataaatggcagcttgttttcttgagcccctgtttaaattttgtttttatagaaattttttaaactgattggttcataaatggtcagttttgtacccagattgaacaatacagccctttgccaaaaatgagggtagcattgtttaaacattgtgtgttaacccctgttttttgtaattgggttgtggggcattttgccctacctggagttccagttttcaatctgtcagtaaataaagggtcctttaacttca

SEQ ID NO: 497566 - DNA, 200 bp, Homo sapiens
gagcagttggaccggatccagaggtacaaggccgcggccctgctcagactaggggcccgcaacgtgcccctgggctttggagagagctggaagaagcaccttagcggggaagttcgggaaaccatatttcatcaagctaatgggatttgtttgcagaagaaagaaagcattacactgttttatccacccccacaccagag

SEQ ID NO: 497567 - DNA, 744 bp, Homo sapiens
tgccactgcacgccagcctgggcaagagagtaagactctctctcaaaaaaaaaaaaaaaaaaaaaaaatttaaaatcccaattaattttctaactcttttatgggatgtatttaaaacacagtatacctatagtatacctatgtgtttataatgttgggtaaagtggtaacgtgacattttaatttatttagaagttactttaccccgtgccttttctccatttttattcaggggctacttgagaaaagcaaagggaaaaacataatagttatcaggtagtgtcacgggaaagaagagaggagggacaaaactgagcagcagaaattcgtatagactttttccggtttaatttctaaaagcccaattggagatgttcagggaggggtttggttttggcccttgggcctcatagaatggggttccatgaatggggctccaggggcttataacctcttgtaaaattctattctaattttggtccttttatttggtcccgggttaaattccagaaggacttctccaacatattttttttctttacccctctattattaaaaaagttactttaacttaagtttggaaccgctttataaacattcaagctcggtgaaaagtgtactcttaataaccttttacttacaagcaatggtttttccggaaattagattaaggtgaaaagcagaggggttccttggaatagggtcccccggttactcaaaggagtgggtaatgtggccggctag

SEQ ID NO: 497568 - DNA, 364 bp, Homo sapiens
gttgctgtttgggaaggggatgggcatccttttggggttttgcctgtggggacccttatcaacaacgtggaaagttagccaggccggggtgcccaatatattcgagttgcaggtgctggaaacgtgggttgtaacagtaggccgagtattcaacgttgtttttaacaaacgggtttttggcaaggcaggttgcaacccctggttgggcaaaaggcctaacagtggggggtggccccccaaggggggttggggtggccaaaaaatttggccccttccccccatgaagagttaggtgaaggtgccttttggttttggccaaaggtgatatccctgtgttttaataaaatggcccccccccccccga

SEQ ID NO: 497569 - DNA, 105 bp, Homo sapiens
ggttaggatgagtgggaagaagaaagagaggaagtaaagtttaattatgcctttttgggttagcgatggaggtaggattggtgctgtgggtgaaagagtatgatg

SEQ ID NO: 497570 - DNA, 824 bp, Homo sapiens
caccgtttttttgtcgccgcgcgccgtcgtgcactgcaaggggggaccgccggtgtcgacgcgcggccccctgtggggcgttctaacaagcgggaccactctgttttgtagagccattgtgccccacgagggtttccgcgttctcgcgcggaataaagtgccccccgaagaccagtctagtgttagccacctcccttgtcacgtgggccccctaatatgtgtcacacaaaggacctgtcaggccaatgatctttgtggcgccacccccataacaggcgaccccattcctttctgtgggtgctcaactaaaacgttctgtagaatagttcgccgctttataccccccgcagtcgccgttctagtcagcttttcaagtaaggctctcccggcggggcgttttcttagacactttttacgtcgtgctggcggccacaccggttagtttcactccacggcaccccccccagctcgcggggcactcgcccctctttcatcgttggtcgtgttgtacacagtagtagggccacccctccttgagttgtgcgcgcgccgctcttgtatggaacatgtacctcactgtctccgcggtacgtattttctttacctcaataacatcgctatcctctattatttatccccctatttaattgtaggtcacagaagagacatgaaaccccctgatggcaaaacacttttgatgtcaaaataacgtaacaaggaatcttttcacagcttccacgaattcttgccctcacttgtagaacgtttgtgcccctctctgcttaacaaattctaatcctttactcctcaacggcacaaaaaca

SEQ ID NO: 497571 - DNA, 961 bp, Homo sapiens
  misc_feature (159)..(159): n is a, c, g, or t
  misc_feature (447)..(447): n is a, c, g, or t
caagtaataccagcgaggcatggcaagccaaggaagaatacagtagcattgaacactttggccatttattctgcattcttctaggaatgcttatttcacttctaatctttatggatttcacactaatttcgatagctcagttgcctaaccttccttcantctcgcaaagctgtcttcatttaccttccataagagggtgggagtcgtgtgtgtgtgtgtgtatggaatgatttaataggaaaatatccttttaatgtgttagtgtgttaagagaatctctcttctctggctgtagttacaaagctgcataggttctgagtggtctgcctgtaactattgtcctataagtcctgttctttttagcgaactattcttcagcggtttaaaattttttttgcaggaacacatattatgttatgacagatacttcaggagataaaatttggntgttattttactgcatataacaaaacaaaactaaaaacaaaaatgtatactagtatacatattaattgcatgatctttaaaacacaagactactgtttagacttgaatttataatttgagaaatgtcttgggatttcaaacaacagctttagtagttagtttcattctggtcatgtgttttagaagaataaaatttctacaagttacgttaaactgtgtagcactaaaactcattaactttgttggaatttttggaattaaccctgcctttaatgtacatcttagtatttttcaaggtaaatgatgtctttttacatttacaatgttgtgagaaactaaacatatcctgtgtatgtaactgatcagccctttctcttctgtcagcggcacctttggcactgcttccatgagcaatgcccacaggattcgggcactccggctcctaaagtcttcccaacagtttagtggcagcttcagagctggcttccagccaagcaaggttcctcaaaagaaa

SEQ ID NO: 497572 - DNA, 738 bp, Homo sapiens
cgccgaggacgagtcgggcgagggcttccccctggagttcaagaaggaactgactgggcagcgactccgggagggagatgggcccgacgggcctggcgatgacggggcagggggcccagggcgaactggagcacaggctggtggtggcgggcgagaagaaggacgaggggccctacagggatggagcacttccgctggggcaggccggccaagggacaagcgctacggcgggttcatgaactccgagaagaggcagacgcccctggtgaagctgttcaaaacacgccatcatcaagaacggctaacagaagggcgaatgaaggcacagcgggggcccaggggctaacctcccccaggagggcgaacccaaaggcccttggctctcccctggcctggtggcggctcccaacctggggggtcgtgggagattatcaggctcttaaagctggctggagttaggaaataaaacctttcaaatttcacattcaactcttactttgaatggtaactgtgtgaattaagtaaaaatacgtaggcggtcaaaacacatcactcagcactctcacacacactcgaggggggggcccgacccaatcgcctatagtagtcgcatacaatccgggcggcgtttacacggtctgatggggaacccggggttccattattcccttgggaatccctttgccgtgcgtatacgagaggcgccgatgcttcttgcctgatgatgacatggctttg

SEQ ID NO: 497573 - DNA, 768 bp, Homo sapiens
cttggaacgatgtacgatacggtcatagtgaccattaaacctgatcctccaaaaaaaaaaaaaaaaaaaaaaaaaaaaaaaaaaaaaaaaaaaaaaaaaaaaaaaaaaaaaaaaaaaaaaaaaaaaaaaaaaaaaataacaaaaaaaaaaacataaatgaccctataaaaaaaaaatataattatgaggtataggcataataaaagaaactaaaaaaaaaaaagaacttttggtccagtttggcccatgtatatttaaaacaagataaattttttatggggaccgaaaatttgcacaatttggaaaatcccctttttgtgggcaggttttaaaatataggttgcctggattttaaaagaatgggttggaaaaaacctggggttcccaaattaaaaagggaataggaaaaaacccctttttaagagttgggacaaaaagaaaaaagcgccacacaatgcccttttcaaaaaattggaagacttttattggaatttaaaatttaaaaccttttatatttttgaaataacagggtaaattttttgaaaaacaggtttttttttaacaaattggccaagaaatgcaaaacccttataaaataaaaaaaattccacggtagggggggggggtttttttttcttttggaaaaaagcctccttattaagaaagggggcctctacgaaaaggggggatacctcttttaaggggggtgcctcaaagaagaacaaagcactaataattttttggggggaggggcgcaaacaacctgtg

SEQ ID NO: 497574 - DNA, 159 bp, Homo sapiens
tccaaattctgctccccacaaaggactttcccacggtgggagtggggctgttcagtggggctgtgggagtcttggacgccaccacagtagagccaggagccccctcccagttggccctgtggccgatgtcttaggtcctactctcagaagtgtctcctt

SEQ ID NO: 497575 - DNA, 562 bp, Homo sapiens
  misc_feature (542)..(542): n is a, c, g, or t
acctcagcataggcaggtaacaccgttaagtcaacaatttggaactgccttcttggatcactcagctgtgctttcatggctggactgactggaacacgtgtgcgaagacgagattgggggcccatggaaagtagtcgcgttcactgcttagtacactcctccagaattgtctttgctggtaggagataaactcgtacttcagccaaaagatcaggacaatatgacttgagtccatcaaggacacgaaacacctgagtagctgggcagcccttggtcagggtcgtaagccaggtagtgaataatgatctggcctagatatttaagggaactctaggaagaggcctaggtttttaaaatcctgtctctttgtcttaccataagaggctgagcctctcttcattttgtcttgaagggccacttgtgttttctgttctgggaacatcattcatttctctactgggttgttgatatatgcagtaatttctaggagctgtttaatgtttggaggtaattggtccttgtccatatatatgagatgtacnccaggtccagttatcttatt

SEQ ID NO: 497576 - DNA, 952 bp, Homo sapiens
gcttgtcttggcaagatggcggcgtacgacttgactactcgcatcgcgcactatgggatcggcatctagtctttccgcttctgaatactctctgtaaagggagatatataatgaaacggactaatagaaggtaaattggcccttcttagtgataccaacgtggtagacgtgtgctatggatgtatacaaaaagctttattctgatgatattcctcattgcttttgcagacgtagaccacagactccactgttggttgcacaaggtgaaagcaggttcgggcaagaaacagaagccaatggtgacagactgttggatgatccagacagtacaaggccatatgcgtcaaccaagggactgggtaggctgcgtcttttgagctaccctggccggagcaagcactggtatttagcggcaggaatttatttaggatacactctacggatatgcaaaattcccatgtagcgatagggtggaaaatacttcacggagcagtccagaatatcttgatttcctctaccaggtgctggttccgcagcctacgatagaaacgtgcttaaagttcactctgggagaaagcttggctctgaactcttaatgcggaaattgcatgcaggtcatggaaggacttacaggggtagagagacgtagactaataattctggaagtctccactcaggtctcttcaccagagaagtggtcctgcatggctctgttgtttctcactcacccaaggtgggataagataatggccttcgttataagcaaattttatgtcttgacagggtctcctctcgcatggatacgcagcatgaacacgatttcaaccggcggtacagctgtagcgttaccgggttcataaagacacaattgtgatgcacaactgggcacaccgtgtatagctacatgtgccatccatctatctcaccattgttacggcacaggttacacact

SEQ ID NO: 497577 - DNA, 349 bp, Homo sapiens
  misc_feature (43)..(43): n is a, c, g, or t
ggctcggaccgtgagactgccagaacctggttcgacagaacgngtagcgcttcatttcgcatcatctgccgcccagcttctacccttgagtgcatagccctcaggactgaacgctctcatgtacaatgacctgaagttccctcgttctgatcgtgcaccgcgacttctaggccgtccctgtcgccggtgatcgggttcgaggcattgcccgggagttggaacaagagggcttcagatatcttttctgccgtgtatctacgctgaaggccggctggtgtgcctcaatcccgtcacggtctgccgtgcatcctgattgccgccgaaggcgccggggactatacccatttgc

SEQ ID NO: 497578 - DNA, 648 bp, Homo sapiens
  misc_feature (128)..(128): n is a, c, g, or t
  misc_feature (288)..(288): n is a, c, g, or t
  misc_feature (311)..(311): n is a, c, g, or t
  misc_feature (313)..(313): n is a, c, g, or t
  misc_feature (342)..(342): n is a, c, g, or t
  misc_feature (354)..(354): n is a, c, g, or t
  misc_feature (360)..(360): n is a, c, g, or t
  misc_feature (547)..(547): n is a, c, g, or t
  misc_feature (573)..(573): n is a, c, g, or t
  misc_feature (587)..(587): n is a, c, g, or t
  misc_feature (590)..(590): n is a, c, g, or t
  misc_feature (594)..(594): n is a, c, g, or t
  misc_feature (598)..(598): n is a, c, g, or t
  misc_feature (617)..(617): n is a, c, g, or t
tttgcttggttcggggaaaatccaaattttggcaaggaaaaaggcaaggggactggccttgtctatcggggaaagtaggcacagggcaagcccatggtgacgattgttattatggggcagaagcttgntgagatgatccggtttttggcccccaggcttgtttttaaggggggaaaccttgagaagaccctcaaagttgacaaggcaaatgcccaggccgcagttctgtataaggtttttgatgccactggacagatgaacttgaccaaggtggttgattccagcccntttgcccttgaactgctgatatntnatgactgctttgtgctggacaacgggctntgtggcaagatntatatntggaaggggcgaaaaacgaataaaaaggaacggcaggcaccccttcaggtggccaagggtttcatcttgggcatgcagtacgccccgaacactcaggtggagattttgcctcagggccgtgagagtcccattttcaagcaatttttcaaggactggaaatgagggggggggttttcctgccccatgntcccctgcccccccccccctgcctgnttgtttttttgggngcntggncagngcaaaggggccccctgcanatgttcaataaaggagacaagggctttccca

SEQ ID NO: 497579 - DNA, 227 bp, Homo sapiens
cgggcatgtactcacaactaagtgccagctaacatcgcgtgagaacacataaacatatggagaggaacaacagacactggcgcttaccaccgggtgacgggtgcaatgagagagaggacccatggcaaataacaagatgcatactaggctaaatacatgggtaacaaaataatctgaataacaaccccgtgtgacataagttaactatttgtaacagacctgtacat

SEQ ID NO: 497580 - DNA, 126 bp, Homo sapiens
ccccaaaactgggggcaaggcaaaggacaggttttttcaggttaaaaaaaaaacgaaattttaaaacctttaaaaaaaacttataaattcggatcaaatttgggggaataaaaaattttagagcca

SEQ ID NO: 497581 - DNA, 1110 bp, Homo sapiens
gggaggagcagaacctgctacagcccagacttcctgccagccaaggctgctggtgcgctccgggtctggcctgggcttacgaagtttcagctcccgtgtgtgccattagactcgttgcacgcagctgtgttggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaagatgagggcggcctcgtgtgcgtgggctcatgtggtcagtgcctgctggtccgggtctgcaaaaacagtgcaggcgtcttgtgaccccagcgctgtcgtggcagcgtctgggaaggagttggaggtgagctgggtgtgacatgcagtggtgagtgcacagcgggcaccagcacccgagtcagggtcgtgagccgaggacatggctgcggattccctgggtgctgggtgtcctgatcctttgttgctgcctggatggtgtcgggggtgggcagcgtcagcctggcttggccccaggaggaggtgctgcttatgttgtgtgtatctggta

SEQ ID NO: 497582 - DNA, 2755 bp, Homo sapiens
agcggagagcctcgcggagggtgagcggccggcggcttcgaccttggagtcccaggctgtgtgggacttggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggcctggcccagcgtcaggccagcgcggcccaggaggcccaggaggacggcttgcccgacaccagctccgcggctgccgcgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtacttta

SEQ ID NO: 497583 - DNA, 139 bp, Homo sapiens
cgcagaaccttttgaaacattagtggatgttgcagcgacagactgcaaaatggattcgtcatgaagtggtctgagaagtgccatggtctaatggagtctggtcttcacctctgtggtgcactcgaagcaagggactttg

SEQ ID NO: 497584 - DNA, 2592 bp, Homo sapiens
gggaggagcagaacctgctacagcccagacttcctgccagccaaggctgctggtgcgctccgggtctggcctgggcttacgaagtttcagctcccgtgtgtgccattagactcgttgcacgcagctgtgttggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggcctggcccagcgtcaggccagcgcggcccaggaggcccaggaggacggcttgcccgacaccagctccgcggctgccgcgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtacttta

SEQ ID NO: 497585 - DNA, 2869 bp, Homo sapiens
  misc_feature (2765)..(2765): n is a, c, g, or t
agcggagagcctcgcggagggtgagcggccggcggcttcgaccttggagtcccaggctgtgtgggacttggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggcctggcccagcgtcaggccagcgcggcccaggaggcccaggaggacggcttgcccgacaccagctccgcggctgccgcgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtactttaaaaaaaacanaaaacacacacaaacaaagaacacacaaacacccgcaacccacaaggacaacaaaacgaacaacgccaaaacataaccacacaccccgccggcagccacagggc

SEQ ID NO: 497586 - DNA, 510 bp, Homo sapiens
ggtcaccgacggggtgggaaggtgttgtaaaagaacaaacaggccaggcgcagtggctcacacctgtaatcccagcgctttgggaggccgaggcgggtggatcacgaggtcaggagttcaagaccagcctggttaacatggtgaaaccccatctctactaaaaatacaaaaattagccgggcttggtggtggtcgtctctaatcccgctcctcggaaggctgaggcagataattgctcgaacctgggaggcggaggttgcagtgagccactgcactccagcctgggcaacagagcgagactccgtctcaaaaaaaaaaaggacaaacaaaccaagtaaggggatatcattaaacaatggaggactggctcccttgtcccctggccagggcctgcagggaacgtcaagggtcatgtcccttttaaacaaagccaagtcatcatggccctccctgggtttgagacgctagagtccgtcaaggaagccgggttacctatgggcaccgcctagg

SEQ ID NO: 497587 - DNA, 165 bp, Homo sapiens
caagatgttactgtctcagcaactatgtacaaaatgtcacattattttctttcttcttttaagaacatattataaaaagaatactttcttggttgggctttaatcctgtgtgtgatactagtaggaacatgagatgtgacaatttctcatccttgggagcaattt

SEQ ID NO: 497588 - DNA, 86 bp, Homo sapiens
ttttaaaccccccccccccttcccggcccccccccctgggggactttaagggggggttgggttgttttaaaaacaacaaaagggca

SEQ ID NO: 497589 - DNA, 2446 bp, Homo sapiens
gggaggagcagaacctgctacagcccagacttcctgccagccaaggctgctggtgcgctccgggtctggcctgggcttacgaagtttcagctcccgtgtgtgccattagactcgttgcacgcagctgtgttggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggcctggcccagcgtcaggccagcgcggcccaggaggcccaggaggacggcttgcccgacaccagctccgcggctgccgcgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtacttta

SEQ ID NO: 497590 - DNA, 1389 bp, Homo sapiens
gttctatgattcggcgagcggcctgcccattctccctactatgcctagaaggaataatactatctgctgtttcattatagctactctcataaccctcaatcattctcactccctcttagccaatattgtagcacataataagaacagtactagatctaaagaacgacgtgcgaaggcaggggtgggcctcagcccgtactaagtctccaatctgcgcgaaggagatatgggccgagagtacgtacagtagagccgtaaagcgcgtagctccacaatgctaagagagctaactcggtgcgcgcaaccaatctatacttacctaccactgaacaatgaacttgtcgcaagagagagagcgagcgagtgaagtgtgtgacatcaagcaacacacacaacccagcaggcgcgtgagagtgtgaccctcaggcgatgcagtccccacacgtagcgtactctgctcgagaggagagcgcaaagtcgaagcaagcaagccgtaatataagactgctggccccgaagcgccgtataagacctggcggagagccagcacacataaaaaggaaaaccccccgcacgttacccgttcacataaaacataaaaacataaaaccatagaaacatacacaataaacagcagcacgaagcagaggaaagccctcggggacaaaggcgcacaaaacgcgcgcagcgttgggaagtaccgccagagagaaaaccacaaaactgaagtacgaccggaaaagaacaaaaaaagatgacgtagaaaagcctacatacgtggaagttgacgctgacaaatccatggcgcgcgttgaaagagagaagtactgaaccattagaagtgtaagtgaaaggcgcaacattatgccgagcgaggggacaagagaaggaaacaacctgaagaggcgcaaggaactatgtagcaagtgcaataacttgagcgtacaccaggaaaaaaaagccgaccacacttttcaattaaggcacacaacacaccgttagggagacttcaaacccgagtgacaagagcaccagggaacaggacagaggccaacaacccaaaagggccacgacaaaccctaggcccttcagagaaaccgagcaaaaggagcgaagccacattaacagctagaagcaccccgaaaatagagcgtaaaccaaacacaccgataaaacagtgcagcgggggcacacacacacgtagtgagcagagcacgtatgaaagctgcccacattccagagccacgatgacaaattaataaaccacggctgccagcgaccaaagacaacgccagtaacaggatgctagcaacataaacacaccaagctaccctgcaaaatcaacatgacaagaaccaagcaccaatctaaggccctcaacagacatgg

SEQ ID NO: 497591 - DNA, 127 bp, Homo sapiens
catccgaggtgcagaagtacatcgactacgtgcgagacgtcgccgcggccacgagctgctgctcgagcagcgtctggacatcagccgttgggtgcccgaggccttcggcacgtccgacgcggtgatt

SEQ ID NO: 497592 - DNA, 169 bp, Homo sapiens
agctcatgttgcgtgtgtgacatggtgcttgtgatgcgcgggaccactattctgtttgtgtaggtaccgtgtatcactgggcctcttggcaacagtacgagacatgtgcttcctaggtgcccaatagggtttcgcagtatggttaacaccacatgtgcatgctgtggcg

SEQ ID NO: 497593 - DNA, 2755 bp, Homo sapiens
agcggagagcctcgcggagggtgagcggccggcggcttcgaccttggagtcccaggctgtgtgggacttggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggcctggcccagcgtcaggccagcgcggcccaggaggcccaggaggacggcttgcccgacaccagctccgcggctgccgcgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtacagaatatagttatgctgcagagaactgatttgtgacagtctgtaaaacgcgagtcttttgctctgaccagtttcagtgataagcggggggagaaacaatgaataaataaccc

SEQ ID NO: 497594 - DNA, 2370 bp, Homo sapiens
agcggagagcctcgcggagggtgagcggccggcggcttcgaccttggagtcccaggctgtgtgggacttggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggcctggcccagcgtcaggccagcgcggcccaggaggcccaggaggacggcttgcccgacaccagctccgcggctgccgcgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagaca

SEQ ID NO: 497595 - DNA, 1837 bp, Homo sapiens
ctccagccgtccttctctggactgtggtctttatctggttctggtcgggcagagattgtgtcacagactttgacaccccacccatcttagaagctcggagcagcgctgtgtgctctgccagacgagctgcccctggtgaaagctgggcctggcccctccagtcggaagcccctcactctccatttgctgcttatcaagaccttcgtgtgtgcgccgttgctagttccggaattgcattctgcacgaggaggggtcgcctatagattcttagtccatcagaccccgaagcagaggccaaagtccacgccaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggcctggcccagcgtcaggccagcgcggcccaggaggcccaggaggacggcttgcccgacaccagctccgcggctgccgcgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtacttta

SEQ ID NO: 497596 - DNA, 1638 bp, Homo sapiens
atttcggcggctgtggttgtggggggatgtgtgtcgtgcacgctgtgtgtgtgtgtgtgtgtgtgtgtgtgtgtgtgtgttcgtgtgaccctcctcgtgcccgcctcggtgcgctctcgcttcctctgcgtccacacgatgccccttctgtgctcctcccaagagaatcagcacgtatcatacatccacgacgcggccgtgcatgcggagaggacgggatgagcgagcatcagtgagcttggatgtactcgtagagcagcatcatgtgtgactatcaaaagtcaaacttcgtgctgtctgcctattgtaagatccacaccaagtgccggcactcgagcgcggcctggcccagagatagggccaacagacagggcgcaggagggcccaggaggactggctcttggcaccgaaaccatgttccgaagagtggcgacacccctagtgcacacgcctagcggaccagcggtggcagctccgagagaagccacggggtccagccgtcgtctgaccgagttagacagggaaacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtacttta

SEQ ID NO: 497597 - DNA, 1509 bp, Homo sapiens
  misc_feature (516)..(516): n is a, c, g, or t
  misc_feature (518)..(518): n is a, c, g, or t
  misc_feature (560)..(560): n is a, c, g, or t
  misc_feature (565)..(565): n is a, c, g, or t
  misc_feature (608)..(608): n is a, c, g, or t
  misc_feature (694)..(694): n is a, c, g, or t
  misc_feature (784)..(784): n is a, c, g, or t
  misc_feature (950)..(950): n is a, c, g, or t
ttttttttttggtatttttaaaaaccagaaacatttatggcatgtgacataactcgtggacatttctataagaagtgaacgtggatgtgcgtgcaacagttgtgccctcttggggtttaagggtggtggtctcctttcagggaatctccagtgccgtgaactcgtggggatatcacaattttaagggtgcctctcattctcgagaccaggtttccggggggtatttctcggctcttttatacgccttgtggcactctccaggtatattactttctcctcttggcggcttgtggcaggggtacgcccactttttggcccacgggctcgacttctcgtggagagggtgcgtatgaggccttatagagagcccacagacgagggcggggcgggcacacacagcggtggtggcgtatcttaatagtgtggcgagagcgcctttttcacaaaagcgaaagatgaagcgtgtctcccacttttcgggtccattcttcgacattgctgtggcgccctctcaanancctataagggggcctctcccataatattatattctctatagncacanctccttctataggacctataaggcgcgtgtataataactctcnaaactcctctcgtgagatctcgagcgggggtgagggccatttctaaaactcttcaaaaaatatagagcccgcgtgggaagctgcgngggcgcccacagctgtgggagagagaacgagtatagccccacaaaaaagacaaattctctcatatattggagagtctccacctctatagncacatttacattttcataacatattcaaacgattttaccttaaatataaggggggggggcatcccttttataaacctccctttcagcgggccccttttatttcaaccaaaaccacaaatagaaaacaaccgctttcggtggagatttaccttccgcggtgcgcaantacaagtggaacccccttcgtggggccacattaatataatgtggagtttataattctccccaacaatagtaaggccagagagagacccaaagcggagaaacccccctcttttgagaaccctttgtgcgcaggaagggagggagagctccagagataatataagtatgtctcagcaggggggtttaacaccaattttagggaaaagatagggcaggggggggcgcaccattattgggacacatatatatttcttacaaatagagggagcgggaatgatatcacccaccaacacctttttttttttatttattataaaatagaggccctcctttgaccacgctattaaaaaaatcttctccctgagggagaaccacaacatgtgttaggggcgaacatctctccgcgggaaagatctactaacacccaccatcattcgttgggtggccaccaagaacacccctaatatataaaaaccccgcggggtgatttagaataatgagaacgggagaaatcacgcccgcgatgatgcaagaaacaaataactacgtcgctgtataaa

SEQ ID NO: 497598 - DNA, 2490 bp, Homo sapiens
agcggagagcctcgcggagggtgagcggccggcggcttcgaccttggagtcccaggctgtgtgggacttggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggcctggcccatgctgtcatgtgccatgctgcgtgcccatgtgagggcccacgtgacgtgacgcggcctttgccccagaacagccagggctcacagcctggcttgcctgcgcagaccacccccatattgatgactgccggcccgggccaagcagtgtgggccgcctctgggagaagcccaagtggtaccgccggccagcgggatccgcactcgactttacgaccgggaactgcatgggactgtgacggaaacaattcccccgcaaccagccaaaccactggacaacgtggggtcccactctctgctgggagccatgcaggcctgccctagagacttattcccttggggcacgcgcgggttctcgggcacgctgtcgactcgtgctaggccaaggcgcccacttggccagtgtgcccgagccctcagttaggcacttggccgcattcgcccaatgacaccaacccttttcaccccaaagaaccctttggcgggggcccttccaccaccggctcgcgaggcgcaaaacggtgtaggcccaccacggagcccatggcgaagcgccagccaaccgaaccctcatccggaggatcccaggaccggccagacccaccaacggaacaagccataggcgcgaacgggtcccccaggccacccacgggagccagataccaacccaatccttcctcgtgcacggcttctcacccttggaaagtggcccgattggaccatctcactggcacgcacgatcatagcgcccggaactatccgctatcatccagtaccaggcattaccgtcccgtattccccccttcccttgcgcaaccgccatttcacctggacatggggagtcacaccccactggtccagtcggcaaacccccaaccagtggtgcgagccttattgagctcatccactgtgattatccatctccacgtgtgagataccatgggtggccccccaaacgaacacctccatctctccattggataggcttgagcg

SEQ ID NO: 497599 - DNA, 628 bp, Homo sapiens
cgtgttggtcgtagtgtcatgccaaatgcaacgccgcacgtagtcatatttcttgaagcaaaaccaggtgcgggcgtgacaaacagatctgcgtctccggtctcgtcgcttagctcgctctgtgtagtagttgtagtatatccactctctcaaagcatccaggcgccccctggcttcgggttctatgtaaactccttcatgcgccgctgccctgataacatccaccaccgcagaataagccacacccagccaacctacacattcgttctgcgagtcacacacgggaggagcgggaagagctggaagaaccatgttttttttttttattccaaaagattatccaaaacctcaaaatgaagatctattaagtgaacgcgctcccctccggtggcgtggtcaaactctacagccaaagaacagataatggcatttgtaagatgttgcacaatggcttccaaaaggcaaactgccctcacgtccaagtggacgtaaaggctaaacccttcagggtgaatctcctctataaacattccagcaccttcaaccatgcccaaataattttcatctcgccaccttatcaatatgtctagtcgacgcggccgcgaatttagtagtagtaggcggccgc

SEQ ID NO: 497600 - DNA, 117 bp, Homo sapiens
ctccgttcttcgttactttcttgtggctcccgatttgtcccggaatgtgtgtgtgtgtgtgtgtgtgtttgtgtctgtctgtcgtgtctgtccgtgagtgctgtatgtctcgtaagc

SEQ ID NO: 497601 - DNA, 459 bp, Homo sapiens
  misc_feature (37)..(37): n is a, c, g, or t
  misc_feature (59)..(59): n is a, c, g, or t
  misc_feature (118)..(118): n is a, c, g, or t
  misc_feature (269)..(269): n is a, c, g, or t
  misc_feature (334)..(334): n is a, c, g, or t
  misc_feature (394)..(394): n is a, c, g, or t
  misc_feature (403)..(403): n is a, c, g, or t
  misc_feature (409)..(409): n is a, c, g, or t
  misc_feature (419)..(419): n is a, c, g, or t
  misc_feature (430)..(430): n is a, c, g, or t
  misc_feature (435)..(435): n is a, c, g, or t
  misc_feature (439)..(439): n is a, c, g, or t
gtttcttaaaagccccaagccccaaaacccttatttnaaagaggcatcctctgtgcccnaaagatcacctaaacccaagatgggaatagtggaaggagcgccgggactgtgttggganagtgagggccgggacagagactacagtaacccgacacgaaagcagatagcaagtcctaggggtgatccagaatcacccaaagacctccagcccctggatgatgccttttccatccctggacttattccctgggacgttggttccggtcccnggtagccttgttaaccctcagaggccttcaagtcctttccactttctcacccaattgcccaccanttaataagcttagcttctcttgccaccttcaaggggcttggatatgtggaatagtgaacntggggccantgtcangtttgtcacntcacccaaacntgacntaantaaaaaaatttatttatgtt

SEQ ID NO: 497602 - DNA, 346 bp, Homo sapiens
tactatacgactcgagtctcgtactgtgggtagcacaacctagggtcagttttgcaggtggtaaagccatttaccaagatagttgtaggtcaagaagggcagatttattagagaaattgtgaaaatatgttgcagtgggcagctcagcagagaaggggctacctgcaaagaggcaaggactggaggaaagttttatagggtcctgctgaagggtgctacgtgctggaatgaggtcattgtgcccgtaggttgtttgtgattagctgtctctaacaattgttcacacaataattgttcattattgttctcaacttggggctctccccaacctggggacccttcctta

SEQ ID NO: 497603 - DNA, 1019 bp, Homo sapiens
tgttgctattttttgtttttgagggagagaggagggaggagagcaacaagaccacggagtgtgagcagacgcgcacacgcgctttttttgttctctttggagcgcacctcgttcgcgtgtctccgcgtgttgtcgctgacccggcttctaggtggtagagacctttcacgcccctgttcctgagttcggtcttcttccggggactggtgttggacacgcttttggggccgggccatcacaagcgccggtgttgcgtggccgcccccttgtcccgttcggtcgcgtgttaccaggagcctgtacacattggagtttcccttggggcctctcataccctctggactcgccgggtttggcatgaggtcatttggcttccccgtcccttccccgggggcgaaccccgtgaccccgggacacctggggtttgctctgctgctccccagtcccacccagggtcctggccagcctgccccctttccctggacagggctcgtcgcgagcattggctcccgcgtgcttgggcgataatcccaattgcccagaattcaagtctacctccagtacaccatcccggaggctgggtaatgtccatgcctcttgcccttttcatgtgtctagcgggccagtgccccagaggcgcccaccaccccccccagagcccctctgatggaccagctctctaccactccacaccccacctgtggccccacgccaggagccccgcctggccatccagtatttattgccgtccgtccagttccgtgcccatgggccacataggccatggcgccgtgttctcccccggctcttctagtgcccaccaacccccggcaggccttccctgacacccagcccaggaaccaaaaaagggaccaccagtgcacaaccttgctgagaaccgtctcctgtgcctcccccgccccatccccggttttcgtgttgtgtctgcccggctcaggcagaggcgcctgtccctgcttgttttttgaccggggaatataatgcccctgaaggagcca

SEQ ID NO: 497604 - DNA, 858 bp, Homo sapiens
aatgcatttaattgttttgattcttgtagcttgacaaaacttacgtcatagactgtccaagttcttcacgccatctcttgcacagcttgtaacagaagagtctgttggtgttacttttggtaaaggagctgttagcagactttcctgccagtgtcagtaaaatcctattgtatgaagtcctgtcggttattccttgagtatctgaaaagaataccgaataagtagtaccattactatgaggttattctctaagatttgcaaaagataagagaatggaaattgcagtcagactaaattactaaagtacaagttctggatacacaatatttttcgttcattttaaaactttttttgaactaataatggctttgaaagaagaggcttaattggggggtggtaactaaaatctaaagaaatgattgagcttgagggtctctgtttggtaatgaatacactcatttaggcttaatagtaaggcatgctaggaacggttagcttgtacattgatgtagcttcgtgttcaatatgtaacgtgttacttgggtctagttttaccgtcaactttgaacagataagtttgcgctgcatgctggacatgcctcagaaccatgattaggccgtagctatgatctgtgtggaagcattggatctgtagagtcactgttggaataaagtgcttactatgagaagtaccccccagccttttgaagaacggggggcttgttacacgggacgcgtatgtagtggcccgtacctaacaggcagtgggttccgggaaaactggggattgactttggcgtcagagctccttttggtcctactttcaaccatattgggcgtcaaaaaccaccccacttc

SEQ ID NO: 497605 - DNA, 380 bp, Homo sapiens
gctcgaccagaaacaagcaaaacagaacaatagattgttgaaatattcacacaagagttgtaagaccacatttttttaaaaaattaaaagataaggctgggtgtggtggctcacgcctgtaatcccagcactttgggaggccgagatgggcggatcacctggggtcgggagttcgagaccagcctgaccaacatggagaagccccatctctactaaagatacataattagccgggtgtgatggcgcatgctagtaatcccagctacttggcaggctgaggcgggagaatcgcttgaacctgggaggtggaggttgcggtgggccgagattgcaccactgcactccagcctgagcaacaagaccagaactctgtcccccaa

SEQ ID NO: 497606 - DNA, 956 bp, Homo sapiens
  misc_feature (80)..(80): n is a, c, g, or t
  misc_feature (302)..(302): n is a, c, g, or t
ggtcgcctattgtggcctcttttctccttcggcggggcgactgtgcgtggaaagcgtagactgaggagatgctaggtatngtgtgagttcggatcgcaagctatggatggccacgttacctgcaagtgatcaccgtagagcacttggatccagagagaacgtgcggtgtgggatacttgagtgggaactcgtatgtggaacgatatgcaggcaggccgagatgccgagagggccaaggaactgcttcagatcacgctggttcgctggatcgggcgtgacttggtgcgccggcgttggttcantgctgggctcagcatcgttccagtctggatagtgaccgagactactgacggatcgcactctacgcctgcccagccctctttctctggctcctagccagcatccgtccggtcgcatgcctgccagtgtgccagcgcaaggagagaccagcgtacattgctagcccgatagtcctagtcgtgcgcgcatctacatgggttctgggcccatgatcgtggtcccgtttgcagcatagtatatatcttagaatttatcactacttgctgtgagaaccccctagaatcgcatcaggttgcgcctttggccctcatgaattcgacgaaatattttgccgagcaaaaatctcgtcccatagagggagtgctggacacgcgtaatggcacagggtaccgtggcgctcgggaggtgcagggaacgtggcccacttaccttggaattgcgtggcaaaccgcttaaccgcactttagggccgtgcccctgagatcgcatgtgcttcccctcgcccgatggccaagccttgggaacctagtattctacaggaaaccttcttaccccacacgactggaagaactaacaattggccctatatggacactcgcatggtcctcgtgggccgtcccggaatctggatccattttcccccgccaagtcttccc

SEQ ID NO: 497607 - DNA, 212 bp, Homo sapiens
tagatagcaattatctctcagatagtaaacgtattcgtttgatcccaaaactacgttggcaggtagttttaactttgatcttaacttaactcattagccatagattttctatacgttgtgcacaagatccacccagagcgcaagggttctcttgaaagaaaagtagcttctgtaccaattaaaggattgaagtggtctcagatgttgatgca

SEQ ID NO: 497608 - DNA, 599 bp, Homo sapiens
  misc_feature (387)..(387): n is a, c, g, or t
  misc_feature (391)..(391): n is a, c, g, or t
  misc_feature (400)..(400): n is a, c, g, or t
  misc_feature (510)..(510): n is a, c, g, or t
  misc_feature (512)..(512): n is a, c, g, or t
ggcacgaggcctcgtgccgggatccgtatgtccattaaacttcatcagtatttaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatggcanaaanaaggggggnccccccaaaaaaaaaggggggccctgagaaacatgataaactcatcttgtgatcaacctattggctacccaatctttgtctcacccctgacaacttcttactctgagggncncgaaaggcttaaagacattcttgggggtcctatcagcttgggaaatatcaggaacttcatagtgtcaacctggcacaggcttaggaa

SEQ ID NO: 497609 - DNA, 774 bp, Homo sapiens
agagtgtgatagagtcctaaaggtgctactgtgtccatgagtcaatgcttggacgagtctagtgatgccaccgagagtgtcttatccacctgtgcttccacggtgtcacgtagcgcactgcggattctatgggtcttaggcgctaagtgctgagtagcgcaggcgtagctttggtagtttggttccttatggcaaaaggtagcttttaaggtaccattagtgaattctagcattgtaatgatcttgcaagttagtgttgaggcgtagtaaggtcttagttgggaacgccctcgttggttgggttcatccgccagtggggatttaacgggtcgcggagcgatttttgaggaggacattgatattaatgcatctggaagggacgttcgcgtttaacccacaattccgatggtttgggccctttgggaattccctttggccacagaaggttcaccacccttgtttgtggcggttcccctttcctgctgtgtgggttttcaccccaggagaaattatggcggggggccccggtttttaaaaccccgcgcgggaaagagaatttctctttttatttttctccctttggagaaggcgctttatacattggggaatccttggggcgttttggtgccaggagtagggaatgtccacgctttcacacgtgtttactgactgttgcagaataggaggggttgtttcgtagtccccttgcagttgaagtcaaacctgtaagggccagtgaacgggctcgttcatgcgacgttcctttgcgccgag

SEQ ID NO: 497610 - DNA, 124 bp, Homo sapiens
tgcttttaggcagacacgagactagagagtctgacttgagtaagtttatgggcccggagatactgtcctggtgacagtgagttgggctgtggagagtgccacctgtgcaggcataatgctggat

SEQ ID NO: 497611 - DNA, 116 bp, Homo sapiens
agtacttgtgtaattattgaggactaaacgtcagttaaaggtgagagggaaaactaggttgcagactaacagctgttttgcatctcacaagaacataggccttaagacaaaatttt

SEQ ID NO: 497612 - DNA, 710 bp, Homo sapiens
atctgtttaacatcagtgaaggagtttagcgaagaatttcgccacctctctttattccatgagtaagggagatagcatctgggtgagctatagagaaacgctgcgttcatgcatggctctgctggagaaacgactgagctaagacgtggtcattcgtgggtagagagcctccctgtgcctgctgttgaccttgaaaccctacccctaacatgtggcttcctattagtcaccttatatgatgcaattctgatatgtgccagtgctataagcaaatggccttgattcatactaggcatgcgtcatgaccaatcgagcatacacgttcatagaagaaacatagtggtgcttctttctgatctctagtggagatctcttgtgagctgctgtacgtacctagaagtgtacttgaatggttatctaacgtctaatagtgcctggccagtggtccatttatatagtattgttccaagaggctagacgtgctttgagccttttgttagaaagacctcccattgtaatagttcacagttgtgtagaccactgtatagcattgtactcaaggaagcttagccttgtccatttgtgaagctcttgggcaatcgtcatgcaggcgaaaagtcacgccatgtaccactgatacctgttgacttactgagggattggtgatggcacggagatcttagtgcactagtacatcgtcttctggtgcc

SEQ ID NO: 497613 - DNA, 930 bp, Homo sapiens
ggcggggactggctggtcgacgtgggacaaccaagcccgcttaaccaaaactggagggagaaagtggattattttgtggtccacacatctgggaccagccggaatgggatcctacgatggaacaaaaacccattgcgcaaagggctgcagggcgagaggtgggtcagtccaggggatgttggaagctgggagtagaccgggattatttctccagggtgggtggatcccaaaactttaaccacatcttcagggccacaaatagaacgagacaattcatgtaattcctgggcggggcccagcaaaaaagcagctggtggccagcgaccccctccagaagaccccagaaggggcagagacacctctcaggcgtctcatctccagaggacaacattccttaaggaattacgcccaggacaaccttttggaacaggtacatttttgggtggaagcaaatgggattcggggttaacattaagcaatgccaacttccagcacatggaaggatatgggccaaaggtcgtcccctggatctctcaggatttccaaacgttggaaccatggggccagtggacccagattgggacagggggaaccaaggttccgggcagatggggaagagtttgaaccggggtttacacccctggcatttggtggctgtgccttttggggcacagcctgtgtccaataggggcatgtacacccaaggattacacgtatcgcagaagggaaaacactccacgccgcacccccagggggtgccccgaaacacgacacctttaaactcgcgaccaggggaaccgggccctggggcttaaaggtttggggccgggggacaaacgggagctacgggagaactaaccggtcccagacccttcccggtgacggccgggggagctgacggccatacacgacggccacgtggatagccgg

SEQ ID NO: 497614 - DNA, 219 bp, Homo sapiens
ttcagcacattagtgtatgttttatgactaagaatggtggaggaacagttaaatcaactttttcagggtatttctggaacataggattacttagttcagttaaaggcctgattggcttgggtggactttatgagactagggttttttggacagtgaacatagacttaacattaaatcctgggatataaaatcttaatttcatgagccatgatactattg

SEQ ID NO: 497615 - DNA, 119 bp, Homo sapiens
agtctttccgtaccggactctggaccgagaggtttgtttcccttgccccactacctgaaagaaatagaataacctgaaagacccatcaggttccgagaatgtcataaatgcatgcagga

SEQ ID NO: 497616 - DNA, 103 bp, Homo sapiens
cagacaggcggacccccaaggctcattggggttccagctaaaatctgaaatcttagcagtgtgtcctccatgacataacaggagttctggaggcccatcttct

SEQ ID NO: 497617 - DNA, 269 bp, Homo sapiens
gcggtcccacggcaggtgtactgggagagaaaaatagcatggagtagataagctgtaagcaaaagaacaattgcagttaactttttttttttggagacggagtctcactctgttgcccaggctggaatgcagtggcgggatctcagctcactgcaacctccgtctcctgggtttaagtgattctcctgcctcagcctcctgagttgctgggattacaggcgcacgccaccacgcctggctaatttttggtatttttagtagaggcaggg

SEQ ID NO: 497618 - DNA, 761 bp, Homo sapiens
  misc_feature (57)..(57): n is a, c, g, or t
  misc_feature (70)..(70): n is a, c, g, or t
  misc_feature (115)..(115): n is a, c, g, or t
  misc_feature (123)..(123): n is a, c, g, or t
  misc_feature (146)..(147): n is a, c, g, or t
  misc_feature (153)..(153): n is a, c, g, or t
  misc_feature (163)..(163): n is a, c, g, or t
  misc_feature (168)..(168): n is a, c, g, or t
  misc_feature (172)..(172): n is a, c, g, or t
  misc_feature (208)..(208): n is a, c, g, or t
  misc_feature (218)..(218): n is a, c, g, or t
  misc_feature (225)..(225): n is a, c, g, or t
  misc_feature (231)..(232): n is a, c, g, or t
  misc_feature (247)..(247): n is a, c, g, or t
  misc_feature (259)..(259): n is a, c, g, or t
  misc_feature (263)..(263): n is a, c, g, or t
  misc_feature (268)..(268): n is a, c, g, or t
  misc_feature (276)..(276): n is a, c, g, or t
  misc_feature (285)..(285): n is a, c, g, or t
  misc_feature (289)..(289): n is a, c, g, or t
  misc_feature (293)..(293): n is a, c, g, or t
  misc_feature (310)..(310): n is a, c, g, or t
  misc_feature (325)..(325): n is a, c, g, or t
  misc_feature (398)..(398): n is a, c, g, or t
  misc_feature (419)..(419): n is a, c, g, or t
  misc_feature (421)..(421): n is a, c, g, or t
  misc_feature (489)..(489): n is a, c, g, or t
  misc_feature (496)..(496): n is a, c, g, or t
  misc_feature (499)..(499): n is a, c, g, or t
  misc_feature (505)..(505): n is a, c, g, or t
  misc_feature (521)..(521): n is a, c, g, or t
  misc_feature (563)..(563): n is a, c, g, or t
  misc_feature (574)..(574): n is a, c, g, or t
  misc_feature (739)..(739): n is a, c, g, or t
aataagagagagagaggagcagctcacacgtggcctagggggggaggacgaggccanaaatactgcaggnggggggcaagggagccctagggggaggggaaagcagggggtgggnagggaganggctccgggggaaaagacactgnnggcttngggcgggggngccanctgnctctcactccaggggcgagcagcttcacttggggcncgggggctgngagtccncctcgnngtcttcgtacatctngccctcttccgngggnggggngtccgggnactgcgggnactngganaccagggcgttcatgtngctctgggcctcggngaactccatctcgtccatgcgctcgcccgtgtaccagtgcaggaaggccttgcgcgggaacatggccgtgaantgctcggagatgcgcttgaanantttctggatggccgtgctgttcccgatgaaggtggaggaaatcttgagggcggggggggggatgtganacagggncancttcangttgttggggatccantccacgaagtagctgctgttcttgctctggatggccagcatntgctcgtacanctccttcatggacatgcggccccggaacacggtggccaccgtcaggtagcggccgtggcgcgggtcgcaggcggccatcatgttcttggcatcgaacatctgctgggtgagctcgggcacggtcagggcccggtactgctggctgccccgggctgtgaggggggngaacggggcatgaagaagtgca

SEQ ID NO: 497619 - DNA, 349 bp, Homo sapiens
  misc_feature (10)..(10): n is a, c, g, or t
  misc_feature (24)..(24): n is a, c, g, or t
tttttaaacnagtttgaatgtggnacaagtaagttgtcctgaagaaatcctctgggcgccattgcaccggttgtcacgcctataatcccagcattttgggaggccaaggcaggagggtcgcttgagcccaggagtttaacaccagcctgggtaacatagtgagacactgtctctacaaaaaatagaaatacattagctgggcgtggtggtgcatgcctgtggtcccagccactcaggaggctgagacaggagaatcacttgagcccaggaggttgaaggtgcagtgagctgtgatggtgtcactgcactccagcctcggtgatgggtgcagagcaagactctgcctcac

SEQ ID NO: 497620 - DNA, 157 bp, Homo sapiens
tcaaactgctcacaccctaattcttcttcagcaaactccattacttccagtttcttccagacacacagcctcagtgaggctaatctacttgtcttggcctcttgtcctgaaggctgattcctgggtagttatttctactcgtatctcgtcattttat

SEQ ID NO: 497621 - DNA, 192 bp, Homo sapiens
tgtggttagcaagccaagccgctgtacttcatcaccaaatagcactcgctccttcctggaatcctttttcctagcttcaccaccgaagtggttagcgctccttccttcttcctagcttccttcaccaaatcgcactggctcctggactcttttcctatcttcaccacgaactgctgcttgctcgcttgctcc

SEQ ID NO: 497622 - DNA, 302 bp, Homo sapiens
acctcttgagagctgttgcccttgctgccgccgcccccggccccgctggccaggaagatcggaccggccgatgcatcactgaccgcgattcatcaccgattggaccatcgacgaagagacttgacggtggctacttgataggtgacgaggcagtagaaaagcttgatacgatgaggatgcacgaggggtagcagagagaacgataagcccggacaagcagaggatcctgcaaggcatgaacactacggttggagcctccagaatcttcaccatgaccgtgaccgaatgacgcacgatagcgg

SEQ ID NO: 497623 - DNA, 298 bp, Homo sapiens
  misc_feature (117)..(117): n is a, c, g, or t
  misc_feature (213)..(213): n is a, c, g, or t
  misc_feature (256)..(256): n is a, c, g, or t
  misc_feature (259)..(259): n is a, c, g, or t
cattggataagggagagggctggggaaacatggcaaagtggaccagttagagccattaatcttgatcattccggttttttttttgtccatcttgtttcatttgcttgccccgccccngagacggagtcttactctgtcgcccaggctggagtgtagtggcatgatctcggctcactgcaatctctgcctcccgggttcaagcttgtccaggtngatcttgaactcctgacctcgtgatctacccacctcggcctcncanaatgctgggattacaggggtgagccaccgtgcccaaccc

SEQ ID NO: 497624 - DNA, 164 bp, Homo sapiens
gaaggtgattctaatgaggatcccagttgctacctccacgaacaggaacatttcacccagcgtcctcctcgacagggtacattccagccagctctctcctcgtacagacacattccatccagtctcctcctcttacagactgggtaccgcagctcgcaattctg

SEQ ID NO: 497625 - DNA, 520 bp, Homo sapiens
gtctagcacagtgcccaggactctgatgagtctctcatcgcattgtaaagcctgagaccgctgcctgtgtgggactgagatagcaggatttacttcacacctctccttagtgacttcaagagcctctggcatctcttactgcaaaggcatctgaatgtgtctgcgttcctagtaagcataatgtgaggaggtggacagacagaccaaccccgtgtccaacgtgacccctgtccccacactgacctgtgttccctctccgatcatctttcctgtaccagagcacagtgggctggatagtctccatctctgtactcaactatcatggtgcgctgcgctgcaacttcttacttccctcaatgacagttaggaacctgcaataaaatttagtaatactcaaaaatataagctatgaagggatgatggattacttaaataaatcaattcctggaaagtgagtcatggtggtgctctggtcatagaaggaggacagcaggtcggagacagagggctgctactccag

SEQ ID NO: 497626 - DNA, 1174 bp, Homo sapiens
acccaccaatcacatgcctatcatatagtaaaatcccagcccatgatcccctaacaggggccctctcagccctcctaagtgacctccggcctagccatgtgatttcacttccactccataacgctcctcatactaggcctacttaagcaagacagctaaccatataccaatgatggcgcgatgtaacacgagaaagcacataccaaggccaccacacaccacctgtcgcaaaaaggccgttcgatacgggataatcctatttattacgctcagaagtttttttcttcgcaggattcggctgagccttttaccactcgagcctaggcccctaccccgccaattaggagggcactggccgccagcaggcatcgacccgctgaaatccgcgctagaacgtcccactgcctgagacatcgcatccgtgatgtgactcgcatcaggagtgatcgaatcaacctggagctcaccatagtctgaattagaatagacaaactgaaggcgaatacattcagagcgacctgttattgcaatttgactggggtctctgatgggaccctcctgagcaagcctgagagtacggcgagtgctccctgtcaacgagtttccggaggagtctacggtgtcaacatatttttgtagaccagcgaggctgccgaagggacttcacgtcagttatgtgggctcacgttgtcctccgctattctgttgcatccggggaagataaatattgcaatttgacaattcgaaaggaatcagtttgggattaggaaagaccggcggcgtggatgatggaatgtgtggatggtgggttgtgactaattgactggaatggtctggagtctatgggagtgaggggtcctaaaaacaagacaacgaacagcaagagggaaaacaccgcgtctgcgcgcgcgaaacgtgcacccgagaaaaccggattgctaacgacacaacgggttcggtggacgcgggggcgaaccaacgaatagggacatgtgacacaccgtggcacaagaagacggaggccgagccgaagaacccgcgggaccaatgacaatacggaagggaggcaccggacataaaagaacgcccgcgggggaaccagaagacaagtggacaaacccacaaggagacacagaggcgtaccgcggacacaacaagggcccaaaggcgaaca

SEQ ID NO: 497627 - DNA, 309 bp, Homo sapiens
  misc_feature (77)..(77): n is a, c, g, or t
ttttttttgagacagggtcttactctgtcacccaggcaggagtgcaatggtgagatctcggctcactgcagccttgnctcccaggctcaagcaattctcgtacctcagcctcccaagtagctgggactacaagggcacaccaccacgcccagctaatttttgtattttaggtaaagacagggttttgccatgttgcccaggctggtctcaaacccctgggctcatgcctcggcctcccaaagtgctaggattacaggcgcaaacttttcttaagtatgaaattatttcaaaatagaaaggtcgtcgacg

SEQ ID NO: 497628 - DNA, 1022 bp, Homo sapiens
gtaagagattaggtattataaatttaaagtgtatacctcaggagagagagagatagggaaagatacagtcattacaaagcattcatgtatgaacctgggcaacatagtgagactctgcctctaccaaaaaaaaaaaaaaaattagctgggtgtgggggtgcatgccggtagtcccaattaaccttctgagtatctgggaaggatcagtggagcccaaaagttggaggtacgtgagagctatgatggtggtacggcactccagccggggtgacagaatgagaaacctgtctctaaaaagaaaattaaaaagaatcactcaggtagaaatacaaaaaaaaaaaaaacacacacgaaaaaaacaaaaaacagaacaacaaaaaaaaaaaaaacaacgcaacaaacaacacagaaacacaaacaaaaaacaacacaacgagcgagggggacgcgaaacccacgaaaacacaacaagacgggaacagacgaacacaaacacaacaacaaaatagaaaatacaaaaacagcgagcccacaagcaaaaagagataacaaaaacacacaaaacaaaacacgcagaaacaaaacaaacgagaggagacaagataaaaaaagaccatgcaaacaaaagaacagaaacacaaaggggggaagaaaaaagaagcaaaacacagcaacacaaaaaaagaaggaaagaaaagaaaaaaaaagagaaaagcgagatcacagaacagccaacagacacgcacacaccagaccgccagagagcaatgaaacgaaacataagaagggaggacagataaaagagacaagaaaagcagcaaccagacacgaaaacaagacaaacaaagcacccacaccagacacacgcaagaagaccaggagcgataaaagccaacagacagcaccaaccaaagcacaaacaccacgacgacaaggatgcgagaacaaagaaaaagaagcaacaagcgagaagagcaaggcaaaaagtgaaaaatagaagaagaagacgcaagaacacaaat

SEQ ID NO: 497629 - DNA, 112 bp, Homo sapiens
accaatctctcagcgactggagggatcgtcgagctcccgccgcagcttagcctgggaggggttgttggtggaacagtccacagacaagatctcccggcacttgtcacactgg

SEQ ID NO: 497630 - DNA, 607 bp, Homo sapiens
  misc_feature (1)..(1): n is a, c, g, or t
  misc_feature (79)..(79): n is a, c, g, or t
  misc_feature (84)..(84): n is a, c, g, or t
  misc_feature (110)..(110): n is a, c, g, or t
  misc_feature (113)..(113): n is a, c, g, or t
  misc_feature (118)..(119): n is a, c, g, or t
  misc_feature (127)..(127): n is a, c, g, or t
  misc_feature (129)..(129): n is a, c, g, or t
  misc_feature (132)..(132): n is a, c, g, or t
  misc_feature (137)..(137): n is a, c, g, or t
  misc_feature (140)..(140): n is a, c, g, or t
  misc_feature (154)..(154): n is a, c, g, or t
  misc_feature (158)..(158): n is a, c, g, or t
  misc_feature (170)..(170): n is a, c, g, or t
  misc_feature (188)..(188): n is a, c, g, or t
  misc_feature (216)..(218): n is a, c, g, or t
  misc_feature (224)..(225): n is a, c, g, or t
  misc_feature (229)..(229): n is a, c, g, or t
  misc_feature (236)..(236): n is a, c, g, or t
  misc_feature (238)..(241): n is a, c, g, or t
  misc_feature (246)..(247): n is a, c, g, or t
  misc_feature (254)..(255): n is a, c, g, or t
  misc_feature (270)..(270): n is a, c, g, or t
  misc_feature (277)..(279): n is a, c, g, or t
  misc_feature (283)..(283): n is a, c, g, or t
  misc_feature (287)..(287): n is a, c, g, or t
  misc_feature (295)..(295): n is a, c, g, or t
  misc_feature (299)..(299): n is a, c, g, or t
  misc_feature (301)..(301): n is a, c, g, or t
  misc_feature (303)..(303): n is a, c, g, or t
  misc_feature (306)..(306): n is a, c, g, or t
  misc_feature (321)..(321): n is a, c, g, or t
  misc_feature (323)..(331): n is a, c, g, or t
  misc_feature (333)..(333): n is a, c, g, or t
  misc_feature (336)..(336): n is a, c, g, or t
  misc_feature (345)..(349): n is a, c, g, or t
  misc_feature (356)..(358): n is a, c, g, or t
  misc_feature (367)..(367): n is a, c, g, or t
  misc_feature (374)..(376): n is a, c, g, or t
  misc_feature (378)..(378): n is a, c, g, or t
  misc_feature (393)..(393): n is a, c, g, or t
  misc_feature (402)..(402): n is a, c, g, or t
  misc_feature (404)..(404): n is a, c, g, or t
  misc_feature (406)..(408): n is a, c, g, or t
  misc_feature (412)..(414): n is a, c, g, or t
  misc_feature (416)..(416): n is a, c, g, or t
  misc_feature (421)..(421): n is a, c, g, or t
  misc_feature (423)..(423): n is a, c, g, or t
  misc_feature (425)..(425): n is a, c, g, or t
  misc_feature (428)..(428): n is a, c, g, or t
  misc_feature (434)..(434): n is a, c, g, or t
  misc_feature (437)..(437): n is a, c, g, or t
  misc_feature (443)..(444): n is a, c, g, or t
  misc_feature (447)..(447): n is a, c, g, or t
  misc_feature (461)..(461): n is a, c, g, or t
  misc_feature (465)..(465): n is a, c, g, or t
  misc_feature (469)..(469): n is a, c, g, or t
  misc_feature (472)..(473): n is a, c, g, or t
  misc_feature (508)..(509): n is a, c, g, or t
  misc_feature (539)..(539): n is a, c, g, or t
  misc_feature (541)..(542): n is a, c, g, or t
  misc_feature (549)..(549): n is a, c, g, or t
  misc_feature (555)..(555): n is a, c, g, or t
  misc_feature (560)..(560): n is a, c, g, or t
  misc_feature (562)..(562): n is a, c, g, or t
  misc_feature (564)..(564): n is a, c, g, or t
  misc_feature (566)..(566): n is a, c, g, or t
  misc_feature (570)..(573): n is a, c, g, or t
  misc_feature (575)..(575): n is a, c, g, or t
  misc_feature (577)..(578): n is a, c, g, or t
  misc_feature (580)..(581): n is a, c, g, or t
  misc_feature (585)..(586): n is a, c, g, or t
  misc_feature (592)..(595): n is a, c, g, or t
  misc_feature (597)..(598): n is a, c, g, or t
  misc_feature (602)..(603): n is a, c, g, or t
  misc_feature (605)..(605): n is a, c, g, or t
nattaaacatcatgattaaatacacatgaaaggcacatgcatactttacagcaacatccacagagaattagctgattanatganagtgacagttaagaactaaagaaacnggnaaaanngaggaatngntgntatgnagnttttaaatgtttgnaatntgaaatcaaaanaataaaatagagtttaangggaatttaagaaaattaaatatatatnnnaagtanntganaatgtanannnnataanntagttannaaatgttaaaaaaanttatgtnnntatnattnaaaaaatnttantntntanatattattaaaaatnannnnnnnnncnaangtggaaatnnnnnataggannnaagaaaagngaatttnnntnaaaaaaagagggaantgcatgganantnnnagannntnatatngnanaanaaaaancanttaaannctnttttaaaaatacancatnttanaanntagtgaataaatatgatgttaaataaaaataaaanngaaaaaggtttaataaaaaatgtaaaaagncnnaaaaaantaaaanaaaananananaatnnnntntnnannatannattatnnnntnnaatnntnta

SEQ ID NO: 497631 - DNA, 646 bp, Homo sapiens
tatccccgggggcctccccggtttttttgggggcccccccgggaaagaaggcgcccgtgccccataaaaaaggggtgtggcgcgccctctgtgggggggagacagggggcaatcgggcgcagcgacggccgcaggcacccgggggggcaagggaaacttgacctgggagcggggagaacttgtttgtaaacacgcgcggcgcgcgggcgggcaacttgtgcgtggcgccggcaaaatcttctctctccacctcttcatagtgactctagtagaagagtggagggtgggcttccgtggccgcggggcgcgcgggaccacccctgtgttctctcggcacaccacgtggggtgtgaacaacaccactgtgggggggtctagaggtctcccggtatattctcccgcgtaacaatgtatgtgggggggtcgccccgtcttcgcggggtgtctctatttggccgcccgaccaccagatcctccccgaaaagtttttttctcgccctcgcgcgtggggggggggatattcttctatacacgccacgcgtggcccccgagagtgaagacacaactctctctcccccgctgagaaacacacatctttgcactccatatcttctctttctataagcgcgtgaagacatacttatca

SEQ ID NO: 497632 - DNA, 294 bp, Homo sapiens
ggaatatacccgggaactcaattcatcttaacagcaaaaaaactccccaacaatctgggcttaaaaatgggtgaacaggctggtggcggtggctcacgcctgtaatcccagcactttgggaggctgacgcaaagaattgcttgaacctgggggatggaggtggcagtgagccgaaatcatgccactgcattccagcctggactccatctcaaaacataaatgaagaaaaaaaaaatttggctgggcttggtagcacatacctttagtcctagccacttgagaggctgagtaggg

SEQ ID NO: 497633 - DNA, 1373 bp, Homo sapiens
  misc_feature (414)..(414): n is a, c, g, or t
  misc_feature (428)..(428): n is a, c, g, or t
  misc_feature (444)..(444): n is a, c, g, or t
  misc_feature (449)..(449): n is a, c, g, or t
  misc_feature (522)..(522): n is a, c, g, or t
  misc_feature (526)..(526): n is a, c, g, or t
  misc_feature (561)..(561): n is a, c, g, or t
  misc_feature (568)..(568): n is a, c, g, or t
  misc_feature (611)..(611): n is a, c, g, or t
  misc_feature (650)..(650): n is a, c, g, or t
  misc_feature (652)..(654): n is a, c, g, or t
  misc_feature (666)..(666): n is a, c, g, or t
  misc_feature (668)..(668): n is a, c, g, or t
  misc_feature (679)..(679): n is a, c, g, or t
  misc_feature (682)..(682): n is a, c, g, or t
  misc_feature (715)..(715): n is a, c, g, or t
  misc_feature (725)..(725): n is a, c, g, or t
  misc_feature (732)..(733): n is a, c, g, or t
  misc_feature (791)..(791): n is a, c, g, or t
  misc_feature (802)..(802): n is a, c, g, or t
  misc_feature (807)..(808): n is a, c, g, or t
ctcgccccatgtactcgccttgtgccccccccttccggggccccaaccgttccggtctaaccccctccgccgggactgccacccccgcaaccccccagccaccatcgcaagcgaccatccacgactcgtgacatcttaaaaatattatattgggacatgggattagaaaatctttgcttgcttccatcaaagttacagcaaaaaaaatttatgctgatgtgtcctcacacacattgggggttgaatttggacacagaattatcgaagttagtgccccaaaataaaactgcagatttgggatacgcccggaccggagcgatttagggctgttacccggagctacttaccgaggagctcgggagcttttatggtctatgatatccactagaagaagtacatataaccacttaagcngctggttgacagangcaaggaatctcaccnatccnaatactgtaataattctcataggaaataaagcagatttggaggcacagagagatgttacatatgaagaagccnaacngttgctgaagaaaatggcttattgttcctcgaagngagtgcnaaaacgggagagaatgtagaagatgccttccttgaggctgccnagaaaatctatcagaacattcaggatggaagcttggatntnnnatgctgctgagntntggtgtacaanacnaaccttcagccccgcagggaggccggctaaccngtgaaccccnaccccannagagaaggctgtggctgctagtgacctctttgctgtggcccctcatttgacctttcanctctgtctgtnggaannagtactttttactgctcattgtcttctgtacatcttactgggtttaattaagaaagaaagagaaagaaattctgttgtaaaaacagtttaacgagcaagataaagtgtaaacaagtagatgtaatcaggttatcacaggcgaagtagagtaataaatctctcctgcatggtaaatactagacttgttttgccccttgtcctcgtgataagtatgtcggccatattgatttaagcgagcgactgaatgatggaggttcactgaatttgtaaccttccccttggggaagctttggcttcaatggacgcgttacatcggggaaattgttagccttttttctcattctcaccggtcacctcgttctgtgcgctcccactagattattggcggggaacatcctgtgaggaccacacgggctctcaacagccacggtcgcaggcaacacgcgcgcagcgtgaactcacaaatacaccgtaccccccagaaaacaactcccgagcataaaacatcacaaccctcctccaacaatgactcgagcccccctgtgtctacaacacgcgacaactc

SEQ ID NO: 497634 - DNA, 347 bp, Homo sapiens
gtctgctgaaggtcggggcaacatctcatacctccgaatgtttttgtcactgtacagtaacggcgcgccatgcgcatagtcttcctcaaagttgatcttcgacggatctcaggcactggatcatcctcttctacctccatggctgatgagtttgtctgcctctctcgttctcgcctaatctcactctcgatggattcaccgatggccaccttgcaagcacgctggctaatctctgtcaggtcagctccagagaagccattagtcactttagccaggaactccaagtccacatccttcgcaactggggacttgcgcaggttagcctgaatggattgctgggtaccgag

SEQ ID NO: 497635 - DNA, 203 bp, Homo sapiens
caggagtggacactaaaatgacagaatgctgcgtctagctacggtgcaagcgggcagctgaagtgatgaggatgatgatgctcgataccaaggaagcagaagaccgacgcggatgactagacagcaaaaaaggcaaagttaaactagaacaaaaaaggccgcagtgacctattcaacctccacatctcgtctcttctcttgta

SEQ ID NO: 497636 - DNA, 114 bp, Homo sapiens
gaaagcgagtgtccctctcgcgccccaggccggtgtacccccgcactccgcgccccggcctagaagctctctctccccagtcaggaggaaaaaaagaagaacaaagtaaaagag

SEQ ID NO: 497637 - DNA, 818 bp, Homo sapiens
tcggtcccctcctccgtcccgtcgtcctgactctctctccctcctttcctcacgaggatgtccggcttccagatcaacctcaacccgctcaaggcaggccactcggcttcatcaaggtcctcgagtggatagcttctatctttgcttattgcacctgtggaggtttcaagggccaaacagaaatacaagtgaataggtcctcctgcagataactgagaataaaactgttacagctacttatggatatccattcaggttgaatgaggcatcatttcagccacactccaggtgtaaaaatatgtgatgtaccatgggaaaagattacgtcctcataggcgattactcttctactgcacaattacaatgtaacctatagcagactttgtgtacctgtacagcattgcagacctatctgcgtaaactgaaggtacacagagtcatgtatctggatagtcgtaaactacctatgataagacttagtagtatacaaccatgttgccacataaaaaaagaagataggagagcacttcagcctggggaaagctctgacacgatattaaaatagctactgggtcacaactattaattgggtgcaaccttcccggccttgtaaggaagaacagcagtaactgtgtacctctaggatcctgtaaccaacactgagatccctaaaatagatcatgtgaaaataaggtaccaaggtatgaaaacactgggaagaaaatgcatgggaaggatgaacaaggagaccagctacacaggccaacagtaatttccccacaatacaagaggaatcaccaccaaccggaaaacaaagg

SEQ ID NO: 497638 - DNA, 562 bp, Homo sapiens
agcgggggccggggagcggggaggcgggcggtggggaggggcggggaggggcgccggtggcgcaggaagcggtgcccggggcgcgccggggccgtgtgcgcggggagggggcgcaggaagcgggcgaggacagaggagcaggagaggcggagagaggcacacagagatgttgccgatacaggaagccagggacaaaagagcgcaggacgacatggcagaccacatagaatgaaaataagaccagaaggatgcacaaaccaagaaggcagcaaaacaacaatagagcacaacacagaacagacaacaagacatagaatatagattcagaagaaagacaaggacaattagagactaccatcagaaaccataaacaagagcaaacaagagcaaacgaaaaataacaatggagaaataaatgacagcaaaccagcaaacaaaagagaacaaaaaataacaagaaacaaaacgaaaacggtaagaaagaaaacaagaacaacaatagcaaaagaagagagaatagaagagagagaaacacaatgacaggaaaagaagataagaaaac

SEQ ID NO: 497639 - DNA, 778 bp, Homo sapiens
atgccatgactatgccatctgcaaatacgcctttctcatatccacgtgacaaagggacacagtcctggacccaagccagaagcctctgcaaaggctctccttccagacctgcgagatcacatatgacaactctgtcctaccagagtagccatctgtgccagacaacactaccaactgcatctgctggtgccagacctcagcatctgaagacatgacttagatgatcttacccggaggtcgaagagctgacaaagaaaacataggtctcttaaaccaggcaactattcacgttaagggagtagagactgagcaatttctccttgtaacacaagaatctccctgacatctgtttacatctgttaaccgtcactcagcacaaacactccctctgggcatcacttcctgctccatccagatatctgctgctttccagtatctctgatagatcctgagacataacaaataggaagactgagagacagagcaaacatggctccctggaaagacttgtgcatagtcacggaataccatgttcagcaggaggataccagggtatccctccttgagaccagttccatgggtcaccatccaaacaggagtggtgacgacgcgaatgcggccaaagccacaatgataggaagaaccaacaaacagacggatggacaagatgggaaagaagcaaggatgtgcaagcaatcccaagacaaacgaatgcaggcagcagaattagaaaccagacaccattctgcgacagggggaccagagaggagcagagacc

SEQ ID NO: 497640 - DNA, 336 bp, Homo sapiens
  misc_feature (336)..(336): n is a, c, g, or t
cgtgtgggccacataccacagggtcttcgataaagtggagctgatgctgtgcgagaaattgaggccgcggtgcacaccatacagaaggtgccagaacaggtttcttctgggctccaattatgaaaagggggttggtgtgtgctggattggctgttatgggcagacctggagacttagcacaggtcaatctggtgttttgatgggtacaggggttatttgggcaagatacttacttgtgattatttcaaagatttttcggatttggagatattacccagaacttaaaggttaagcgcacaaattgaggttctgagcacccggacaatcttgtgtggn

SEQ ID NO: 497641 - DNA, 256 bp, Homo sapiens
cgctgtcgagcatgatgccgtgcaagatggtgaggcgcccgatcgggatcaccgtgctgccggcgacgcggttgtaccgatccacgtgcaccttgcacgtctcgcagaagaacgggctccaccgcgagccgctcttcacggtgtccgcgccgcagccgcggcacagctcgatcgcgcggttgtagtcgtacgccttccatcgcggctcctccggctcgcacgcgcaccgctgcgtgcgctcgatccggctgaaggt

SEQ ID NO: 497642 - DNA, 891 bp, Homo sapiens
tccacagaggccagagaggcgtcagttacacactggaagaaaaaaccgcccacagcagcctggcactcttcagcagatgatacgggctgtcaaatatggcttggtgggattcggagcccaccaacggtggccttgaaatgtggagcgctatccgggagtgggcagtggctgctggcagacacagccggtcaccagctggcagacactactgggaagtgacagctgaagcgctcccagcagttccggatacggagtggcagatgtggacatgtcccgggatagctgcattggtgtcgatgatcgttcctgggtgtacacctatgcccagcgcaaagctaggaacaaccaatgctccggccaacgagaaagccaccagtagcagggtcatacgggcagaccagacaaggtggggctagtaagctaggagtactgacggcccaagaacgctgacgcctgagtggactgtgacgccaggtcctctgtaggattcaacaacgctacacgagcagactatccagggagtcccatggtggatagccttgacccttatgcatactcctgaggaactgggcaacgccagcactagaccacactaccagcggcctccgcacgtggccccggagaggaaccatactagcgaaatggtcgcaaaaaagatagaaaaaatcaaccaaactccacacgcacaccagaggaccacgcacccaacacaaaacaagaacacgccaggaaccccatacaacatactcacacaaactcataagaacctacacaacaacaaacctcactaaaactcacacaacacaacaactcacaaatgaaattatgacaatacccatacagaaaacacaacaaataccatgcaataccaaactacacacaacaacacca

SEQ ID NO: 497643 - DNA, 517 bp, Homo sapiens
caggaatctggggcctgaccacagattcctctcccatccttttctgctccaacctgccccactgggtcccggcaggggccatgcctaccaagctcgagctggcccttgacccccaccagccccaccttgctggagggcagggaccacagggggattgacgtctgcagaaaaagcgagccacaaaaaagcgtagcggctgatgatatactagtctccaaactcccaccgacttcctccatacacaccaatgatgagcctcatgccagtgaggacccggaaacgctagaggaggggtcccagtggagagccatgagaacaccatactgtacatgagcgaacagaccatcaatgtaccataaggaacacacgagaaaggaaaacatgtaggttcaattagagctacctaaagcatagaaacagagtaggagatagaaaagagacaacaacaaagagaaaagtgcaaagcaaggaagcaagaacaaagaacaacaaaggataacaaaacaatctcaaacac

SEQ ID NO: 497644 - DNA, 370 bp, Homo sapiens
  misc_feature (8)..(8): n is a, c, g, or t
  misc_feature (35)..(35): n is a, c, g, or t
  misc_feature (108)..(108): n is a, c, g, or t
  misc_feature (120)..(121): n is a, c, g, or t
  misc_feature (144)..(144): n is a, c, g, or t
  misc_feature (252)..(252): n is a, c, g, or t
  misc_feature (339)..(339): n is a, c, g, or t
ccagaaanagctcagatctcaagcatcatggacgnactagatataccattgtctgatgtaaattcagccatatatggattgatatggtttggatgtatccccacccantctcatcttganntttaaccccctaattcccaggtnttgtggtaggtaattgaatcatgggggcagtttccctcatgctattctcatgatagtgagctttcatgagatctgatggataagtgcctggcatttcccctactggcnctcattctcactcttgccgccctgtgaagaggtgccttccaccgtgattgttaagtttcctgaggccttcccagccatgtggaactntgagtcgaaaattaaacctcttttataattg

SEQ ID NO: 497645 - DNA, 802 bp, Homo sapiens
gacgctgctaggggctcaccaaaaggcacaacctgctgcatcgtcaatcctgcgaggcactcgtgtcacgacctgagaaagcagtcaccagctggagactgatactgacatgtgcatgatacttgtgtacaacgctgaaatctgctgaataggctactaggccatctggggctctgcattatttctgccttccatatcttgtggtcctgcattcttaactggtgtaatcagattcgcatccagaatactagctatacaggagtctggaacacacagaattccagtatccaacttctgcgttgtcaggaaggcttactacaaggaggaagtcgcatgagtgatagctgatcctttcccaggcacttcatcttcttaaacgatagtatattacttacaattctagcccattcttgagtggcgtcatcgtccatctcgtgtgagcttctctttgcataatggcctgtagttggaataatcatagggccaagggattttaacatctgtacgtaacttttgtcctaggttagcttgtatctctcccagctcccataactgctgctgagacatctatgtttgatatcattctgacgtcaacctcccctgcaagccacgaggcagggagagcacctcacccaaagcaaccagtttattggctggtcagcaacctgtgatttctgtagcttaaaaagatgagtggggcttattgtcttttgaactacgacaaaaaggaaagaatttccaattgggggtgggagcttcagctgagaggtttgaagtgagtgggtgtattcttttgcaagac

SEQ ID NO: 497646 - DNA, 285 bp, Homo sapiens
  misc_feature (9)..(9): n is a, c, g, or t
ccccgggcntgggcatctgcccccccaccccaggtgtgatttaacatcaagaaatggaggcctgaaccattttgcattttccccctcctcccagccctctgagggcccaggcctgaaggtactgtcccggggttttttggttttttaaaaccggggttgggggcctaattttaattccttgggggccttttttcctggccaaaaactaaaaacctcgccaaggtaatttctggggtttctatccagcttgggtttcatgttttaaaataaattttaaaaagcaaa

SEQ ID NO: 497647 - DNA, 432 bp, Homo sapiens
gagagagagagagagacagatatagatagagagagagagagagcgagagagagagagactgctacagagagtctctgctggcgattgtgggatgctcattacttgcctccttgtgccgctgttggtctgccatatcggacagtgcgggctgcctgcccttgccctgtgcgctcttcatgtctgcctatggccttgttctccttctagagctctgcattccctggtgctgctctgtaccgtgtattggttgttcctcctgtctgggcttcttccgtgtcctcggcctcgccatgcgagttgactgttgaggcttcctatcctcctgaacgattggcggatcttgacacatttatgcgctattgtactcgatttggggaccatgatcatagttatcagctataacttcgccttctttcagtctacgttatggct

SEQ ID NO: 497648 - DNA, 133 bp, Homo sapiens
acatggaacagttagaacttgccacatatccagaacataaggaaacttattaaatcaatacagtcacggaggacttaacacacataggggcaggagggtagctagcgacttatgcagcctaaaatgctatcta

SEQ ID NO: 497649 - DNA, 227 bp, Homo sapiens
aattcgaaaaggaacagacagcaaacaagcagtagagatgaagaatgataagtcagaagaggagcagagcagcagctaccgtgaagaaagatgagactaatgtgaagatgacgagtctgaggagcgggtgcagatagcactactgctgagcagagggggacctactggatgatgatgataatgaagatcggggggatgaccagctggagttgatcaaggaaaaaaaa

SEQ ID NO: 497650 - DNA, 893 bp, Homo sapiens
gggcctgattaaacctggagactcgggtggccgaggggctctcataccagctgaagagcgacaagccgctgggagccgcggatctcaccgccggcttcaggggtttctagaacttcagccattaacaatgggcaggaattgttcccttgatcatatcgggtggtaccccgtcgtgttatcgttgtggcaaaccgtgtgatagcgatccttgatcatacctgttcaggaattcatctccactcgttccacatggcgccactgggagagcatgtctcttctgtaacaaggtagttaacctgcatgtacacgcgaatgttcaaagatcggtgtcatgctcactggccgccagttggccacgagatgtgagctgcaaaaagtgcaaatagcaaacttgggatgtgatctattgagtttggccattgaagacagccagcgatataaggaaaggccgcgtgatccaggaacgtgctctagttcgagagagtgagggctttgaggagcatgtaccatctgataactcttgaagataccgagagaaatcatcgttttcaccaggtcgtccttcagtgaaaacaaaaatctacttacattacactgttcaccttagcatcagaggtcggataatgaactgcggacagacgtggcgaatctcacgatggacctttgtcttactgcatccaaagtctggttccatcacaccggggtgagtgaatatttcgaccggggatacccattgacctttgcggagggcttgcgtatgtgcgtatcaacataggcgaaagctcttccagaaagggtcgttctctctctgtatcctagttgttttgtctcctgtgtgaaaagacacacggaggacgcgagtagagagaagacgacggacacatagaaggacg

SEQ ID NO: 497651 - DNA, 309 bp, Homo sapiens
tatggaaacactgaactaaacttatatttctatgttgtggggacttggataactagcccaggaaatgactctggttttgattgtcctgtaatgggcagattgctccctcggttctcgatatcttgaccatctattgtgtgatcatgcccacacccttcccacacccattgagcccttagcctcaactacttacccaccccatactcttaccacgagagcacccttacttggcccggcttccaaagaccctccaaatctccgagaagataaacagctgctacctcttagtattattctgatttcattttg

SEQ ID NO: 497652 - DNA, 268 bp, Homo sapiens
catttgccagaaccgtgtatgagcgggtgggagagcgctcgggtcccggcccctccctctccctaatggtttcagttggtccttactgttggaagtaaaaagtgaagcactttattttccctgtggttgttcacgttatgcctggaagtggggaccccttactggaaccacgtgtctgcgacttgtgtggagtgtcaccgcgtgtacatactgtaaattatttagtagtggctaaatgcaagtaaagtctggtttctttgttatttta

SEQ ID NO: 497653 - DNA, 137 bp, Homo sapiens
agctgtacccccgctgccaatggatcgagacacagaaaaagtagggcaacgtgcactgaccaacacatccgctcacacatcagctgggacaggaaccactggggcagcacgtcacaacacaacacagacagaacaga

SEQ ID NO: 497654 - DNA, 501 bp, Homo sapiens
gatcccggtgtatcctttgtctctactaaaaatacaaaaaattagccaggcgtggtggcaggtgcctgtagtcccagctgctggggaggttgaggcaggagagttgcttgaatccaagaggcggaggttgcagtgagcggagattgtgccactgcactccagcctgggcgacagagcaagactccatctcaaaaaaaaaaaaaaaaattctccaattatgactgtggatttgtgtggcctcttttggtccttttttggaagcctataataaggttacattccaaatttaaggatttttgtgtttccctaattgtgaatttgccctttaaattatttagaaaaagtgctttattccatttataattcttcttggatctccccattctgctttggcctttacatttaattaatagcccacaaccaacctttctttgggtttagccaagtggcacaggtgttattcttttccttgctcttttccctttctcaccctttttggtg

SEQ ID NO: 497655 - DNA, 121 bp, Homo sapiens
  misc_feature (24)..(24): n is a, c, g, or t
  misc_feature (96)..(96): n is a, c, g, or t
  misc_feature (103)..(103): n is a, c, g, or t
aagcggaaggcgtagagaacgggnttgaggccacagcgggcgagggcaacccgctggtcaccagcagtgcgacatccttgcgtttggtggcagggnaggtccnctccgcgcgcagccagta

SEQ ID NO: 497656 - DNA, 672 bp, Homo sapiens
  misc_feature (108)..(108): n is a, c, g, or t
cagaactggaaaagctgaaatggtgaaaactatgctgcctccagcttcagtctcctttccccatcagctcgccctgaggcaggttcatatattgagcatctaaccgtncatagaactgtgctttccattccgctgtgggactctaatgcagccagtgggatatggatgtaccactgtctaaggaagacagatcatagatccatgatggatgttgttcaagggtttcctctcctctcacgaaggcagtaccagccagtactcctgctctgtaaaacctgcggtgcaccaccctaagcgggtaggctgacagaggccacacgaccatagctgaatttgttctgtaggcgggaggcacaagccctgtttcttggtgtaatcttacagatgccccttttgctttcacaaagatggtctgatggttttatgtctaaagtatttatatatactaaacatatactaacatttttataaagagacgtaaaaaattcaacgttattttaacaagggaacatttatatacgatatggtgcttttatctatatctcaaggttccaaaggaaacaattgtgttggtccattgttgcatttcttacaaagggagacacaaattattggggaaatggggttaaaggcaggatgagagggattattgagttgttatggaagaaacag

SEQ ID NO: 497657 - DNA, 151 bp, Homo sapiens
caaagggggtttttttaaaaattttaagaagtagcgtattgggaacccttaatgggttttttttcccaaggcttccgctttgtttttagctaaaaacccttaaaaccaaaattattataaaaaaaaattaattaaaagggggggccgccca

SEQ ID NO: 497658 - DNA, 347 bp, Homo sapiens
cattccatgtatcacattatctaaattaaacagagatgctgtagactaaaaacatgtttgctaagtaattacactggacctaggcaaaaccactgacgaacaggtgttcctttttaccacataacgttttgatcactgctgctatgagccacgctataggtataattcagatcattttagcttgtagctgaggatgtcacatcatagacaggatcaaacctgaaagacactaatggttcaatcctctataaggccaacaaggaaaacaaattaatgtgatgtaacttgcatatatgtgcactctgcataggtacccaataatactgtactgtagctgaacacctttc

SEQ ID NO: 497659 - DNA, 164 bp, Homo sapiens
ccaggggagagggtcaccatgacctgcagtgcagctcaagttacgttcatatattggtccaacagaagctggatctccccagactctgattatgacacatccaagtggtctggagtcctttcgcttcgtggaggggctggactctattctcaatcacgatgggg

SEQ ID NO: 497660 - DNA, 333 bp, Homo sapiens
gacggagttaagataaagtactggagcaggtaagctctcatcccagtgcctgctgtgtttataagaagagatggaggccgggcacgatggctcacacctgtaatcccagcactttgggaggccgagacgggtggatcacgaggtcaggaaatggagaccatcgtggctaacgtggtgaaacccatctctactaaaaatacaaaaattagccgggcgtggtgaagcacacctgtaatcccagctactcaggaggctgaggcaggagaattgcttcaacccaggaggcggagactgcagtgagccgagatcacaccactgcacttcaagtcgacg

SEQ ID NO: 497661 - DNA, 719 bp, Homo sapiens
ggggttgaagaaagatgatcagagcctaaggtacctgcggtacaccatcaagtgagccaacgtatgcattgtgagagccccagatggaaaagagggagacagaaaggggcagagagattatttgaagaaataatgaataaaaacttcccaaatttgttgaatgacatgaatatgaacatcaaaaagctcaccaaaatacaaatagggtgagcctgaaagactcacaccaaaacacattataaatactactattgaaagtcagagacaaagagagaattttgaaagcagcagaagagaacagatttgtcatgcactagggatcctcactaagattatcagcagattttttcattagaagctttacaggccagaaggctcagatattcaaagtggtaaaagaaaaaaaactctcagccaataatcaccgtatccaacaaaactgtactgcaaaagaagtaaaggagtgaaggagaaattaagacattcccagataaaacctgagaaaatttattagaactagatctgccctttaagaaatgctaaagggagtccagaaggttaaaatgaggtgatgctagacagtaacttgaagttatataaagaaataagggctttgtattggtaaatatatttgaagtagagctagtggtattttaacaggggatgtaattcacttttcggtcctatatgaattaagacgatcggattttatattttgg

SEQ ID NO: 497662 - DNA, 183 bp, Homo sapiens
acggatgcgtatctgcctcgactatgaaagtcataccgtataaaagatggcgtgtttctttattttgaagatgctgcaggagtcatacgtgaacaactaaaggcgataatgaaaggttctgccattacaggaccagtagcaaaggattgtgctgacttttggccccggattgcatccaatgct

SEQ ID NO: 497663 - DNA, 758 bp, Homo sapiens
ttgaggccggtgtaatagcgaagtaagagatagtgcgcttcggctttgaggtgctctacatggacagctgtgctcggcaccggatctaacgctgctttcaaggaactgctgggttcgggcatgcaccaccacctccagcacaatgagctactccgtgacatctttggcctgggccatgtgtctgttgctggatgccactgcctctgaaggcctgtaaggttccacgtctttgagaagcacctgtacaatgctgctgccttcaaaagcccggagccaaggctcgaagccgtgtgccgggatcaagcagggcagacatgcctgtgaagcaggacctgctgaagaggagactttctatgcccttggtccgtatttgtgtaacagaagacagtgcaagcaactggtctccaccagtatttgtcactttattgttttttaatgacaaaaccagaaaacagacatggggtgggtagctgggggcccgcacacgttgggaccctgagcaccattgtgtacactgcactcagccatgtggcccgttcgtgtcactgtctcaggaccaggataaatagtgtgccttcgatcagggctgatggggcaggcactagggggcctttcccttcctgttcctctctcaggcgttgctcccccaggatgacccactcttaggggggtggtggcatctggacaaatgccacaaacagcaggtaggggtggcaaagcgacctgtaacgaccggggggtgcctcaagttttgttaa

SEQ ID NO: 497664 - DNA, 147 bp, Homo sapiens
  misc_feature (1)..(1): n is a, c, g, or t
  misc_feature (102)..(102): n is a, c, g, or t
  misc_feature (128)..(128): n is a, c, g, or t
  misc_feature (136)..(136): n is a, c, g, or t
ncacacgcctcttgaacggtaagcagagatcaaaagcacagcagcagtaatactgggtaagtccttttgatctctgcttaccgttcaagaggcgtgtcaggnccgacagtcggtgaccccatcactcngcaggacnaaagggggggg

SEQ ID NO: 497665 - DNA, 1190 bp, Homo sapiens
aggctgtacgctcggggttaaacgggatcgtgtcagctgccagaagaagggaaagctgccgagtgatcgaagtggagtgtactgtagctacagcttctggaatagattccagtatggacagtctccgacttaggatttttcaagcttgaggagtggtgtgaaagagacacccattcagatagataagagctgtacttcgagatccagcatgttagatctgttcctggacggctagggataatgatggttacagtgagccactcgttgatgaatgcttgggcagcgggacatgtgtagtgcacagggtcccgaggtcacgccatgtgatcacgggaaatcaaacaatgccatcctcgtaccgctgtactgctgtctgtcaagcctctgttatcggagtattggctgcttttggtgatgcattcatcagtgtctcatgagtgtctaccaataatagtccatgtcacgaatggtactccgtgctattcatgggtgagactgaaggacatggagcgaagggcgaactaacgtctatgagcatgacaaccttccaaggcatacgtcgcccaaggatagacaggtcggagcaaagcgacaggaagtgggccatacgcacgggacgttagggacgttgaggcaagccacggaggttacaacacagaccttcacagggatacagaagcgaacactcagatgctagcacgcgagacactcgtcccgccaaatcaggctaaagactcccgaccttgatccttccacgcagaccgaccaacgggccctgagaagcgaactcggcaccgactactggcacacacacgcacctggtaatcgctgcgcacgtggaaaggacccgcgaacacccagaagccgcgcatacccaccatagggcctactggccggcatggcctcgggctcaagggctaacgacagcgccctactgaaccccctcgccgcacatacgaaccggtagccaggtgaatcccaacctaatacccccaccatgggtcgaaggcgaaagtcaaccgaccgggcattcccggcggtgagggggcaataacaggcaggactggggcccgtcacgcgccgcgtcctccccccccctcctccccccgctctcgtacgactgacatgacaggacgcggccgggcacggcacaacaaatgacgccaagacgcgcgcaggcccacatagag

SEQ ID NO: 497666 - DNA, 1229 bp, Homo sapiens
  misc_feature (52)..(52): n is a, c, g, or t
gccacttggtgtgcaaggtggcccgttttggccacagtcctcagggcccaanttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaaaaaaaaaaaacaaaaaaaaaaaaaaaaaaacaaagaaaaaacaaaaaaacaacaacaaatcaaatagaagatgactgagagaacgcgtcgtcgctcccccagctacaacgaccgcactctttttgctggtgccccagtgtagatgccccctctgtcaatatagcagaggcagtccactaacattacaactgagaatgcgggctcggtcaacagcgactggtcacacacaaagcagcagtcgtgccgtagtaccaaaggcacgccctgctcacgagaaagcgcgcgtgtgctcgggccacacttactctctgtacggctggtgggcgcaatcagcttggtgggcggcacatgaccaactcggcgtaggcaccccgcccacgcggagcaatacac

SEQ ID NO: 497667 - DNA, 212 bp, Homo sapiens
tgatgtttttgacaatgctcttgtcaataggaacaagacagtatgcttctctttgttagtgtagttcgtttggtagtattcgactcactacgtacttgtgttggctgacattgttcgattggctgggttgtacctagccaaggtattgggcccagcttgggcactgcccaaagtgaccaaggtgctgaacgctgtgataccggagaacttca

SEQ ID NO: 497668 - DNA, 877 bp, Homo sapiens
tacgtaaaatctttttatattcagaaaaaaaaaaccccaaaaaacaaaagtttcccaacccacaccggggagggttctgggtagggggaggtgtctgtccatccagcccgggcccccagcccaggtggttgggcagcaagaagggggtacgaggggtaagggcccaaacaaataaacagggtcgagtgtgtgatactagggaaaggaaaggggtgcaaacgctgagcggagagcgaggaacggcgagcacggagccacgacgaggatcagaacgtgggcaaacgccgaagggtggcgaggccaattatcaaaacattgtcatggagtcgaaccaacaccacggggacaaacaatagaataggccacaaaaaaacacgggaacataagcgatcaggagaaaacaaacttgtggacgactggcgaaatacgaacggggggggcccccacagggggagcgactatgaggaaaccagaaagaactcacagtgaatacaacatcaccccagtcacgggcacagccccaggagaagaccacgcagacactaagcaaaaaaaaataacggggacaccacaaaagcgtgactccagccacagtacacgaaaaaaaacatggaacgcgggaaaattagaccaaaacgaaagtgaaaaaccacaaactctccaaacgagtgaaatgtagaaaagatgcgaacagaacaagggtagtacccgggggggacaaaagggggggaacacacaaaagagagaaaaggcaggaaaccccattgaacagggccccaaacgaatgaggccccagatccaccacgacaacaggaggaccgcagacccacgaaagacaaggaacatagccaaaaagtgacagtgacgggacaccccc

SEQ ID NO: 497669 - DNA, 769 bp, Homo sapiens
tctactacaaacataaaaaaattagctgggcgtggtaccacgcacctgtaatcccagctactcctctggaggctcagacaggagaactgcttgaaccgggaggcggaggttgcagtgagctgagatcgcaccactccattccagcctgggcaacagagtgagactccatctcataaaaaaaaaaaaggtaaggaaaaaaaggaaaatgttttattcattttctttcctaaagaatatattggggggataaaggattctgggtggacagtttggtggcttttaaaaagccttttataaattgtggctccatggtttctgatgagaaatctggcatcactgaaatctggcggttctcctatatacaaggtgtgttttcttccagtttgtttcaaagtatttccttaacagtgggttccatcacttggattatgatggtgcctgggtgtggttacctttggggattgtgctgtgccagagacggttttaaatacgaatgttctgtacctgtctgtgacatattggtcttgtggccacgatgttgtgcaagttttaggctataattcttcagatatattttcttccaatgtgtgctttcgtggggtctaaggacatgaatttagacgctgtttcattttgtgccaaagagtcccaaggggtcttcttaatcttttcacattttctttctggccatcagaaaaagaaatttgggcatgtttttcaaattatggacttgcacagaatttcatggtgtggagctcaggaaattggg

SEQ ID NO: 497670 - DNA, 347 bp, Homo sapiens
  misc_feature (27)..(27): n is a, c, g, or t
  misc_feature (44)..(44): n is a, c, g, or t
  misc_feature (82)..(82): n is a, c, g, or t
  misc_feature (182)..(182): n is a, c, g, or t
  misc_feature (189)..(189): n is a, c, g, or t
  misc_feature (208)..(208): n is a, c, g, or t
  misc_feature (219)..(219): n is a, c, g, or t
  misc_feature (339)..(339): n is a, c, g, or t
atatatatctttttaaaatctttgttnttgatgacaaacttaanttgtgttaatagggctggtgtgatggctcacacctgtnttcccagcactttggaaaacctaggcaggaggatgcttgagcccaggagtttgagaccagcctggacaacatagtgagaccccggctctacatatatatnttttttntttagctgggcgtggtggnttgtgcctgtngtcacagctactcaggtggctgaggtggcaggattgcttgagcccaggagttcgaggctgcagtagtgagctatgattgcaccactgtactccagcctagatgacagagtaagaccctgnttctctaa

SEQ ID NO: 497671 - DNA, 476 bp, Homo sapiens
  misc_feature (20)..(20): n is a, c, g, or t
  misc_feature (41)..(41): n is a, c, g, or t
  misc_feature (46)..(46): n is a, c, g, or t
  misc_feature (73)..(73): n is a, c, g, or t
  misc_feature (83)..(83): n is a, c, g, or t
aaggaattaagggtttttangaccacacctaattaccttcngccantttatttagttggataaatcgggatcnaacacactcnaatggaaatgaatgcttagaaaactagacaaatactgatatttgctcctttctgagggagaaagcctccttggaactgtccaaggtgctgatgtgaactaacggaaacacttcattagttccgtctacccacctctttccaaaaagattgcttattcagagtatttttaatcacagtatttggctttgtaattcccacattctgcaatagttatgatatttggggccctgtccatgttttagtgaaatcctaactaacttgattttgtttacagctgcttattctgttcccatgattagccctaaatttatatttaaaaagttatgagccatgaatccatgtaaggttcaagaacatttcagcaaataagaacagcattttcattctgttaaa

SEQ ID NO: 497672 - DNA, 298 bp, Homo sapiens
ggtgcatgagttagccatctgcgattggagatctcgcttacaactactaggactctcactagcgtcacaatggcgtcaggatgaagcctcaggctcgctcagatgctacgatcatctccattcagatcaacagctcacacgaggtcaaggtgttcagctgatcatcatgcgagctacaatcatagatgatcacatgctgctcagccagctcatgatcagtcatcaagtcaggttgatcagctcagcgcttagtcagagctcagtcagtcagctcatcacatgtcgtcatcatcgtcaa

SEQ ID NO: 497673 - DNA, 195 bp, Homo sapiens
tatgtatgttggtaggtgggggtggtgttgtaatagtcgctatactgcttgtatgtattataccttcgataatcaggtccctcttctatagggctcctgcagtttgctgggggttcacttacaggccctattcatactgatattgaaccaattgcctggaagatgtcattcaaggagtgctggagacacagcaaa

SEQ ID NO: 497674 - DNA, 574 bp, Homo sapiens
gacatcctagaggatcccttatccgtgtcggggttgtacatgcatggcggtacggccatgtacgcagcgtggcggatcggctcacgcccatcagcacaaatgcaccaggatcttccctcctggctggctcagcgcccggtggatgaagtcgtcagccgtcttgaacacctggatgctcatgtcaaaggctggcgagtcgtgggcctcaacacccaggtagcggatgcccagcccctcataggcctcgggcgtgcctcgccaccggctgtgtgaggcattgaggacgtgcgtgatgcccaggcggcgaagctcccggcggttgttagccatgtcctggtctccgagatagaggcctggccagacctcgtcggcatggttacaggctgtcttgcctgtgtagaggagccgctccaactcgaagacattgaggaaaggatgttgaacggttggcatctcctccagggtccctcgagttcgaacaggagaccttgagctactccgggagaagcgggccataaaagtcatagaagcccaaagccagttaccaggacacatcttagaggtggagaaaccg

SEQ ID NO: 497675 - DNA, 118 bp, Homo sapiens
  misc_feature (52)..(52): n is a, c, g, or t
  misc_feature (68)..(68): n is a, c, g, or t
  misc_feature (104)..(104): n is a, c, g, or t
gacattacctaacagttccagtgctcagtaaatattcattatgattgacaangcaaggataagtgtanaagttctaagggttcaaaggagggattacaggcgtnagccaccatacctg

SEQ ID NO: 497676 - DNA, 542 bp, Homo sapiens
acaggttgagcttcggaggaatgttctgtatttcattttggaaacctacgttccttccactttcctgggggtgttgtcctgggtttcattttggatctctctcgattcagtccctgcaagaacctgcattggggacaacaaaggaagtagaagaagtcagtattactaatatcatcaacagctccatctccagctttaaacggaagatcagctttgccagcattgaaatttccagcgacaacggtgactacagggacttggcaatgaaaaccaccgacaaggtcaaggtggtcttccccgaaaaaaggggccggaatgggggattatttcacaatttaaaaaccccagcaaggggggtcacttattccaaaaaacggggccccttggatttttatggccccccacggatttttaacggggccaacaacaagtattttttgggggcgggggaaaaatttttgggcggcccaagggctttcccccggcacacaaaaaaaggtgtaaaatgggtttttttaggcgccggggggccccccccacca

SEQ ID NO: 497677 - DNA, 873 bp, Homo sapiens
ggggagcgacgtgccgggaaaggcaggagggccccagtgttgggggcgggggttgcgcgccgtggaggggcggcctcaggctgggagcctggcagatcgtctgactctgccctcggagccccatcccaggccgagccaggacccctctgatgcatcaggcgtctcaggagcccgtttctttcttgaatccggggcccagtgcggcttgaacctaaggcccccgacctcctcctcgccctctcagagtccgctgggtgtgggcgctgaaggagcccgggtcggagaggagccctccccttctctcctgcgtgatgccctgctggctccgtttctttttggggactggggtccggggccttctgcctgacccggggtgagagtgggagccctgcatcattgacgccggtgagagggcgctggagcccgggagcggcttgtgagccttgagcggcagccgggacgtcaggatggggtcaccttctgccccaggtcccccactgccagtgatctctgtcaccttctgggggtctgtcccctggggtcccacccccccggggctgctgtgcgtatctctcatctggacgtgtaaataccctcttatagtacggcttagcacagtattattcgccccatgcacccccctttttattccctttaataggtgtcttttgggctcggatcaattgggttttcctaacatgatgttgagcattttaacgaccctgtaagataggctgcatgggcacatcaatgaggggcgtccaaaccgggtatggtgtaaatctcaactatgtcaggttagtacgaaagatatgggacaatgcgtatggctcgacacaccaagacgtgagtcagttacgtgacaggtgtggt

SEQ ID NO: 497678 - DNA, 123 bp, Homo sapiens
gaacgtactcagaaaaagtaacatgcaaggtaattggaaatcagactttaaagcatgtttggaaaagatggcaagcatttccattagttgttcatagcgttttatataagtgactggactcca

SEQ ID NO: 497679 - DNA, 1133 bp, Homo sapiens
gatctatcgtagagcatttgatggggtgcgtggtgtcacagaagggtactcggaatctgcggtactatggcgtgccctcgtgaggagccatgctgtcgtgcatagacgtagtggctaaggcattcgtcgaggcaagtgatgaaaagaagcttcgcgctgaagagatcgaagccgattcctagagaccagagatcccagcattcgagcagtctcttgcacgggtgccatttacctgtggactcgtgattgaaatgcgaagactaccgataggcggagacatgctgcagtaatcgagacctggagcagtcccacaggctgtgacaacgacaggagcgtggctggcagggcttgtgcaccacttgtaagaagaacaccaccacatgcgtggttgtggcgcatttgtgcggctcacgtgtgaaaaccccatccgaggccctccgggactcttcaagcacttgtcatttgctgcagcaacatcaagtgattgaactgcaagaaggcagtttctcataacacgacatcgggcactaaaatcctaaggcacgcacaggccctttaaccaacgatacctgccaagcaccatggcacggcatgcagggcatgcgcaacgacagccacgctgggacagacacggactatcaagacagcaatgacaagacaagtacctggccaaagtacataccggtgtccatttgcccaacacccacagaatgacgccttgattccctcctgcggccacgaagcaaggccacaccctagatgggacgatcccaggatgaaccgggacggcactggttggccgagaaagctggacatgggcccgcgagacggctttgacgcagcagggtacctgtgaagaccaagtgttgaggcacggatgcggatgatccgacgtcatcggagatgaccaagggcaaaacggctaccaaggggtcacccagacgtagggaaacccaacgaaggctggccccgcaagacccaccgaggcctggcgccaggggggctggaatgggcgctggcacatcccggccgtgtaacttctctggggcacgcgctggcacaagggtacataacggagtgggtcaagaaaagattaaaactggcacgaaactatcaggacgaaagcgaacaaa

SEQ ID NO: 497680 - DNA, 657 bp, Homo sapiens
cctaattttatttttatttttaattttaatttttttgtttgagatggagtggcactctgtctcacgtagtctggagtgcagtggtgcaaacttggctcactgctctccagcctgggcgacagagtgagactctgtctcaaaaaaacaaaccaaatcaaaacaaaacaaacaaaaacaaacaagaaagaaatcatccttagagatcaaatgatattaatttatagtattccaaattaaataaattgttctcttttgaagggattcctattttggtattttaaattcttcatcataattatttactgctgataattcatattacaatgaaaatgcctgttatttatgcatttctttttcccttcctttccttttttctattttcccttttccttaactcctttcctcctccccggggggcccccccttttctcctttctccggtttttttggaccctccccttcccccttttttttcctcccttttccctttccccccctatttttccccggcccaaattctgaccccgggggatccctctattttaaacggccgccccccgggggagaccccccttttttctcctttatgaggggtatttcaccctggggaaaaagggcaaattgttcccttggaaaaatttctcccccccaatcccg

SEQ ID NO: 497681 - DNA, 603 bp, Homo sapiens
atagagggaaatgaacggaagacgagaatctcacagtagtatggttgacatataaccaaatgtattcatctcaaaataatgaagaactactcctaactattacacgtcctcatttctgcaactgtcactgtccctagctggatatagtgactatctttacatcttgctctcacagccatttcctttgggcctgggccggtggacgtgagcgtgggaaagaccagaacccgcggtgccccccaccgcactatcctcgggtctccagaggtgggatccactgggcaggggccttggctggatactaaaccggctctggggatacaagaacagctgcctttgagaaacagttcgggtctctatattccagacttcttagtaggactaaacccttaatttccacccgggaattcatggttctcctaaaaccctgcggtggaatgccttccttcaccgagcatatatggggcacctactaggtgctagggtggctctgggcgaagggctgcagactgtgcaaactccaggtccctttcctgtggatcccacctctgaggacccgagggggacgcagtgaggacaccatgggttctggtccctcccacg

SEQ ID NO: 497682 - DNA, 218 bp, Homo sapiens
gctcggtccatccagattatgtcggaatttcattgtaatactctcataactcttttcatttggtctacatttaaggggaatttttaaaggaaatgttttttctttatttttttggtattttcagagggggcaaggaagggacagaaaagtaacctcttctataagtaggaatattctaataaagctacctttgagaaagtagccagtgtaaattaatc

SEQ ID NO: 497683 - DNA, 376 bp, Homo sapiens
  misc_feature (29)..(29): n is a, c, g, or t
aaagaggttggtccagaaagcaacttctntgtccttcagcttctggcccgcttgggtgttggcaccaatctgcagatacccttctttctggttgtactgtgcacagtgggacaccccttccctattggggtttccattgcgacgcaaagtgtggcccagaaaaaatggggcccacaaagccgaagaagggctcatcgccgtgtgtctcctatcaccgtcttggtgtttcatgtctgatgagaagcttggacggtactgaaactcatcacatgtaggtgggtgctccagcatctctgtggttccgggccacactcacatatggcaccctaaacatcacatctgctatcgagtacaggcacaggtctctctttgtggc

SEQ ID NO: 497684 - DNA, 298 bp, Homo sapiens
tggacagtatacggtgagaagaacatcagttatacacaagatgatgccatgtataacgattccacagatcagtttatgtcagtatagtggtcaaagttatatgtgatatcaatgaagaaatttttgtagcatgtaatcggttatttctgttacttaaaaagtattgttagtgggctattaaacttggattttactttgttatgaatgcagtatgttctttttattcaagtatgaacttgtagagaaactatagtaatatgattgttaagagatttatgttctacttaaaatgtgaatt

SEQ ID NO: 497685 - DNA, 906 bp, Homo sapiens
  misc_feature (123)..(123): n is a, c, g, or t
  misc_feature (127)..(127): n is a, c, g, or t
  misc_feature (139)..(139): n is a, c, g, or t
  misc_feature (166)..(166): n is a, c, g, or t
  misc_feature (185)..(185): n is a, c, g, or t
  misc_feature (214)..(214): n is a, c, g, or t
  misc_feature (222)..(222): n is a, c, g, or t
  misc_feature (231)..(231): n is a, c, g, or t
  misc_feature (253)..(253): n is a, c, g, or t
  misc_feature (258)..(259): n is a, c, g, or t
  misc_feature (279)..(279): n is a, c, g, or t
  misc_feature (283)..(283): n is a, c, g, or t
  misc_feature (289)..(289): n is a, c, g, or t
  misc_feature (300)..(300): n is a, c, g, or t
  misc_feature (304)..(304): n is a, c, g, or t
  misc_feature (313)..(313): n is a, c, g, or t
  misc_feature (321)..(322): n is a, c, g, or t
  misc_feature (334)..(334): n is a, c, g, or t
  misc_feature (336)..(336): n is a, c, g, or t
  misc_feature (347)..(347): n is a, c, g, or t
  misc_feature (357)..(357): n is a, c, g, or t
  misc_feature (365)..(365): n is a, c, g, or t
  misc_feature (367)..(367): n is a, c, g, or t
  misc_feature (376)..(376): n is a, c, g, or t
  misc_feature (385)..(385): n is a, c, g, or t
  misc_feature (400)..(403): n is a, c, g, or t
  misc_feature (406)..(406): n is a, c, g, or t
  misc_feature (421)..(421): n is a, c, g, or t
  misc_feature (432)..(432): n is a, c, g, or t
  misc_feature (437)..(437): n is a, c, g, or t
  misc_feature (461)..(461): n is a, c, g, or t
  misc_feature (466)..(466): n is a, c, g, or t
  misc_feature (495)..(495): n is a, c, g, or t
  misc_feature (499)..(499): n is a, c, g, or t
  misc_feature (520)..(520): n is a, c, g, or t
  misc_feature (538)..(538): n is a, c, g, or t
  misc_feature (548)..(548): n is a, c, g, or t
  misc_feature (837)..(837): n is a, c, g, or t
  misc_feature (906)..(906): n is a, c, g, or t
ataagcttgtaccaagcataagcattgtaacaaaagtgcaacttttcagcaaatcctccccaaaagatattttaactcaaaatatcattagcacatattttctccctacaaaaatagcatgtnaganatcattaattgnatgtattaacaactatgtacataaganccaccttgtaggctaagantttaacgttgtttaaacacagcgtttgangcaaacantagcaacancagcagcaaatgcaccaaactnacgannagacccagatatatttcctnactnatagtnagactgttgtntctnaccccttanataacatnnaagtgagatttntnacagtgctacnttgggaacanactaaaantntgttggganggtcttggnttgggcgtttttatnnnnggnttttttgtggttttntggtttttggnttggncttcagaaaatttattgatttggngattngttggtttcataggtttttattttatatntttnttgcatttgttattttaattngtcagttaaatgtttttntttatttttnattttttatagaatataggttatattagtttggtcttgttttttgttgttgttgttttttgttttgttttgaagttcagtgcacttttttttacagtaagattacaaaaatttaggaacatgatggattaatgagagtgggaatagatgcacttgagatgtgtatgtatagatacctatctatggataaatagaaatctgtacagatagatatctatctatatatggacttagaagaaattaagatgagtccattaattcatggtcaatttctcaataaagtgttagcnaatgtactaggaatgattctggccttctcatccatctccttccctgacttagttctgacgatggcccan

SEQ ID NO: 497686 - DNA, 582 bp, Homo sapiens
gtatccctctcagtcttaactagacaactgtgtgcttttgtgtctggccctattgcatttactgtgctcatgctgaaaggaaagtaacagctttagaaactgttgaaaataaaataggaaaacaggctgggttgaattcctttgctgggaattgttttacagctcttcagtggtctttctagccagttattcctgtgaagaattggactttgaggagctaaagctttgaatgggggctgggtgcaggggcctgggagtggagagtctgctttcagatactttaacctcggagctgtgacctttgattgtagcaaacatcgatttcaaaagcttcttttgctttcagtcacaagcctgcgtaccttactgcgagactgccaatgcttcaaagatgtatgtttgaaaaagttctttcatagtttttatgaaatttgggaagttgtttacttaaacaaatgcacaagaaaataattcataaaaatactgaatatatatgtgcaaaatttttcttagctacaataaatgttcaacatttttctaataaagattttttttctgagtaaaaatatgcattttaaagac

SEQ ID NO: 497687 - DNA, 123 bp, Homo sapiens
agaaactactccacctctgtgctgtccacctcctctgtgctagtcacagcacagaggaggaccggtcttcggtcacgggtatacgagtagctgcgcccccctgtgatgtccacctcctctgtg

SEQ ID NO: 497688 - DNA, 701 bp, Homo sapiens
  misc_feature (171)..(171): n is a, c, g, or t
  misc_feature (198)..(198): n is a, c, g, or t
  misc_feature (204)..(204): n is a, c, g, or t
  misc_feature (437)..(437): n is a, c, g, or t
gggcgaagcctgtccaagagatattttaatatttcaaacaacatatgggagtcattgtccaaaaacggtcagaaaggctttcaaggctaattacaaatggttaaatgtgtaaagaatatggttgtttaactcaactatcatgacaaccctatttatctcatattaatccanagtctgattggcaattatatgtctctnataaanaatggaaggcattcagagagtcagagggtctgaaatagcttctaacttgttaactggtctctgcttctcctcttgtcccattctaatccagtctccgtgtggaggcagaaagatcttcaaaagctcaataggatccagctagtctctagcttaaaccccttcagtggcttcccattgccctgaaagaaaaccagctcttctccaggttctgaccctgcttttttcccagtctnatctagtttggctctttattgtgctcccacacactggtcatgttggtcttttacttcctagaaagcagctacatgaggttttctcccaatagggcctttgcagcaggtgttccttctgacagtgctttgccctcagccttgcctgtgcacttgctccctcattagtcttcaccgtttcagctgaactgatgcctaggaaagcagctaaatcggttttaggtttctcacctctgccttattatacgtccacggaccctgtttata

SEQ ID NO: 497689 - DNA, 1003 bp, Homo sapiens
  misc_feature (498)..(498): n is a, c, g, or t
gtctgtggtagcttttaggctgctcctaacccaccatttattgccttctgagaggtgggtgaggacaagcatgtgcctgtgtgtgtgtgtgtgtgtgtgtgtgtgtgtgtgtgtgtgtgtgtgtgtgtgcacgcacgtgcgtgtgtatagcccacctgagtggcggctcgcgcgagagagaactgacggcgtgactactctcggctcaaacctaggaatagagagcgtcgtctcgtcttgagagagagtacttttctccacgagccctctggacacgtgtgagagggaaacgacaagggttcccttggatatgtgaagggtccgttggctctcatctccatcatgtccccaccagaagcacttcaccaactagctggctggctgtccctggcgtgggcagctgctgctgctccctaccagaaagcggactaaaccagagacacagctgtaccaccagcacgtgctacctcctttctccctggaaaagttgaatagtantctccaagagggccttggaatagtcggcacaacagggtgactaagcggacgcagggctgctgtgcgtgcatcgtcgtcctcttgcaatagtgtactaaatataaggcgcctgttggttcccaaccccagatgtccagagaacaatagtgccacgacacgcttctccgccatgtggagagatgaagaaccccagctggggtcacgtaaaggaatcgcaggtcggaatgagaggaccagagggactcccatgttctaagcacctgttcctggacagggctctaggccaacgctctctaaagcatcatctctcctttcatctcccctctaaaaaaccagagtgcacgctggaaagtacatgttcttgtgctccgtgaccagagctcgaagagcgcagaagattgggcccagtgataacgccggcagactcgagcggccagccaatcgttgtcgcacagcccgtgttgggggctgccctttctggctccacgaccagttacaggactcc

SEQ ID NO: 497690 - DNA, 818 bp, Homo sapiens
ctatcaacaaaggagggggaatcaaaggctgggcgaagaggcaggcaggcgccggtgacgctgctgggcaagcgggctctgcagtagcatttgtggcgaccgtggcagtggctgtgactggaagcttctggaaatggcggcgatgaggacccccacatagggtattcacctgttatttttacacggggtgggtggacgagcgtgatccaactcaggcaaaatgacgctgcgaccgcagcccgaggactaggcgaagttcccccgctaagccggcggcggctgtctggccccgcaccaggccggagaagctgcacctacgcccagagcccgctggtcccccgtctcaggtggggccctgggccccgcccggaaagcgcggtagcgtgcacctgccctggcaccagggggtctagagcgcgtcccctcccagccacgccttccagtggcctttttaaagaggaattcagtgcaccctcccacacgtagtgttggggatttgagagggagctgctcaggtactaggaagggtgccggaggaaaattgaccgtcgcagcgtggcagcagcgtgtactcactcccttctgggcgcgttatttacgtagaggttaatctgcaacaacagcgtctgtttatgacttagtgcatgcagttacaagtttatgttacactgtcctttaacgtcttgatgaactgagggttcaggtgtgatcacagcagatgaagtgacattcagacctgacagggacggcgaggtcccatcaaattactatgtaaagcataaacctgcattaaagatcaggagtttttcctttaaaaa

SEQ ID NO: 497691 - DNA, 444 bp, Homo sapiens
gccagggtggggccaccactacagaacccctctgccctggccagctgtggggctgccgaaaaggggaggcttggcaatcccagatgctgcagaaaaacagatgtgtgggaagggcgtggaactcagcagtgccagcctcctgcaggcccctgaacactcctgtcccgggtgccagtgtggagcatttgcctttcagaggttgggtcccttagggttgaactccaatctgacggctgaaggacaggttccctactcccctggtgtctgtctgttaatccctgctgtgagctctgggcctgataggaaagtgtgaagttgtgtctgaggatttggtgtttgcagcctgtcattgtcggagcaatccagagctgtaccctccagcatgcagccgccagccatggtgatcatttattaattaattaaagtgaaatcaaggtaacaaaa

SEQ ID NO: 497692 - DNA, 279 bp, Homo sapiens
  misc_feature (73)..(73): n is a, c, g, or t
  misc_feature (78)..(79): n is a, c, g, or t
  misc_feature (102)..(102): n is a, c, g, or t
  misc_feature (108)..(108): n is a, c, g, or t
tcgcactaaaagaagaaataaagagatgcatggggttgcggatatttacctctgtgcccaaacgctgaccacnccctnnctgggtaggggggggggcttaanaccttnggtgaacttcactgagatcattcttccctaagcagtcaccaaaaaatttatatattttgcgcatatacatttccatattataattatagaagatgtgtaatctatttagatgtgaattaaaggagacaaacaggggggggaaaaaaaaaaaagaggggctcggtggcctca

SEQ ID NO: 497693 - DNA, 375 bp, Homo sapiens
  misc_feature (47)..(47): n is a, c, g, or t
ctgcccccagccccttacagataccccattggtaaggtccacccaantgggctgtttccccctcccatagattaagccccaaaggccaaaaagtaaaacccgctaccccaaacctgcctgtaactgtttgaccaaaggccagctgtcccaggatgcggttaaaacgttttctttgcccaaaagaactggcaagaaaaacatttccaggaagcggtcagacacatggcccaaagggcccccccccttttttttttccttccccctgatccagttttatgtcctataaaaccttgctttagcctataagtggggctgccttttttgcttttgtcaaaaggtagccaggcagggctggcaataaatcagcttgcctga

SEQ ID NO: 497694 - DNA, 211 bp, Homo sapiens
caacatttgcggagagacaggtctgctgtcttgccaggctggtcttgaactagctgaactaaagcagtcttcctgctttggctcccaaagtgctgggattattggaatattagaaataagggtcagggttgtttttttaagttattcctttaaatttgtttttgttatttgtcctgcaaaatgttgcggggtaccggagctccgaattcgt

SEQ ID NO: 497695 - DNA, 154 bp, Homo sapiens
ttccgaattattgaatcttcttctgtaacatcacaatcttcctggttttcagaataaacgctcttctcgctcgcctctctctgcactcactcccacctcactcactcactctataataaaatgtttgcactcaatttatatagtagtgtttgtc

SEQ ID NO: 497696 - DNA, 922 bp, Homo sapiens
gctgttttccagagcttggccaagtgcagcaaatttggagatgacctgtactccggctgtttggcagcagtccttggtaccaagctggaggtccagttctggcacaaaactgtaggcatcctgccctctaactgctcggatatctggcaggttctgaatgtgaaccagatagcggtttccctggaccagtcggcccaacgcttcaagcagctacagaggaccactccaaatgtgtgcgtgtccccgaaagggccctggacctgcgtgggtgacatgaatcggaagcaggagaggagcaacggggtgtgggcacacttgttgttgcccaggtgtcaagtcctctggtgaaaagccttccagccgctgtgacagaaactaccagcccgtgtaaatggcatggccaggaagccgagagagtgatagatctaacccttgatggcaggtgcatgtggctcagcgtattgtgattcccagcagttggggacgccaagggagggaggatcacttgatactcaggaattcgagaccagctggttacggtagtggagaccacattgtctactagaagcttaggaatacagttcggcaggaacggggataaattgctgtagtccccagccattggagccagaggatcgatgtggacctggtcgatcatggtcgcagtgaactatgatgacgcccactgggtcacgtagcaagactctgcttcaaaaacacggggggcgggacagctggtgccgggctacatcttgtaccccgatttgggggtggcctggcagaacttgggtcgggtggaaccctgcaatgggaactcatccttaaagttgaatacgactggggggtggggcaacccgagagagggaactcctcggcgtgtggtgccagcttgcgtgctgtgaaaaaagcgcgccaatgggta

SEQ ID NO: 497697 - DNA, 385 bp, Homo sapiens
tctccaggctgcactgcttatacatcaactatcccaaaaggcatgtcacattcgctgtcatcgtgcactatctatcacatggaaattatagaagaagaagctttcttggcttggaaagaagatataacccaagagttcccgggacaaggcaaggctttgttccaggtgaatcagtggctaacctggttagaaactgctgaagaagaagacatcagaggacgacacgctgactaaagaaccagccaaagccttaaattgtgcaaaacatactgttgctatgatgtaactgcatttgacctaaccactgcgacaattcattccgctgtaatgtttacacaatatttaaagcagaagcacgtcagttaggatttccttctgcataagg

SEQ ID NO: 497698 - DNA, 1041 bp, Homo sapiens
cccgaatagactcaagtctttctaatgcccacgatgtgaatgcccactgtgtactactaaacaatgcaggcaggccaggaagtagctccatttcagagaggaagacactgaggactgaaaacgtgaactggcttgacagaggcaagaccagaatccatgtggcctgatctgaatacaccgtggatgggcaggggagcactttgcctcttactaccaggtagagaccacctccagaaatcattactgcccaacggatgaagtaccatcgtcctgagaagctggagaattgacacaggctgcaaggaacatctccccttccacacttgcacaggactctacctctgaccaccacgacagttttcccactcgcttctgcagaatatggtgataaaattacaagaagaagtctggatggctggaagattgtagcccttgaagccagtaacactgtaaaggaagacactattcctgtgccttctcatatcgtggcttcttcagggcaatttccaccgaccacaactggtgaatatagcaccagccctcgagcaaagtatgaagcaaaggtccagcaaggctccctgcgctctctgcattgccctcacaaacagtgtcccaggcacgagaaacaggaacccgcataaacagctgggtacacgatcaacaccgaggatggcgtcagacaagctccgaatcccaacactcggcctgagaatacccgagaatgccacgacatccctcctacaccaaataataacaaactagggcgtgcacacaggaacggtgcatgccccgaaaaccaacggacaacaggctccacaacaggagaagcccacaacctggctgcgaacacaaagcagagctccacatctaaacgaaagacatccatcgaaagaaagacatcacagacgacccacagcgctccccgtcaaaggacacagcgagccacgacaacgcaggaagctacaccgggacggcgggcaagcaacaaacagcaagcatcgactaagcacacacaggcaagggcaaggacatccacgccaa

SEQ ID NO: 497699 - DNA, 759 bp, Homo sapiens
  misc_feature (517)..(517): n is a, c, g, or t
cagggccgatgtgggaatcctacttatcgctattactcaccgcgagcgccaccctcgtgaccttactgcattactgctgatgcctactaacccgacctgtgtgctgcccgatgtggggccagactaatctttctaaaggtgagacttgagcagaccataccccctgcctggcaccttgtgaggatccctgatggccgcattggagtcgaaaccctctaacatagccttcatgattgtaatgactgggccccttccaggccgacataatgctgctctgacattgttcagcgacacagagttactgtcaggaatgacaggtcctggaagtagctgatggctctgtcacgcgacattccgtggatatgaaatatgaagtggttaagagccacacctatgaggtcaaagctcagttccaccactactagctgtgtgaacatggactgcttacttagcctccgagaaccctatgccccattagcggagcttgatagcagcagaattttccacatggagttgncatgaggatcaactgagaatctcagagagagctctgagcacaggacttgagcaaaggatagttgagggatgaacaatgctcgacgtctgcgcccagtcgattctagactcgcgtaagcttaatcatgcggacgtatacagagctgcacttgggcaatacgtcttatagagagcctgggtacaattacactggccggtgtttctacaacgtaatgactgtggaaacccatgggggttcccctt

SEQ ID NO: 497700 - DNA, 130 bp, Homo sapiens
  misc_feature (1)..(1): n is a, c, g, or t
naggatcttcccagctactcaggaggctgcacatgagtaatcgcttgaacctgagatgatgtgttggagtgaaccgagatcgtgccattcctctccatcctgggtgatagagtgagaattcatctcaata

SEQ ID NO: 497701 - DNA, 381 bp, Homo sapiens
ataaaaaggggaaatttggacacagaggcaagcacacagggagagtgccaagtgaagatgaagaaaaagatcagagtgatacaaagaagtcaaagaacaccaaagattgccaacaaaccaccagaagctaggagaaaggcctgaaacatatccttcccgcatgccttcagagggagcgtgggcctgcagacactttgatctcagacttctaccctatggaactgtgcaaaaataaatgtctgttgtttaagccattcagtttgtgttacagcacaaatgtattctatttaggaatacatcattctaaataggaaatttttttaataattaagtattttcctctccttgggggcacttgggtaacttctaattctacttttc

SEQ ID NO: 497702 - DNA, 442 bp, Homo sapiens
taaaaacccaaccgggggccttttttaaaagagaaaagaatttttggggggtacacaattataacacaatccctcacgctttttacaaacgggtttttataaaggtccactttaaaaaaaaaaaacgctttttgggcccccccaaaaatcacttttttaaaaacaagttttttttttaaaggtccccgcccccccaaacacaaaaaattccacggtttttgcgcacacttttaaaaggcgcgggatttgtttcgccctttttatttttataccccatcccgcgcggttatattttaaaatcgggttttccacaaaattcacatttttgggcaactcttctgtgcccacaaagtgggggccctaacacgggttctctcacaatcttttatttatccccacaattttaaaattttttaagagttattttccaaatttttaccca

SEQ ID NO: 497703 - DNA, 201 bp, Homo sapiens
tcactacacgtatacgttgcgaaaacagttttattacaataggtaaaacgtgcagtcctatgtaatctgtcagaaggtaatcttaattatacgcttgggatgtgcttctaaactagcaaggctggcaggtggacgggcacgagttccgtctgcatttcagcgtttctccattatacttgttctgggagtctgtgacgctgc

SEQ ID NO: 497704 - DNA, 482 bp, Homo sapiens
aggggattgtggtggactgttggcacacagctggcttagctaggtagaagacaatgggaggtgtgcaagacttgtacgactcatttaatgaagattggagtgaaaggtagcgatagagagtgttgcagacagaaaagggattatatgctgtggttaaagcacaagtccagagggttgcagataagtgcagaagtctttaaaaacaattatatttatcccaacttccagggagactgaattgcttctgccagtcagtaacaccgtcacgctgggagttgccccttgacctctccagtctaagctcctgtccctgtaccaaaataccataacactggttagcttatagagtacagatgtgatttcttacagtacaggagtctggacttccaagatcatggtgccatcatggcctagttcagttgaggcccctctcctgtgatgcagcgcgcagttcctcatgttctcactgtggtgaaggggag

SEQ ID NO: 497705 - DNA, 341 bp, Homo sapiens
  misc_feature (33)..(33): n is a, c, g, or t
  misc_feature (62)..(62): n is a, c, g, or t
  misc_feature (66)..(66): n is a, c, g, or t
  misc_feature (78)..(78): n is a, c, g, or t
  misc_feature (90)..(90): n is a, c, g, or t
  misc_feature (105)..(106): n is a, c, g, or t
  misc_feature (115)..(116): n is a, c, g, or t
  misc_feature (132)..(132): n is a, c, g, or t
  misc_feature (150)..(150): n is a, c, g, or t
  misc_feature (156)..(156): n is a, c, g, or t
  misc_feature (160)..(160): n is a, c, g, or t
  misc_feature (220)..(220): n is a, c, g, or t
  misc_feature (237)..(239): n is a, c, g, or t
  misc_feature (242)..(242): n is a, c, g, or t
  misc_feature (245)..(245): n is a, c, g, or t
  misc_feature (251)..(251): n is a, c, g, or t
  misc_feature (278)..(278): n is a, c, g, or t
  misc_feature (288)..(288): n is a, c, g, or t
  misc_feature (303)..(303): n is a, c, g, or t
  misc_feature (315)..(315): n is a, c, g, or t
aatgcgcatttttggttttggtgaaaatttaanaaagtgtgaaattaattatttgtctttgnaaanaatgatgatgcnaaagcaagaacnataaagtactgatgnnaagtacttnnagaatgggctctgtanaccctgctctctgggtcnaaatcnagcncttaagttttaaataggaaaatatgaggtgagtaaactgagtttgaaaaatgtgcttatnagaaggtgtgggatgtnnnaanaanttcttnagagcaaaagaattactgttccttccnaaataatttnactaagggtctgaanaactaatatccnaaccattaaagaaaaaggagaattaa

SEQ ID NO: 497706 - DNA, 121 bp, Homo sapiens
gagaaacctggaggtccccgtaatgggtcctttagggtggggttgtgggagcctcacctccggctcccgacgtgttagagttcaccgaccatggtaggcagtggcttcgtgggcggcctct

SEQ ID NO: 497707 - DNA, 436 bp, Homo sapiens
  misc_feature (291)..(291): n is a, c, g, or t
  misc_feature (342)..(342): n is a, c, g, or t
  misc_feature (397)..(397): n is a, c, g, or t
gcaggaactgtatgccatgtggtttagagtcacacatcctcacacgtctgttagtgtgaagaagtgcaccagtacctctcaaactcttatatcaatgtgtcctcatggcagaaggcagcctttctcttaaatcagaatttatcagaaagaggacaacccaagcctcatttcagagagaggtctggtatactcttagaaacctatgtgactgtcatccctaagtacattcatgttttttctcttgatctcaagagaatcaagggaaactgatgcttcagaaagatgtcccanatttatcctgtggcactcaaagtacccaaggttgagataatatgaggaagnttcaaggtgtcaagttcagtttcccaagatctattccacagaagatgagcaaatntcacttcagagaccactgactgaaggagagtctggtcat

SEQ ID NO: 497708 - DNA, 258 bp, Homo sapiens
agcccttacctaacacattcctcaacccatctctctaaagaccggtcccagtcgttaggtacgtcatccctgactcaccccagaatacgttaaggactggctggtccatctctgaagcccacctgagcctagccagggcccttccctagggggtaagatctggtccaacccgaaccaccacttatattgggacatggaacactggcagcaatcagaattcctgtggtcccatccaaccagacctttctccttcctccc

SEQ ID NO: 497709 - DNA, 290 bp, Homo sapiens
acgggggatgaataacttaccaagggccttcccccttcttaaagctggggccttggggataaaccagagcctgggtgtcatcaagccacgcatgtgctctgggccaaagacaggagggccagctggctgctactgcttctgttaacacttcttggtggcagcagcagcacgcagagctctggtccccgccagagcctgcttcaatcctcagaagtcagccttgtatgtgggaacagcgttccatgcagtatactaacaaccagttgataaccacctgctccactgaagaa

SEQ ID NO: 497710 - DNA, 278 bp, Homo sapiens
  misc_feature (14)..(14): n is a, c, g, or t
  misc_feature (119)..(119): n is a, c, g, or t
  misc_feature (210)..(210): n is a, c, g, or t
  misc_feature (248)..(248): n is a, c, g, or t
atctgagagcacangagctttttttaaaagaggccagggcgggcggagggaggctgtggagagagcgcggagaactaacagacgcagcgcacggccacagacaccctgggcatccaccngagcgcagccggagccagcagagccggaaggcgcccccgggcagagaaagccgagcagagctgggtgcgtctccgggccgccgctccgggngccagcgccctccccatgtccctgctcccacgccgctncctccggtcagcatgaggctctggcggccc

SEQ ID NO: 497711 - DNA, 104 bp, Homo sapiens
cagagaaagcaggagagatctagaagcgacacctagcatcacgattaacagaactagagaagcaagaggaaaaaatcttaaaattacatagtgcagaggaaaat

SEQ ID NO: 497712 - DNA, 494 bp, Homo sapiens
  misc_feature (15)..(15): n is a, c, g, or t
  misc_feature (143)..(143): n is a, c, g, or t
  misc_feature (147)..(147): n is a, c, g, or t
  misc_feature (241)..(241): n is a, c, g, or t
  misc_feature (274)..(275): n is a, c, g, or t
  misc_feature (279)..(279): n is a, c, g, or t
  misc_feature (288)..(289): n is a, c, g, or t
  misc_feature (298)..(298): n is a, c, g, or t
  misc_feature (303)..(303): n is a, c, g, or t
  misc_feature (310)..(310): n is a, c, g, or t
  misc_feature (314)..(314): n is a, c, g, or t
  misc_feature (322)..(326): n is a, c, g, or t
  misc_feature (328)..(328): n is a, c, g, or t
  misc_feature (333)..(333): n is a, c, g, or t
  misc_feature (335)..(335): n is a, c, g, or t
  misc_feature (349)..(349): n is a, c, g, or t
  misc_feature (367)..(367): n is a, c, g, or t
  misc_feature (382)..(383): n is a, c, g, or t
  misc_feature (386)..(386): n is a, c, g, or t
  misc_feature (456)..(456): n is a, c, g, or t
gggaaaatgccaaanagccggcgatcgcacccagcccacctgtcgtggaggtcccttccttctcaggccacagaaataaacccgtgtactgcttattgttagcacaacatcaccagaaaacgataacgacagccaagcagganaganagttaagtagtacttccacactcccaaactcagggagccctataaccttaaggagggagcatttgctacacaaaagcactatccacagccaggnatgatgtagccacaaaaataaataaggagaaannaaancctaaaatnnaagtccctnaaacntaaaaanaaanaaccctgnnnnncnggttngnttaggatctagggngaatatgtacaccttgtngggagagatgggggnngcncaagaaagctcctcagggggggtgaagagggagcaagatgtggtgctgaggggagcttgcagttcattgntgcagtaggaagagggaatgttcttcagttcattgcgc

SEQ ID NO: 497713 - DNA, 226 bp, Homo sapiens
aagccagttctaatagggggacaagtgactaagtgcacatggtggatgccttggcgatatcaggcgatgaaggacgtagtagcttgcgataagctgcggggagtgagcaaacacacattgatccgcagatttccgaatggggaaacccggccgaaaggtcatcgtattctgaatacatagggatacgaagcgaacgtggcgaactgaaacatctaagtaactacag

SEQ ID NO: 497714 - DNA, 656 bp, Homo sapiens
ctagcacgatttacgcaagtggccaagcccagcccttgtcacagccagaaacgttggtcatgccatggggacacataaatgcatcggtcatgaatacgaggccatgctacaagtacattgtctcagatacggaccagggaaatgagatgctttaacgcgcttaagctaaactatagattacattctctgagaccgagtagttgtcaactacgaacacttatggcttagctaactctgaatgtgaggaatttgactcaatgtgggtataagtccaaatggaattttatcctattaggactatcataactgaacataatcggtcccaatatgattccaatcgggtataagacgtatggtcaatgtcgaccaactcagctatttccgttctttacaggctgattcatggtaatgacttcacaagataaattggacatagttgcctaaatgatccagtgactctactacaggaccaggtgtatctaaggatactagtggtatactctcgtagaaaccatgttaaacagcttgttaaataatcccctattggctcaatgctgacaattggagcagcccatcaccaaggttcattagtacaaattgtaaagtcttgaagggtttgggcattgaccggagtgaaacaggaggttaaatttgca

SEQ ID NO: 497715 - DNA, 861 bp, Homo sapiens
catcctgaaaagttccctgagctaccggctgcctcctgcttcccgcctgctccccggcccaccccaactctggcacccaagcgtgcctggccctcagacacagagatcattgtcaaccaggcctgtgggggggacatgcctgccttggaaggggcaccccataccccgccactgccacggcggccccgtaagggaagctcggagctgggctttccccgcgtggccccagaggatgaggtcattgtgaatcagtacgtgattcggcctggcccctcggcctcggcggcttcttcggcggcggcaggcgagcccctggagtgccccacctgtgggcactcctacaatgtcacccagcggaggccccgcgtgctgtcctgcctgcactctgtgtgtgagcagtgcctgcagattctctacgagtcctgccccaagtacaagttcatctcctgccccacctgccgccgtgagactgtgctcttcaccgactacggcctggccgcgctggctgtcaacacgtccatcctgagccgcctgccgcctgaggcgctgacggccccatccgggggtcagtggggggctgagcccgagggcagctgctaccagaccttccggcagtactgtggggccgcgtgcacctgccacgtgcggaacccactgtccgcctgctccatcatgtagtagcgcctgcctgcccgccactgcccgctgagcctcgctcgctgcttcttcagggacccggccctgccctgccgcccgctgacccttccttccccaccatggcttccggccccaccccgagtggcattgtcgctgcagccaactttgccattaaaactctttgccaaagttaaaaaaaaaaaa

SEQ ID NO: 497716 - DNA, 102 bp, Homo sapiens
ttcagtgcatttttgcaagcaacgcattctcggttctgcaacatttgtctcacagttggagccacttttggtgagtctctctctatgatctctcttaatttc

SEQ ID NO: 497717 - DNA, 1140 bp, Homo sapiens
gccatctgttttcaaccaactatttttgaggaattatcatgggaaaagaccaggcttttcccaggaatatcccaaacttcggaaacaagttattgggagtgaagagaataacttgtttccgaagtttgggatattcctgggaaacaagttattgggagtgaagagaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattcgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtatgacagaatctccgtatttgggccaaggtgtttccatttctcaatcagtgcagtgatacatgtactccagaggggacagggtggacccccttgagtcaattggcagcaagacggaacggaggcagaactgatggcgaattccctctcacccgggaattctcccctttcaaggaaagtgaacctttaagtaagggctcaattcctttattggagttcaatcctcacactccaaggacgacgtatttatcacgccagttgggtggactacggcacgagagtagtatccctacgggaaaatagggcacctgagacatagggaacgaaaggctattggcccatgttaccaataacggttgcagaggacaagacgaacagcggacccaaagagagaaagaacaactcttagctgacgaatcacacactatagtctgtcagacaacaacgagggcgttccactgcaaaaacggaaacgcagagagaacgactgtgtcaaagaagcgtagtctcatttgtctgagtatatttcaggagagt

SEQ ID NO: 497718 - DNA, 715 bp, Homo sapiens
cttagtgtatatctatgtgcctttattgaggaagcaccatatataacaaacacgttatagtagatgggcgcacatgcactataatgatctaaagaagctacagatgtcatagtagtatgtcctgctggacaaagttgctccagatctggaatgccagtttgacctgggtcttctataatagttccgtataagcccctcgtttgaaatctctgtatattggattcgtagctaaaattgttctctgtaaagtattctgaatcctggtacttaagcagtccgaggggtataagctataacctcgaaggaaagagactagtaggtagaaaaagatatttggtggaataagcatgtgtttacggtagtaaggtacagtatcttgggtgaagacaccagactgaagtaaactagttggtgcatccaagttaataatagtttggtaggtaaccaatatgtaatcaaagcttctaggtgacttgagatggggaagctcgctatatcatcaatttagcagccgtttgctgacttgtaaccattgcagtgtattggtcttattatacccacttaatatcaactttattttttcaccaggtcacacaattttaattttctacaaaaataaacatttcttggaatccaacgcaccactggtattgctccagcacggggttgaacttcatgcaaccagtgtccatcaactggttccacgtcaaaaagg

SEQ ID NO: 497719 - DNA, 194 bp, Homo sapiens
tgctccctggcaggctgcattgggcaatggctgtgagcgcgaggcttaccggcagcaggatcgagaacggtactggtgttgtcacgattggggtatcgcgaggacccccatcgtgataatcccgccgagagccagcatgatggtgaccccagcgacgacgtcctgcccagaaccgtccggttcaacgaaggatt

SEQ ID NO: 497720 - DNA, 939 bp, Homo sapiens
  misc_feature (750)..(750): n is a, c, g, or t
  misc_feature (788)..(788): n is a, c, g, or t
  misc_feature (791)..(791): n is a, c, g, or t
  misc_feature (795)..(795): n is a, c, g, or t
  misc_feature (797)..(797): n is a, c, g, or t
  misc_feature (801)..(802): n is a, c, g, or t
  misc_feature (804)..(804): n is a, c, g, or t
  misc_feature (808)..(808): n is a, c, g, or t
  misc_feature (810)..(810): n is a, c, g, or t
  misc_feature (817)..(817): n is a, c, g, or t
  misc_feature (844)..(844): n is a, c, g, or t
  misc_feature (846)..(847): n is a, c, g, or t
  misc_feature (864)..(865): n is a, c, g, or t
  misc_feature (869)..(869): n is a, c, g, or t
  misc_feature (884)..(884): n is a, c, g, or t
  misc_feature (891)..(891): n is a, c, g, or t
  misc_feature (903)..(903): n is a, c, g, or t
ctgatctcaaactcctgaactcaagtgattcacccaccttagcctcccaaagtgctgggattacaggtgtgagtcaccatgcccggccatgtatatatataattttaaaaattaagatgaaattcacataaaataaaattagccattttaaagtgtacaatttagtggtgtgtggttcattcacaaagctgtacaaccaccaccatctagttccaaacattttctttttttctgagacggagtctcactctgtcacccaggctcgagttcagtggtcttgaactcctgatgtcaggtgattctcctagttccaaatgttttcattatctccccccaacaaaacccatacctatcaagctgtcactccccataccccattctctttttcatctcagcccctgtcaatctggttttgtccttatggacttaccaattctgaatatttcctataaacagaatcacacaatatttgattttttttttaaaactaagccttgctctgtctcccaggctggagtgctgtggcgtgatttggttcactgcaacctccgccttccaagttcaagagattctcctgcctcagcttccaagtagctgggattacaggcatgtggtaccacgcctggctaattttcttgtatttttagtagggacatgttggccaggctggttgtgagctcctggcctcaggtgatccacacgcctcagtgtcccagagtgctgatattacaggcgtaatatgtgatcttngtgtctggtcctttcacgtgaacgctatttgaggtcgngcntgtngnaccnncncacngntgtgttnccccatctcatccagtgctctctatgncnntataaaagctctgggcnngtcngacggggttgcgggntggccgnagtcccaccggnatacggaggccccggggaaaaaggggataccggggg

SEQ ID NO: 497721 - DNA, 895 bp, Homo sapiens
ctgatctcaaactcctgaactcaagtgattcacccaccttagcctcccaaagtgctgggattacaggtgtgagtcaccatgcccggccatgtatatatataattttaaaaattaagatgaaattcacataaaataaaattagccattttaaagtgtacaatttagtggtgtgtggttcattcacaaagctgtacaaccaccaccatctagttccaaacattttctttttttctgagacggagtctcactctgtcacccaggctcgagttcagtggtcttgaactcctgatgtcaggtgattctcctagttccaaatgttttcattatctccccccaacaaaacccatacctatcaagctgtcactccccataccccattctctttttcatctcagcccctgtcaatctggttttgtccttatggacttaccaattctgaatatttcctataaacagaatcacacaatatttgattttttttttaaaactaagccttgctctgtctcccaggctggagtgctgtggcgtgatttggttcactgcaacctccgccttccaagttcaagagattctcctgcctcagcttccaagtagctgggattacaggcatgtggtaccacgcctggctaattttcttgtatttttagtagggacatgttggccaggctggttgtgagctcctggcctcaggtgatccacacgcctcagtgtcccagagtgctgatattcacgggcatctaatagtggtgactctttggggctcgggctgcgcttccagtgtggaagtgcatattttgggaggtccggtgccgtgtgtgttagaccccacgagtcccacacacgtgcttgtagctcttccccccagtcctctcattccccagtgtgctctcctcct

SEQ ID NO: 497722 - DNA, 213 bp, Homo sapiens
caactgagcttatgttactgagatgatttttacaaagtccctagataaccacaggactggtggccaatgccagggaatcaaccctgtgctcgtagagttagaactcaaaaccccaccctcaacctccagggaaaggagaggggctgaaggttgcactgataaccaagggccaatgacttaatcaatcatgcttacctaatgaagcctccataa

SEQ ID NO: 497723 - DNA, 886 bp, Homo sapiens
  misc_feature (697)..(697): n is a, c, g, or t
  misc_feature (735)..(735): n is a, c, g, or t
  misc_feature (738)..(738): n is a, c, g, or t
  misc_feature (742)..(742): n is a, c, g, or t
  misc_feature (744)..(744): n is a, c, g, or t
  misc_feature (748)..(749): n is a, c, g, or t
  misc_feature (751)..(751): n is a, c, g, or t
  misc_feature (755)..(755): n is a, c, g, or t
  misc_feature (757)..(757): n is a, c, g, or t
  misc_feature (764)..(764): n is a, c, g, or t
  misc_feature (791)..(791): n is a, c, g, or t
  misc_feature (793)..(794): n is a, c, g, or t
  misc_feature (811)..(812): n is a, c, g, or t
  misc_feature (816)..(816): n is a, c, g, or t
  misc_feature (831)..(831): n is a, c, g, or t
  misc_feature (838)..(838): n is a, c, g, or t
  misc_feature (850)..(850): n is a, c, g, or t
ctgatctcaaactcctgaactcaagtgattcacccaccttagcctcccaaagtgctgggattacaggtgtgagtcaccatgcccggccatgtatatatataattttaaaaattaagatgaaattcacataaaataaaattagccattttaaagtgtacaatttagtggtgtgtggttcattcacaaagctgtacaaccaccaccatctagttccaaacattttctttttttctgagacggagtctcactctgtcacccaggctcgagttcagtggtcttgaactcctgatgtcaggtgattctcctagttccaaatgttttcattatctccccccaacaaaacccatacctatcaagctgtcactccccataccccattctctttttcatctcagcccctgtcaatctggttttgtccttatggacttaccaattctgaatatttcctataaacagaatcacacaatatttgatttttttttttcactgcaacctccgccttccaagttcaagagattctcctgcctcagcttccaagtagctgggattacaggcatgtggtaccacgcctggctaattttcttgtatttttagtagggacatgttggccaggctggttgtgagctcctggcctcaggtgatccacacgcctcagtgtcccagagtgctgatattacaggcgtaatatgtgatcttngtgtctggtcctttcacgtgaacgctatttgaggtcgngcntgtngnaccnncncacngntgtgttnccccatctcatccagtgctctctatgncnntataaaagctctgggcnngtcngacggggttgcgggntggccgnagtcccaccggnatacggaggccccggggaaaaaggggataccggggg

SEQ ID NO: 497724 - DNA, 348 bp, Homo sapiens
gagccatcttagaccgctcttatgacccacagacccaagtcgaccatcctgcggcctgcctttccacaagctccacctccgcgtgcctggcccctgacataccaccctcaggccccgccacctgtaagccccgccaaggggcgtgccactcactgcactcctcctcatcgctgccatcgctgcagtccaagtccctgtcgcagcgccaggtgaggggccgcataagccactggtgcggcactggaccttggtgggtgggccgagcctgcgctggggcctgcgagcatggatgcacatgacgcctgggaagctgcaggctgcaccttactccacgagcacagtagtcac

SEQ ID NO: 497725 - DNA, 942 bp, Homo sapiens
  misc_feature (1)..(1): n is a, c, g, or t
  misc_feature (76)..(78): n is a, c, g, or t
  misc_feature (87)..(87): n is a, c, g, or t
  misc_feature (92)..(92): n is a, c, g, or t
  misc_feature (103)..(103): n is a, c, g, or t
  misc_feature (106)..(106): n is a, c, g, or t
  misc_feature (110)..(110): n is a, c, g, or t
  misc_feature (114)..(114): n is a, c, g, or t
  misc_feature (116)..(116): n is a, c, g, or t
  misc_feature (130)..(130): n is a, c, g, or t
  misc_feature (154)..(154): n is a, c, g, or t
  misc_feature (156)..(156): n is a, c, g, or t
  misc_feature (159)..(159): n is a, c, g, or t
  misc_feature (161)..(161): n is a, c, g, or t
  misc_feature (191)..(191): n is a, c, g, or t
  misc_feature (200)..(200): n is a, c, g, or t
  misc_feature (203)..(203): n is a, c, g, or t
  misc_feature (205)..(205): n is a, c, g, or t
  misc_feature (209)..(209): n is a, c, g, or t
  misc_feature (211)..(211): n is a, c, g, or t
  misc_feature (215)..(215): n is a, c, g, or t
  misc_feature (220)..(220): n is a, c, g, or t
  misc_feature (228)..(228): n is a, c, g, or t
  misc_feature (239)..(239): n is a, c, g, or t
  misc_feature (243)..(243): n is a, c, g, or t
  misc_feature (252)..(252): n is a, c, g, or t
  misc_feature (282)..(282): n is a, c, g, or t
  misc_feature (285)..(285): n is a, c, g, or t
  misc_feature (308)..(308): n is a, c, g, or t
  misc_feature (311)..(311): n is a, c, g, or t
  misc_feature (318)..(318): n is a, c, g, or t
  misc_feature (320)..(320): n is a, c, g, or t
  misc_feature (322)..(322): n is a, c, g, or t
  misc_feature (328)..(328): n is a, c, g, or t
  misc_feature (349)..(349): n is a, c, g, or t
  misc_feature (355)..(355): n is a, c, g, or t
  misc_feature (358)..(358): n is a, c, g, or t
  misc_feature (379)..(379): n is a, c, g, or t
  misc_feature (385)..(385): n is a, c, g, or t
  misc_feature (402)..(402): n is a, c, g, or t
  misc_feature (452)..(452): n is a, c, g, or t
  misc_feature (464)..(464): n is a, c, g, or t
  misc_feature (477)..(477): n is a, c, g, or t
  misc_feature (493)..(493): n is a, c, g, or t
  misc_feature (499)..(499): n is a, c, g, or t
  misc_feature (505)..(505): n is a, c, g, or t
  misc_feature (516)..(516): n is a, c, g, or t
  misc_feature (522)..(522): n is a, c, g, or t
  misc_feature (524)..(524): n is a, c, g, or t
  misc_feature (531)..(531): n is a, c, g, or t
  misc_feature (575)..(575): n is a, c, g, or t
  misc_feature (649)..(649): n is a, c, g, or t
  misc_feature (675)..(675): n is a, c, g, or t
  misc_feature (677)..(677): n is a, c, g, or t
  misc_feature (681)..(683): n is a, c, g, or t
  misc_feature (689)..(689): n is a, c, g, or t
  misc_feature (692)..(693): n is a, c, g, or t
  misc_feature (803)..(803): n is a, c, g, or t
naaattcaaaataagcgtgaaattccagagctattaggaagaaaggagtctgtgtaatacagaaaaaatctgaaannnatgaaaatnaaaanagggtaagaanaanaaantaananatttgaagtaaaanagagaaaaaattgtggaactgtgnanaananaaaatgacactgatgaggaactccaggganattaagggnaanantgcnanaaanaaaanaagggtanaattagaaaanctgnatctttaanaaagtgagatttgtatgcatacactcgggnggnttcattttgcagcccattaaatnggnttaaaancnanaaaggngctcatgcatgtaattaatantggagnaangaatggagtgtaagtggacgngtgtgntgtgcactttgaaaggnagtagttttagaagaatgagaagaaaattacttcctgggcattcattaanaattcaggtganatcctgtacctcnatttataaaaaaatanaaaaanaaaaanacgtacaaaanaacatnanaaataanataaatgagaagttttcaagtatttcaatgggccttgaaaagtntcaaacagtaattctcacaattggttagacaatcatttttttttcttttcttttcctctcatttagtctcagancctaaaatgaaatgcctccagtctcngngagnnngggggnttnngatgaaattaacaagattctaccttaaaagagaaaacttatgtgggcttttcaaattgtgaaaatttgttccctcttataaaatataatctttcccctgctgctggtttntaaatatgggcatatagcccagagccattataaagaaaaaacaaccaaccacaataaactaaggagcctcatctgatggctaaggttctcaggaaaaaatgagaagagcaccttgatcaggaaaggaaaaaaggataga

SEQ ID NO: 497726 - DNA, 350 bp, Homo sapiens
  misc_feature (34)..(35): n is a, c, g, or t
  misc_feature (55)..(55): n is a, c, g, or t
cacacaacaacaaaaagactatttgggaacacgnnagctataagattaaacaaanatgttataatcttttcttgttggggatcatctgttctttaatttcaaactagagtctaagatgatgtagaaaatatgttagctatttcttaaagtgaacttattaaaaatgaggaattgtagtataattccaagattgaagggtgatgaagtatctgttgtttgtgatcttttcccctcactcaaaatcatatgattaagaatgggtgtgaaattacaagcaattaatatttatattatttttgagactgttacagagttagatttgtgattaacaagacaaaattctatcaaaa

SEQ ID NO: 497727 - DNA, 258 bp, Homo sapiens
ccaaggctgcaccaaaatgacaattgccttattcgcattccacctgataatgccatgcttcataatctgggttacctgaatatgtcatcgagtaacctcataagtttaccagcattgctatgaaacatagggtctctcagggaattgcatttaaataacaatctgttacgggttttgccctatgaacttggtcgactcatccagctacaccctctaggtttgcaaggcaatccgttatcacacgatattctcaggtta

SEQ ID NO: 497728 - DNA, 589 bp, Homo sapiens
atcagtgctccagttgccttggcttccagtgttgatgggtctcagagagtcttattctcccttggctgctggcttgcaggaactcaggatgtactaagtcacgatgtgcagatggtagctcctcagggagagcagagcttacacacaggcgtcataagcttcccgcaggccagcatctgcttttgacaggacaaactcacggactgaggggagttagactctaatgagcacaggacgttcctgtggagcgtgatggcatatatcttctcatgtcctggaggacctgagcagcatgtcctccagacagcagtctgctggatgcccagcaggacgtcatagctctgaaagaggctggttgggcctgtagtgggctctgctaattcctttgggtcttcccagaactcttcatacaccagagcgtctgatagctgggggtagccgtttcgcagccagacaaatatatgcgaagaacactggaagattgcgttcggtttcacatgatcgtgcggatgggacgcagagatggcgagtcttcgtcccattagtgatgccccagcaggcatggaaccgacatggttaatatatgtgg

SEQ ID NO: 497729 - DNA, 866 bp, Homo sapiens
cggactgcaggcacatgccaagagctgttcctcacgggctgtgagacaagagcatcttggatgtaggacaatggaagagttacatcccttattggaggaactggagacgctccatccttcaggaccgagtgatgtagagtattccaacccagctcctcttccgcctggatcagcattccagaaaggagactaaccttgatgagacttcggagatcctttctagttcaggataacacaagtcccttgccggcgcagctcgtgtatactaccaatatccaggagctcaattgtctacagtgaagcccaagagccaaaggaatcaccaccgacttctaaaacgtcagcagctgctcagttggatgaaggcttccatgggttaacttggacggccgatgcaggccaaggtggcagtgagagcagatgctggcaagaagcacttacacagagcaagcaggatcacaaggcctccctggactcaaagacttgggggtctcgagcaggaattgcaggaccttggaattgccacagagcccaagggccatcgtgcatccttgccagaaaccgatagctgggaaggtgatccatgctcatagggcaatcatggaatcctgagcatgtagtctgtactcattgcaaagaagagattggactccagatcccatactgtgaaccggagaggcatggcctactgcccaccgacataccacaaataacacatcccacgcagctgcataaggcaccagcacccatcccgggataaagctgcagcacagcaacagacaacagaccatggaaccccaaaagcaaacatacagacccaacaggcgcaccagcgagaaaggagcccaaagcaaccaggagaacga

SEQ ID NO: 497730 - DNA, 259 bp, Homo sapiens
gccaggctggtctcgaacgcctgaccctcgtgatctggccactatggcttccatagtgcagggataacagacattagagccactacgcccggccatatatttgcttataaattcctaatcagatgggtagtttgcaaatgttttctccctttctgtgggctgtcccttcactttattgtttcctttgctgtgcagaacctttatgacttgatgtgatcctcctgtttgtccattttaaatttggttgcctgtgcaaggt

SEQ ID NO: 497731 - DNA, 338 bp, Homo sapiens
  misc_feature (133)..(133): n is a, c, g, or t
tggggaggaaagagggaaaaaggaaaggaaagaagatgattctgagggctccagactttaaagagagaaaagggtcctatctcttttctcttaatgttaaatgttattttgtttgtggaatgttccactcttntaatatatatgttgattaagtataccattatgcatgatttgcaatattgattgacctgtggagtgccttgagcctgtgtgtccaagactctgagtgctgagtgagtgggaagtactaaggagaattgctttcttggaaactccatgtagttcgtggcttttgtgattgaaatagcaacagtaaaagtctggcattgtggaaaaac

SEQ ID NO: 497732 - DNA, 457 bp, Homo sapiens
aacgagatggggagagcgaggaaacctcagagaaaaatatacaatatgcagaaagacgaaatagatgcgaagaaaaagtaaaaggtatcggaaaaaggggaaggaattgtgagtgtaaaatgaaaaagaatgaaatgaatgggaagaagacgataaaatggtggaggaagggaagttacgaagacaggtaagtagcctaaagggtgaaggcaaagagaattgaaatgtaaggggaaaaggagtaatacagggaagaaggatagagtgagggaaatgtgaaaaaaaagaagaacggaagaaatcaaaaataaaaagataagtgcgaaaaatagagaaaccaaggggagaaaattaaaaaagaatgataacaagaaggaaaacgatgaaaaacagtaataaaaagggaagacgagtgagaatttaagaaatggaaaggaatgcaaagatgaagggtcga

SEQ ID NO: 497733 - DNA, 723 bp, Homo sapiens
gactaagttctagatcgcgagcggcgcccttgtgttgtttatcttaaaaggaaaataaccggaaatagcccttctgatcttatccaggtctctttatatgtgctaggtaggcaaatgtgcttgcacaccaagacataagcatgtgtcgtgaggagaagcaggaaggtatctcgagagccgtaaagaaccagtgtgtaatacgtttcttggactcataaacactcggtgggtgtctgtccaccacattatccaggcctgaggggggcagggtggctgggtgataagagcgagggcagaaaactcaggcctaggcgatatcccttaccatgtgtctgtccagtggaagtgtgtttcaaggggcctcttcaaggccccaattcagtctggtgtaagccaagttgtctcagccgtggggaaacacaggtactacattaagtgatggtgaggtttaccattaagtagctgagtgctggaataatccatgtttcattaagtataagttgggtaagatacaacagatggaacgagggacaacagtagctcatttagcagaagggacagtgaacccatgtggggtcatatacatttcgcttacagaatgggatatcatatgagagtccacaccccgttggagttatgctttgaagggcatactatctcatcatcttccggattcaggataagtcggtcagggccatgggagactctcttccctaggaattg

SEQ ID NO: 497734 - DNA, 333 bp, Homo sapiens
ctgatagaatgagtgatgttccacaagtgatcaagagactcctagctgggtgcggtggctgacgcctgtaatcccagcactttgggaggccaaggtgggcagatcacctgaggtcgggagtttgagaccagcctgaccaacatggagaaaccctgtctctactaaaaatacaaaattagccaggcttggtggcgcatgcctgtaatcccagctaatcgggaggctgaggcaggagaatcgcttgaacccagaaggcggaggttgcagtgagctgagattgtgctattgcactccagcctgggtgataagagtgaaactctgtctcataaaaaa

SEQ ID NO: 497735 - DNA, 109 bp, Homo sapiens
aatcatatattggttgctgcttgtacctgccccacaagtggtggctgctctgcagatctctgggaaggctggagggggaaggggacgattagttcttgtgcgtgcgctg

SEQ ID NO: 497736 - DNA, 1018 bp, Homo sapiens
caggccttacacccgcagtcaaccatgttcaagggaacgtgcagttggtatgatcttggaaccacctacgtcttgtgtgggtgttgtatccagcacggaaaagtcgagataattgccaatgatcaggaaagcgaaccactccaagctatgtcaggctattacggacactgaacggttggatcggtgatgccgctaaagaatcaagtcgcaatgaaacccaccaacacagtcttggatgccaaacgtctgattgggacgcagatttgatgatgctgtggtccagtctgatatgaaagcgattggccgctttatgggtggtgaatgatgctgggcaggccgcaaggtgccaagtagaatacaagggagagaccaaaagcttgtatccagaggaggtgtctatctatggttctgacaagagatgaaggaaatcgcggagagccatacgcttggcgaaagactgttaccaagtgctgtggtcacagctgccagactgtactttaaatgcactctaacaggcgtcagggtaccaaagatgctggaccgtatctgctgggtctcaatgtacttagaagtctattaatgaggcaactgctgcatgcgtattgctataggggtgtagagcaagagaaggttggagcacgagacgaaaggtggctcatctttgacctgggaggtggcactgaggatgtgtcagtcctgactattgaggcatgggaatcgtttgaggtcgaagtctacaagcttggagaacgacccacttgagcgtggcagaaagactttggaccaaccgccatggtccaccgagtttgattggccggagctctaaaggcgccacagcatacagaacgcgcggcatcagtggacaaaccagggagcacgcggcaggaacggcgctccgcaacgggtcgatagacggtgctaaaccgtacccctcgtactgccaaggccaaggccgacgcactggagaccccgagcacccccatctccacacggcaccgccgacactacccccgaagac

SEQ ID NO: 497737 - DNA, 895 bp, Homo sapiens
cgccacatggttcattccccctttgatccagtgggtgatgggctcccgcgcgcagttgatgtctctgggttgaaggaacccacgagaagagtcgctctgtggttgggcgacctcttcccccaagatgtcatggtacctgctggggttgtccccgtcaaatacctcgggcggggtttcccccacgccctccgtagttgcttcctcccgctaatagatcatcgaggttttcctcgcgcgcttgtctcgccccgctatattcatagtcgcgcgcatatagcgcagctctttattggctcccgaacatctatttaccgctcgcacgcgcgctggcctcctggaccggggttgttgctcagggcactcactctctgtttcatgtggcccaccatgcagagcgcagtggtgactcccctctccgtgggtcgtccccgcgcaccaccccctagggttgtccactcgctttcctgccccccgcaaagccccgcctgtatcaaaatacatgctgtggcacctctctcgcgatccctggccgttcggtgcgcccggcctgtttcatctcgctctggcagctgcgcccgcacttacgttctgttagatagaccctcgtggtgtctaggaccaccgcgctactagagggagagtctatgaggactctacgtgcctcctcctccgttgggcgttcgtcgtttgctaccggattcttatttggctcgccactgcccgcacctgtgaggccatttggtggccagcccaaactcgctgaaagatccttgtcgcgcggtattttgtccgttgcgggagttgggagagatgtcgaccgcccctcacggaagtgggctgtgttacccattactattcacgccctaggtcttacaatctcaaaccaacaaaacgc

SEQ ID NO: 497738 - DNA, 258 bp, Homo sapiens
agtgtcgtttaagacaggcaaacagtagatttcaagcccagctagcactcagagaaaaataggctgctgtaaacgggaggatgagaacaataggtaccaggttgcatcggaaaacctacaagatgaatatgtaagaacacttgaagagacgaggaaagaaaagaccattgtcgaatagtcagtcagaaatggaccgaatgaacagttgaaccagaaaggaagaaagccattaccactcaagaaaccctaaaagaaacg

SEQ ID NO: 497739 - DNA, 701 bp, Homo sapiens
tggagacaggttcttgcggtgttgcccaggctggagtgcaggggccgggtcatggcatcaagggctcactgcagccgggacctccgggttcaagtgatcctctgtgtctcagtccccgtgagaacaatcccccagcgcccagctacatatttttgggtgggatacaggggtctcattctggtggcctaggcttgtctgggaactccggggctcaaggggatctggtagccttagcctcctaaagtgctggggataataggcatgagtcactggtacccggcctgctctaccgctttataaggacgcttatgatcacatggcgcctacccagagaacccaggtcgtctttctattttcaggtcagctgattagccaccttagttccatctgcaactttagttcccactgggctgtgtaacctaacatagtcacaggctcgggggactggtcacgtggacatcttggggaggccgtaattctggcccaccgcaccctcggttcatccctgtgccctgccggggcacctcgctctaccccaggaaattggtgagctcgtttcctgctcggatatgtgctccccctaagggtctgctcctccctgggcctgaaaagttcctttctccagctgagaaggggggcccttcgatctcaggcatgactcagcccgggttgatgctctgcagtgctgagccaggataggg

SEQ ID NO: 497740 - DNA, 749 bp, Homo sapiens
  misc_feature (31)..(31): n is a, c, g, or t
  misc_feature (34)..(35): n is a, c, g, or t
  misc_feature (217)..(217): n is a, c, g, or t
  misc_feature (662)..(662): n is a, c, g, or t
  misc_feature (668)..(668): n is a, c, g, or t
aaacatcgggtggccgaagggctttcatacncannctgaaaaagccaacaagccctttgcaacccccgggattttacccgccttctagggttttttaaaaactttccccccttaaaaaatggggcaaaaattttcccttgtataaatatggggggggaaccccccccttttttttttttgcaaaaaagtgttgaaaaaaccccccccacaccccccncaaaaaaaaatttttctcccccttttttaaaagaggccgccccccggggaaaaaatttttttttttttaaaaaagggataacccccccccccaccaaaaaaaaaaaaaaaaaaaaggtttttctcctctccccccccccccctctttgtggttgtaagtttggttccaaaaaaaaatttttaaaaaaagggggggggggttttttttttttttccccccaaaaaaaaaaaacccttttttttatttaggggggggggggggtttaataaaacacattttttttttaaaaaaaaaaaaaagagtggtgttttaaaaacaccgtcttttcttttttttttttttttataaaaaaaaaaaaaaaaaaaaatttctctctccccccccccctttcttttcaaaaaaaaaaaaaaaaattttctcccctccccccccccccccccccccncccccnaaaaacaaaaaacttcctccccttttcctttttttttttttttaaaaggggcccccccccccccccccccccggggggggg

SEQ ID NO: 497741 - DNA, 228 bp, Homo sapiens
taaattagtttaccatccttaaaaaatcagggaatcacagaaaaatcggggtttcgggcatggctgggaacatcagagctcacagctctggggcccactttccggccgggccactctgggtgggagggggaagagccggcctctctggggggcagggcagatgcggtccggtcagccccagcctcagccccgcccagtggcactcatttatggtgcttaggggcccgg

SEQ ID NO: 497742 - DNA, 284 bp, Homo sapiens
ggggccccccttttccttccccccccccggggtgggggttcccggttttccccctttttgggaacccctgggggcatttggccctttttatgtttaagggggggccgggggttccccttccctttccctaggggtaaggaaaagcctctttttttgggggggttggcccctttaaaagcccccttggggaaaagtttgtttgggtcctttgtttttcccccccggttaaccaacccagttttacccccgggggcccggaattaaaccccggttttccgggggga

SEQ ID NO: 497743 - DNA, 470 bp, Homo sapiens
tagggagacacatacatgtaaccatactgctcaaatgccagaaaagtaatatccaacagccggattctgacccaccctgccagcttaacctataacggctaattattcctggaggaaagatcaccccagttcttcacgcttccacttacaatcacatgacgcccacccaacttcttaggaaattgataacaccactttgcattgttaagtactcaactgctggtgttatacacatgatcttgagcaggatttctcagcctacaacactgctgaccattttgggccagagaattctccagcgtggggggctgtcctgtgcaaccgtacgacgtttagcggcgtccctggcctctacccactaggtaccggcagcaactccctgacaccatcgtgaccatccaaactatgtccagagatcgccacatgtctcctggggaactacattgccccctgcttaacgaaccactcat

SEQ ID NO: 497744 - DNA, 241 bp, Homo sapiens
gggggacggattatccgggcgaactaggaatactctgggaacgagttgatcctagtgggaagccttctccgagtagtcttcacactcttggtaaatctccaggcctctctcttgccctgagttatcagcctgtgtggtgttgactaccttagaaggtacaagctaagaaatgtaacagtatcaaccctcccagttgcttaattatacccataggtaatacaaaacgcaaagaccccaaaag

SEQ ID NO: 497745 - DNA, 144 bp, Homo sapiens
taccagtccatcgaggacaggtcaggccgcgttccccaagtgagccagaagttagtgaatcgccatctcctgtgactacaaacactccagcgcagtttgctacagtgtccccatgcggtttcctgaattcttgtaaaactcctc

SEQ ID NO: 497746 - DNA, 223 bp, Homo sapiens
tcttctcaagctacgaaggatatccaatagagcggagccagctccatcacgatacatcaaaatcgatggggcaaccgcacgtcaagtcaataacacgaaggttggaacagagcgccgagaacacctcttggctatttaatgcctgccagagtttatttgcggcaatctgagcaccgaatcatgcgggtacgcgaggagtacccgagcctctaattctgtgatc

SEQ ID NO: 497747 - DNA, 546 bp, Homo sapiens
  misc_feature (4)..(4): n is a, c, g, or t
  misc_feature (26)..(26): n is a, c, g, or t
  misc_feature (73)..(73): n is a, c, g, or t
  misc_feature (202)..(202): n is a, c, g, or t
atgnccaaaattccgaagttgctccnagggtgaccattgcctaccagttatggttccccataaggggaaaagngaaactcacttccccctgtggtccatgagtgtgaacactggggcctttgtacgcaaatgttgtactgtgtgtgggagagctatacagtaagctcacataagactggaacagataggatgtgtgtagctnaaaatgcatggcagacgtgtttataaagagcatgtatgtgtccaatatactagttatattttaagaccactggagaattccaagtctagaataaatgcagactggaggattctgctctttgatttctcttctcctgtgacccagcctaagtattatcctaccccaagcagtacatttcacccatgggcaataatgggagctgtaccgtttggatttctgctgacctgctgcatttcttttatataaatgtgacttttttttcccagaagttgatattaaacactattccagtctagtccttctaaactgttaattttaattaaaatgaagtactaatgactctt

SEQ ID NO: 497748 - DNA, 176 bp, Homo sapiens
  misc_feature (28)..(28): n is a, c, g, or t
  misc_feature (61)..(61): n is a, c, g, or t
ccttttttttttttccagtgaagaagcnatctcgtctctgtctccactctcacggacaaanctcgcgcgcgcacgcgtgggcgcccaggccacgcactcatctgtccacgaaggcccctccacatgtgtgacgcacatgcgcgcagagaaagcacatcatatctgctgtgtctttt

SEQ ID NO: 497749 - DNA, 170 bp, Homo sapiens
  misc_feature (17)..(17): n is a, c, g, or t
  misc_feature (33)..(33): n is a, c, g, or t
  misc_feature (50)..(50): n is a, c, g, or t
  misc_feature (92)..(92): n is a, c, g, or t
  misc_feature (127)..(127): n is a, c, g, or t
  misc_feature (154)..(154): n is a, c, g, or t
  misc_feature (158)..(158): n is a, c, g, or t
tgtgagtgataatggcngatgaaactactcacnagcgcttactgtgtgcngggagccgtccttagaggagagcgtgaataaagtcagagaancttcccagcaaccctgggatgtagaacctctgganccattgcccaaatcaagggaatgaggnaggncccgggctctgg

SEQ ID NO: 497750 - DNA, 680 bp, Homo sapiens
tgctttcagaaacagagaatataatattctcactaaggccttgaatggatttttttctcataaaatagtctgataagctaatttttaaaaagaaatgccattaactgtgtggtatcgtggtttaaaacttactaacaagttgtgggaaacgaaacaatacatattggatttggaactcttaacatgtttttaaaaatttagacttgaactgggcacaaagtataacatatttggtttctttaatggaggacatgtggcaaggagttggagggttggggatgggagaagtatttggcagagttatcaatgtccaaataatttaaaaacaaaaaatcaagggtattcaagcagcaaaaaaaaaaaaaaaaaaaaaaaaaatctgttgttgggggcgatatgggccttggaaaaaggtttttaagaacacttcggtgggggggcgggggggccaatattggctacacgtgcacacggtggcaaacggcgtgtcccaaagagaaaccgtgggcccaggacacacacgggcggggcgattctctccccaattataaaaaaaagcgccgggggggcaacccggggcgctccgcgaaccaaccccagaaggggaacacggaggcccacagggggccacaccacgggggcccacaggagccagaataaacgcggcccggggggggagc

SEQ ID NO: 497751 - DNA, 147 bp, Homo sapiens
aaaccatgacattggcttccatatgagatgaacacatacaagtagaacgctttgagaaagtgttcagctctgaaagactgttttcttggaaaggcattaactttgtgatggtcaacagcgtggcctgaacgggatgctgtggcatct

SEQ ID NO: 497752 - DNA, 476 bp, Homo sapiens
  misc_feature (25)..(25): n is a, c, g, or t
  misc_feature (85)..(85): n is a, c, g, or t
ccaccccaaaaaggaatccggcctnacccccagcttcctaccggcttcatggcccttggttccatcaaatgtcctttacctcaanaagaccttcaccctataagtcctattttcctgtaattctgttaacaatttattgtctcctcatttatagctcacatcccaaacttccctatgatagagaattcaaccctggtcaagaagtcacaaggctgggcatggtggttcacacctgtaatcccagcactttgggaggccaaggcaggtagattgcttgagctcaagagttcaaaaccagccgtggcaacatggcaaaaccctgtctctacaaaaaaatacaagaattagccagccgtagtggtgtacacatgtaattccagctacttggggggctgaggcaggaggatcacttgagcccaggaggtcaaggctgcatgagccgtgttcacaccactgcactccagcctgggtgacaa

SEQ ID NO: 497753 - DNA, 105 bp, Homo sapiens
catactatgtaaaggcttatagttcctcaacgctttatactctcaacgctataatacttcctcaacgcttaatactatcctacaacgcttgaatacttacctaca

SEQ ID NO: 497754 - DNA, 738 bp, Homo sapiens
atcttgagtacgtggaccattgctgtgcatgttaacttttggtactggttttgttttgtttagtgttgcatttttaactccagatatcctaaagctcaattgttggtctctggttgttcatccttagagaagccatgggagaacagacttgaaaagtttaggaaatcataatgtggcagaggtggtgggaagaagacagttgatgctttttccccttgagaaacttctgcatttagttctctatctttccacggcaaaacaaatgggtattcttttcatacaaccatttgcaaatgaaccttagcaaaagtcttaacatctaaggtatttttatgcacagaatacacttagattgataggaacagaactcgtaatggagtttgagtaagagaaaatgactgatgtactaatacccagtaaaactgttgataaatgttacaaggtcagcctgttctaattgggaatctagatctagcttagatttcctattgggcttagagtattgcgctataaacaaatgaagtgcaactgacaattatattttcctactcggtcatactggactggcttccgtactcttacatatactcagtaagtgactcaaggcctctgggtatttaacataccctagttgccggttttgcaacttgccatgagccaatacttcttggatacattgatccatttattttcattggctgcctttcatttctatctcttttgctgctaccatcttgg

SEQ ID NO: 497755 - DNA, 496 bp, Homo sapiens
  misc_feature (496)..(496): n is a, c, g, or t
ctcttaagagcataccaatggaggcacaacagaaagagtcataatgactagagaaatgatggttgatatagaggtggttatctttacaccaacgaaaaaaaaagacacatgaataagctgtggagaatgattttatgttcttatactaacagtaggctgagaatctggtaaatgagatgttctaagcctaaggcagattgacttgcataaacaagtgatttaccctgctcggcaaagcaggcttgcatattgtcagacttgcaggacttttttacaaatgctgtgaaagcatacataacaactttcagttgctcttttgttgccatgggctagagtgtcacaagctcaacaagtgccagttgaatctagaaggggatctacatgtgagaaagtgcgcatatatatgcatggaaggagaatgattcagattaaactctatgagaacgtatgtttcatcgacttccagagctgataaacatgtgcgcctgttcaccan

SEQ ID NO: 497756 - DNA, 329 bp, Homo sapiens
tggaaacaaagcctggctctggtggcccaggggggagtgcaaaagcaaaatctcggttccttgaaacctccggggtccaagtgatggtccggcctcagcctcccaagtatctgggaataacgggcttgtgccatcacgcgcagttaattgggtataatctgggtatatcaagaagagatgggggtccgccatgtggcgccaggcggtctcaaactcgtgggcctcaagtgatcggcgggcctcagcctcccaagggggtgagcctcgggaccgggtcacccattctatataaggggcaatctttctggtcatctcgggaccggccagcc

SEQ ID NO: 497757 - DNA, 295 bp, Homo sapiens
gatagagtgtgcggagtcccgccctacctaggtactgtgcaaaggccaagcaccttcatgtctatgagatcctctcagcaactctgtaatctggtcccgaccagaatattacctttcagcagctgagaaaacaacttagcacagagcaggatgaattaaaagcttggtcgtaacatgctgtggcgcagcgtggtcacgacctggtgatgcccagacacttcagggaatgatcgagtgcaggatcggaatcagcaaggttcaaggaggatcagaagacgcatcactgggcccaagc

SEQ ID NO: 497758 - DNA, 150 bp, Homo sapiens
aggatatgcaagcgcttctttatcctgctgtacctgttcctgaaacggaactacgacaagattgacgttgtgttcatccgccatcacaccagcgcgcgagaggtggacgaagaggagtttttctactctgcggcgaaactggacggcacc

SEQ ID NO: 497759 - DNA, 484 bp, Homo sapiens
tatgctctatttaactgatttctgtatagaactctagtgtcgtctaatataagtatagttactccatgatctttttaggttactatttgcatggaatatcttcttccatccctttatttcataaagacacacacctttattacttctttatttcttctataaagacacacatagacaatgtaaatggtttcttgtaggcaacagatcattgggtctatcttttttaaaccatttagccactccatgtcttttggtcgaagagtttagttcatttacattccatgttatcattgataagtaaggacttactcctgcactttgtgatttgatttctggttgttttgtggtcttttctttcttcttttcttccttcctgtcttccttttagtgaaagcaattttctctggtggtatgtcttaatttcttgctttttattttttgtatatctattatatgtttgtcgatttgaggttccagaggtttg

SEQ ID NO: 497760 - DNA, 234 bp, Homo sapiens
caaagtttttgctttttttccggttttcccccccaattggtaaaaaaccgggttttttttcttttttggtttttccggtttggggggttttttttgccccttttggggaaataagggtttccttttttccttttcccttcccccccctttgggttccccctttttttttcccccaggggttttagctgttttgggggtgcttttaaaaaaacccccccgggggggttttttcca

SEQ ID NO: 497761 - DNA, 229 bp, Homo sapiens
acggcgtatgtaatttctctcgtttcagcctcaggtgcacacatccataaaaggatcataataccatctgtctctgatcattctcggtaaacattagaacctctgggataaccaagcctttacagcaaattcagaaatgaacactgcttactcacggggtcccacagaccacccatagggcttagtgactttgctacggacagactcacagcgactcagctacacagtt

SEQ ID NO: 497762 - DNA, 308 bp, Homo sapiens
gtcaaccctagccggaccctagctgctattggagggctgcttgatgtggattgttctgaggaagagattaaacacttaatcatggcagtgagaggacaggtctctactgatgagttggcggctgaagtaaaaaaaagaaataggctcaagctgatgcttccctggctggaggcgcacattcaggaaggctgagaggagcctgccactaacaatgcactggctaagatctacatcaacagcaacaacaggcccgagtgcttcctgagagagaatgcctactatgacagcagcgcggcgggccgctactg

SEQ ID NO: 497763 - DNA, 429 bp, Homo sapiens
aattttaaaggttttatttggggaacctataaatgtccaaggaacacctcaccaacccaggttctccggcaaggcttcagccagtcaacgtgtttggggcccgtgactccctgcaacaatgccctgcaggaaaggttttttttttatacccagtttttacaggaggaattatttcccaatatttcatagtttatgaggctgaatccttcttgaatttataaatgcttacctcacacactctgtgatgatcatggtttctttactgataaaactcaatacctagaaactgcacctagctcatgatggtacctaataaatacttcaatgaaatgatgtggtgatgcatgcctatagttttagctacttgggagggtgacctgagcccaggggttctagaccagcttaggcaacatagcaagaccccatctc

SEQ ID NO: 497764 - DNA, 1392 bp, Homo sapiens
  misc_feature (1)..(2): n is a, c, g, or t
  misc_feature (170)..(170): n is a, c, g, or t
  misc_feature (990)..(990): n is a, c, g, or t
nntgttcgcgatcgctactgcagtgaatcggactggtcgttgatgttctcattagttctttgtgagtggtgtcttgtagtggctgcgcgtcctctcttgctctctcgtggttttagtgtttgagttgtatgcggtacgtggtgagctgttcttgtttcgttgtttttctnctgttgttgacttgtttgtctctgttgtgtcttgctgcgttggtgattctgatgctgtgctgctgtgtattgtgctctgtctggttttgtgcgttttcttgctcgtggttgttgttacttcgggctgactgttttgttggtttttttttgattctttatctggctgctgtggtttgtgtgtttctcctcccataggctgtcgtgagcaggaggacctcgtcaaattttataccaacaagccccatgtgtggggtgccgagaccaaccacgacccggattttttagggggcacccacattattaggggacctttctgggaggggtctcccacccaagaggtgtggttcgacccacaagagagaacgcccgggccgtttgtttgatatacacgccgcgcgtctccacgtttatcttattttacccgggtcctctttaaagggtttgcccgaggcgcccttggggtgggccgcgaatatttctcggccccccgagaggggctcttctttgtataggaagtagtagagtctccgccctccttctctttgtgaccgagcccccccgtgtgatctttatgtccccgcccctattgggaaagttttctcttggggcctccccccggcttatctttttccagagggggagacaccccacatggggtcccctttgagatgttccccgtcaccccccgcgggagaagggcgaccacagctgcccttattagaccacagagaatattgtgggagaaaataactatgcgccccacacaatgcttcccacgactcacacacccgcgagatgttacactatgttttgttatatnttgggagatatcacgagaacatcacattttggggtggtgggccaggaacacaactggctttcgggcactgagtatttatgagttgtccctcgggagtttatgcccacaagagaaaataggaacccccgcacactgaggagcttgccaacgaccactcggctcgtgattgaagagaaggaaaaagagcctcccacgggaaagccccacccaaaaaggaacgcccacagaaccacgagattgaaggaaataatccgggggggctcccaagagcccatagttggtggctggcccaaaaacccaaggagggattaagaagtgctcccatagatgtttagactgtggcccccgtgggttttttcccccaagcaaccacttttattaactttaaacttcccaaaaaaa

SEQ ID NO: 497765 - DNA, 637 bp, Homo sapiens
aactgtaaaccaagagagtgcccaatggggccccctccccatgcgcgacgcaatacgctgcgggccccccaccctggcggggagaaacccacgtgcgacacacccgcgactcagcggtaccgacccgaaattatcctaccgtcacccaccacatgtaacgcgccccgcacactgtccctcaggcgcccgcccctgcctctctggatatcgcccggacagtggttgccccccgctggagtaaaaatcccgcagtgtaagagccccccctgttgcgctcaatcaaatgtaacactccacccaagcctttagttgcacctcgcgcagggacgagtgacccccacgttagtgcgtttaacagcccacggaactcgcttcccccgcggcactttctatcgcccatgaccacctctgacgcactcgcttacctaccagcgggaggtatatactcgcggacaacaatatgtcttaaaaatctccattggcagcacaactcaccccacttcgtgcctaacgcacatctactgcctaatgaaggttgagtttcctccctgaaaaagtcttgatgaaacatgcggggccctccactttgtgcccacgtagcgctccccctttacccccttttaacccccacaaaaca

SEQ ID NO: 497766 - DNA, 667 bp, Homo sapiens
  misc_feature (3)..(3): n is a, c, g, or t
  misc_feature (71)..(71): n is a, c, g, or t
  misc_feature (77)..(77): n is a, c, g, or t
  misc_feature (114)..(120): n is a, c, g, or t
  misc_feature (123)..(124): n is a, c, g, or t
  misc_feature (126)..(126): n is a, c, g, or t
  misc_feature (131)..(131): n is a, c, g, or t
  misc_feature (133)..(133): n is a, c, g, or t
  misc_feature (140)..(140): n is a, c, g, or t
  misc_feature (142)..(142): n is a, c, g, or t
  misc_feature (144)..(144): n is a, c, g, or t
  misc_feature (147)..(147): n is a, c, g, or t
  misc_feature (149)..(149): n is a, c, g, or t
  misc_feature (158)..(158): n is a, c, g, or t
  misc_feature (160)..(160): n is a, c, g, or t
  misc_feature (163)..(163): n is a, c, g, or t
  misc_feature (168)..(168): n is a, c, g, or t
  misc_feature (170)..(170): n is a, c, g, or t
  misc_feature (247)..(247): n is a, c, g, or t
  misc_feature (249)..(249): n is a, c, g, or t
  misc_feature (287)..(287): n is a, c, g, or t
  misc_feature (359)..(359): n is a, c, g, or t
  misc_feature (483)..(484): n is a, c, g, or t
  misc_feature (495)..(495): n is a, c, g, or t
  misc_feature (500)..(501): n is a, c, g, or t
  misc_feature (503)..(503): n is a, c, g, or t
  misc_feature (507)..(507): n is a, c, g, or t
  misc_feature (509)..(509): n is a, c, g, or t
  misc_feature (518)..(518): n is a, c, g, or t
  misc_feature (532)..(532): n is a, c, g, or t
  misc_feature (592)..(593): n is a, c, g, or t
  misc_feature (655)..(655): n is a, c, g, or t
ctnttaaaaactatgacacaacttacacagctttttaattttcaataatacattatcacgcagcaaattanaaacanaaaagcgcacactaaactacaagtctcctataatttnnnnnnnccnngnagggnanaactaantnantcntntccaatctnancanctgantntttacaggacatcacctgccatcttaaggcttaatatttacaaatgcctagttttaaggtaacaaagcagctgattntntctacaacatgctattctatgacaccacatcaaaagcnttaaaaagaaagctcatctctattttcttagtagcatctaacagatatccaaataccaagaatcttaacttntgaatggtggtgttatccaatgcacaaaagcaatctgataaattaatatcagaacagaattaagcgtccaagaaaagaaaaaccactcctcaaaatcaattcacaaactaagttttccattttnnagaaccctttnttttnntntttncnagttaaatntgggcattttaaanttttttttttcattttttttttttttttctctttttttttttttttggttttttgtctcnntgaagaatcagaaaccccaaaaaaacacacattttcatgctgaaaataacagtgtaacaaantccaaaacaagc

SEQ ID NO: 497767 - DNA, 260 bp, Homo sapiens
cgcataaactataacagcataaactattacaccataaactattacagcataaactatttaataatcttagagttcatttaatctcagcacagggaagggtttcacaatgaagatgtgtagcaggcgttatcccatggttatcactgggcagaacaaagaccagtgagtagacactataagaaggcacattggctggtcacagtggctcacacctgtaatcccagcagaatagttagctgtaatagtttatgctgtaatag

SEQ ID NO: 497768 - DNA, 446 bp, Homo sapiens
agtgcaatggctcacaggcagggtgattctctctaagcggaacacctgcatttgaatccgcctgcctggtagtagcaccctggggagttgtctaacccctatgagcccaacctttcacatttgggaaaagtggaaccagcagttcgatgcctggctgggtgtctgtaggaaacatgaggccccggaagtgcaagggcctcacacggcacaggatcctcacatggctgccagcctctcctccactcctggagtctgcagagccctcccctcccacacacttcctctgggaaaagctgcccaggctgctgtagggaacaggaaccctggagaaggcagaaagtctggtggcacacgccaaccctcagcttggctgggcaccttttggcagacagtttcaccccactgtttccctgcctccaactaggcagccggcaggtcagtcagtt

SEQ ID NO: 497769 - DNA, 955 bp, Homo sapiens
gtgttgaatacaatttattaagtacctatcacaggtttgtttccttataatggcagcatctgagctgttggcactattggatgaggatcagatggcttgcgctttaatttttattatgcacgaaaatagcctttctctgcactatgagatccgaatgaaccttatgatgtgtatattgagatgtactcagtgtgatttcaaaccaaattgtctatcctgtagtcacaatatatactgtagcctttaacagcaagtcttgcttcccaaacagaaagccattctgaaatcctacagtatcacaggtgcgaaaaggtggttatattaccccaagacaacagactagtaatcccacttaataagagcttatttaatgggatgtcagcctcttaacatgctaagccactttgtgggtctcagccgtcttcataaacagaacttccgtatcccaatacaaagtctgctatgagactttacagcatatgatcttttttccataaacttgtacagtgcaaagacacttttgaatacccatgatcgatgatgtccatgctcgaggaaatccaaacacttccgcctctcttgcaaattccattcctcatgactgaccaatccttcacgatggcatgcgcacgccaagcccttcccttactccaagcccgagaactcttccaaaacaagatgatgaagccatgggaaaacggaagccaagtcaacgggagtcctcactctgaatgcggggaaaaactgacagctggggctacaagtagagccatcggcggtgaaaactcttgaaagaggaccctcacgagcctccactgaggtcggacacaaatctgacgtctccgcgagggacgtcagacacggacaccgccagatgagtaggcacaaaagcatcacggacgctccagagggacaaggcgacaaaacgcacacgcagatgacaatgacacaacac

SEQ ID NO: 497770 - DNA, 372 bp, Homo sapiens
  misc_feature (14)..(14): n is a, c, g, or t
  misc_feature (22)..(22): n is a, c, g, or t
  misc_feature (24)..(24): n is a, c, g, or t
  misc_feature (26)..(26): n is a, c, g, or t
  misc_feature (32)..(32): n is a, c, g, or t
  misc_feature (36)..(36): n is a, c, g, or t
  misc_feature (82)..(82): n is a, c, g, or t
ggggggttattcanctctccananancttccncctntttttttttgaacccgggggcctggggccccttggggttgcccatngggggggcttcccggttgaggccccccttggtttttttttttcttccccaggggttttgccctcttgggggggcccccccttggggtttaaaacagggggtatttcggggggttttaacccacccccttttcccggtacccggcgggggggtttctcggggccttgtttttaattttggggggccacccccggtttttggcccctgggcctgggtttttttccccttaaattttttggattgggggcgggtttttccctttgggcccccctttccccccttttgggccca

SEQ ID NO: 497771 - DNA, 509 bp, Homo sapiens
  misc_feature (34)..(34): n is a, c, g, or t
  misc_feature (199)..(200): n is a, c, g, or t
  misc_feature (311)..(311): n is a, c, g, or t
ggggtggggggggggccccaaagggccccccccnccccggaattcggggccttaatttggtggggggaacacccccccgcggtgtttaggccggtttttccctattttaaagaggcgccagggggtttttttttacccccttggggggggccctctcccatttgggggaaaaaggtggttgtgttggctcccccccccnnaaaaacaccccccctttttttttgccttttgggggggtttcccccccccaagagggggggggtcaagggccccccccggggggggggggttccccttttccccaaaaaaanttttttggggggcggggggggagaaaccccccccccctggggggccccccccgggggtttttttttgggggcctttgggaaaaaaaaccccctttttttttccccccccccctttttgggggggggggggttttaatttaaaaaattaccccccccggggggggaaagtttttttttaccccccctttccctttttta

SEQ ID NO: 497772 - DNA, 1062 bp, Homo sapiens
tgtaaacatctgtcagtccactgcaagaacagcagaaactcgtagctgacctccatttggcctactcactgaattaagtgatgttactcattcgctttgtaaaagcaaactgagtgaggccccaggctcattgaagactctgtgggttacccagaagcccaactttccagattcaatattttttctatttcttagctgtgttaccttgggcaagttaattaacctctctgtgcctgcatgttgcatctgtaaatgagactaatactagtacccaccttctaaagtgattatgagcattaaatgaattagtacgtttaaaggcttagaacagtgttttatgatacgataaacactcaaataatgttagctattgatattggtgtgcccagaaggcttgttactactagttgatttatgtgcttgccaaaagttgttgtgttggtaattaagtacgacataaactaatgaaaattgagtttataaagagttgttttatgaaaagtttagtactttggatagaatggataatattgatttgctaaaaaaaaattgtcaccaaataacttaaaggcaaaacagctgtaaaaaattgtaaaaccatagtttgtattccatatgctttacaggtgattaactttggcactgctttaaagaaactgaaaccaggaattgtagatgttgacttgtgagtgtgtattttgcatggaagatgatttgcatctctagtcagcgtgccaaaaaaagatcctaccctttgattggttaataaatatgcaactataataaaatatttaagtgttggtccttaatgattgcctacattttcaatgaaatgacagtggcagaactgaggaacaggggtttttctctccaaggcagatcagctgccagaaattgcacgttttgtaccagctgcagggtttcctggaatcagcaaaggcctgtgagaggctgcatgaaccacacacgcttactgacacctcctgtgtgccgagcgctgagtagtgctgaggatatagcaaatggggaagcaccaccaatacagggagcaccaccaataca

SEQ ID NO: 497773 - DNA, 427 bp, Homo sapiens
atccaagttaatgaagatttagcctatgttttcttccaggagctttataatttttaggtctttgatctattttgagttaatttttgtatatggcatgaattaagggttcaactccattctctggtatgtggttatccaattatcccagtactatttgttaaaagatgaacttttctcactttaattttctgtgtcaacaatcaattgactataaatatgtgggtttatttctggactctcaattgcatcccattgatctatatgtctatcgttatgccaataccacactgttttgattagttgtttataggaagttttgaaatcaggaagtgagtcctttaactttgttctttttcaatattattttagctattcttgttcccttgcaattccatatgaattttggatcagcttgtccatttctgca

SEQ ID NO: 497774 - DNA, 906 bp, Homo sapiens
tttataacaattgccaagataagaagacgatatattatagagactgaagaataatgtgtcatccaagaatatagaaatctgtacaacatttgccacaatcaatatacatgaactgttcaattttacgccagttcataatcttaccaaataaaagatgactaacaaagtgcactaaaatagatggtggtttgtggaaaagactgtttacccaaattaatgtacacggaaaggttacaaagccagacctccacttatctaacataccataagaagtttactcagatcttagaaaacgtacaagctagcaatatgtacagagagctggctggatgctaatgcaccagcaggttgagacagtggtctgtatgtaaaggggtcttttttaaaggcctgttgccatggctgatgtctgggtcactagctacctttcaaggccaaaaacacgagatacaaggtctgaccattgtgccccgaggtcatgcttactgagtatgtctacatgtacgtttatacgatatataagtgcttaggtaaaaggtcttgttaaattttccagtactaccatgtgtaaaacgttgtaactttcctattaaaagctgccgaaaaggttgacaataagaactttcaaggtgtaatagtgcaagattcccctgcgaagattccacctgcagagacaagatgcttttgaaaatactgatcgctttccgaaggatcgatggtccacacttgcatgtatgtactgggaggaaactgagagccaccctaggaacttcctacctagcaactacgtgaccatttacctgggactccaaagctattcaccattaatccttgaaaagtctcggcacacgtatggcccgctctgaaatgtgtaagataaacgattatatgagggccaattacacg

SEQ ID NO: 497775 - DNA, 255 bp, Homo sapiens
aaaggtggactcgaccgcttcacatccgcgagcgtacacggcaacgagcaagtgcacgtcggcaatggcgcagcgtttgcatatttcccacactggtcacagtactattcctacaaatgccaatcctcttcacttgcgcaatgttctctatgttccacacatcaccaaaaatttactttccgctcacaaacttactcaagacaatgaagtttttattgaaattcatccaaaccactttattgtcaaggatcaggt

SEQ ID NO: 497776 - DNA, 666 bp, Homo sapiens
  misc_feature (448)..(448): n is a, c, g, or t
tagtctaggtagaggctggtttaattcggccgaggctgggcggagcctggcgtccctcccgcgtcggccgcgcccgtcctcctggctgcagagagactaccggccaccgccgccgccgccgccgcgagctgtccctgcggcgcgtctgccttgtgcggagcctgacctgctagtgctgctcagtgctgtcctggtgctgtccctcagcctcctgcccctgtgctgctgtgggtgctgactggtactctgctgctgtgcgcatgcgcctgtgaggtggctgctggtgcttggtgaccgcccttagtcccatgctgctgtagctggcctagatctgatgcgtgcagtgtgctgattgtgtgttgtggcgtgcctgtgtgctgcctgtgtgcggccaagtgccatgttgattgtgtgcctttccctgctgcttgcttgtgcccacacattntagtgatgtgacgggctctcgtggtgtgaccagtgcaggtgacgcacctgtgtgtcttgcccctgctgcggggttgcggtgacccaattagtgcgtgtatccctttgtgcccggtgtgcccgggctgccttgcctttgcggaccttggggcctaggcttctgcacggcccaggcacccttttgcccaatgctctccaactaaacggtatcgggtggcg

SEQ ID NO: 497777 - DNA, 545 bp, Homo sapiens
ccgactctagaggacccttcgattggtgggcacttacaatttctcaattatgatgaattaatataatgtacagagtatactaccgcagttaggatgatcaattgatgaactatgttgaaataataaaatgacatttaataatgggtagtagttgaaaagataagacagactataataataatggtttacacttagaggaaaaaaccttggggaaatgtggcttaatctttgagtaaataatttggcacaaactcatacacccaatgtactacatttttataaggaaaaaatgaccaggagatcaaactgataaaaagtaatttcttcacataaccaaattgtcagaaaagcttatagaatcagtactaattcattccaataaccccactgtagaacacagtaactattctaatgatgatcctgagtcaccaagaaaaatttaactcctgaattttcggtgaggtcatcctttctctacaattggggccatactaatatattagtgctatatactcatatagctccctcactcagtaagttctggc

SEQ ID NO: 497778 - DNA, 502 bp, Homo sapiens
  misc_feature (2)..(2): n is a, c, g, or t
  misc_feature (10)..(10): n is a, c, g, or t
  misc_feature (27)..(27): n is a, c, g, or t
  misc_feature (47)..(47): n is a, c, g, or t
  misc_feature (66)..(66): n is a, c, g, or t
  misc_feature (82)..(82): n is a, c, g, or t
  misc_feature (95)..(95): n is a, c, g, or t
  misc_feature (139)..(139): n is a, c, g, or t
  misc_feature (142)..(142): n is a, c, g, or t
  misc_feature (154)..(154): n is a, c, g, or t
tnttcctgtnaaacccatgagattccncttaaagggtatttaagtcncttgattgttcccccaaanccataagtttcttggncaggttaagaagncctgtgttgctttcattgcaccatcagtgcactgtctttctgtnatnccttattcttcncaaagcatccctcaacacacatttcacaccagcctgttgcgcgggggctcattaaaaatagtcagggccgccgggcgcggtggctcacgcctgtaatcccagcactttgggaggccaaggagggtggatcacgaggtcaggagttcgagaccagtctggccaacatagtgaaaccccgtctctactaaaaatacaaaaaattagccgggtgtggtgttgtgcatctgtaatcccagctactcgggaggctgacgcaggagaatcgcttgaacccaggaggcagaggttgcagtgaaccaaaatagtgacactgcattccagcctgggcaacagaacaagactccatct

SEQ ID NO: 497779 - DNA, 712 bp, Homo sapiens
tgggagcaaaactttactggtcagcaggctctgcggggccacgggttcttcagaaacaccgggctcgcccggcctcctctaaggctttcaataattattagtatattaaatagcaacgctctatcccccaaccggatattgtccaacagaggtccctattggtgcctatgtggtcccaaggggtctgggtcccatgaaggtctgggtactcaagaggcagagggggctccctgtatgcacgaaggtgttaaggccacaaaggaaacggagaagggatggggtgtctgggggacagtctgacgctgggtccatcacttccaggattctgggtctcagccctcggggtcgactgatgtcgcagggcttgcctatgtccccagtctctgcggtgcccggagggcgcggctgggggccccgaggctgtgggggatactgtagagggttacacgggcactggcgctggtgttgtccatcacagaccccagtgcccaggtccatcagaggggttcagtggcaaagccaggggggcctccacaggggcatactaaggggccccccaatgccagggcaggggctgcctttaactcggaggacctggaaacgggcttgggctacaggggcccaggaagcccattgggccagcccggccaaagtccccaaggttgtggccaacatttgccacccaggacgcatgagggacaaaaaggaggac

SEQ ID NO: 497780 - DNA, 81 bp, Homo sapiens
ctagaagattcagcaaagtacttttgtgctcttggggaacgacttcctcctgtactgggggatactccagcacaactcttc

SEQ ID NO: 497781 - DNA, 177 bp, Homo sapiens
ttctgtaactattgtcgcacagattaccataaccgggcaagtctgtggagaggagctatgcacggcggtattcacactgcccgttttcccatgggatgcctttcttctgttccaggacccagcattgcattccgatcctgtctctttaggctccttccttctgcgacccgggatgtg

SEQ ID NO: 497782 - DNA, 284 bp, Homo sapiens
ctctgctgtgggtaggcagaaggcgttatcaggtagactgaccggaacgccagaagtccgagtgttcctcacaagattattcctctgagttgccggtctcacggttatgatgaggttacggctataagcaatcatcatgtctgttacttgatcaaggctcttccctgtagacttctatgccattcacttctaaaacttcatcatgaacagctaatagtcctgtggtgtgagccagacctcctgggacaagcctggagtatcaagatcccgggaaccttttctag

SEQ ID NO: 497783 - DNA, 108 bp, Homo sapiens
tatgacgcgcagttccgagacgccgccggtcaggtttcggtgtcgccggggttgccgtcgacaaagcgggcatgggccagaatgcgagcggtccgtgatgtccttcag

SEQ ID NO: 497784 - DNA, 206 bp, Homo sapiens
  misc_feature (6)..(6): n is a, c, g, or t
  misc_feature (22)..(22): n is a, c, g, or t
  misc_feature (33)..(33): n is a, c, g, or t
  misc_feature (176)..(176): n is a, c, g, or t
gaggcntgagccgttggggacntcgagcaacgntgactcggcctccccggacctgggtccccggggtcctggactggcggttctgcaggcggagcgggaagtggacatcctgaaccacgtgttcgacgacgtagagagctttgtatcgaggctgcagaagtcggcggaggcggccnatgggctggagcaccgggagacgcggtcgc

SEQ ID NO: 497785 - DNA, 298 bp, Homo sapiens
ttccaaaaagaggaaggtataatgaggtatgtctgaccccccattcccatcatggcctgagctagtgtttcaggtttactttagaatgctcttggccaagtggaagggtcgattcagttggttgtgggcttagaattttatttttgacttacatagactatcagctgcttcatgtcacatctcatgcttttcttatgttgcccagttttttcagggcttccggcggcatgtttttgtactatatgaaaagccttctttttagaagactaccaattaaatatttctttagacaaatgta

SEQ ID NO: 497786 - DNA, 382 bp, Homo sapiens
  misc_feature (374)..(374): n is a, c, g, or t
cgaaatagggtactgtccttttaattgcatcctgagaatttttttcctgatttccctacgtctttaactataacttctccatctctctctctcactttctttctctttctcttcatccttgcccattcaatattgggtttcccaaagtttgcccctggaccttcttttcattttattctctatgcactgtatgaaaggaatctgtctactcccatattctcaacaaacccctgtatgtttgtatcttcagacctgacaatttcttagactttcaatctaggattaactactgtctagcaatcatcatgacatatggcaaacttactgttctataggaatctcataatcaacatgaatcaaactgatttcattgntctgccta

SEQ ID NO: 497787 - DNA, 429 bp, Homo sapiens
cagctggtgagtagcttggatttacaggtgcctgcatacgtccagctaatttttggtatttttagtagagacggggtttcaccatgttggcctggctggtctcgaactcctgacctcaggtaatccacctgccttgcgctcccaaagtgctgggattacaggtgtgagccaccaagcccagcccagttttgttttgttttgtttttaaagacagggtctagctctgtctctcaggctggagtgcagtggcgcaatcttggctcactgcaacctccacttcctgggcccaagtgatccccccacctcagcctcccaagtagctgtgactacgggtgcacaccaccacacccagctaattttttttttttttttggagacagagtctcactctttcgcccagattggagtgcatgggcacgatctcagctc

SEQ ID NO: 497788 - DNA, 404 bp, Homo sapiens
ttttcatttcattccatctttaaaattttttatctttggtggagaatattaaaaactattttaagaaagataaattctctttaaaaagatctctagggggtgtgaataaagctccagatgcctttaaaagccgcatgtacaaaggaagccacgtctatcccgtctgtttaaatttgcttttcctgttttgtaacctctttggactttgttcatggtgacttgtaagctaaggggaaggggggcctaaaagcctttgtatctttccatgtcacgcggtcctgggccagccggcctcccttcctctccttgtatgtaaaacctttttttcccctttttagcaaggactttcaaaagaactctggacattttaacataaaaaataaattatgttgagcccttttgga

SEQ ID NO: 497789 - DNA, 237 bp, Homo sapiens
tcggccggtccgcgaatcacagaggtgaactcggggctttagtatacctatcaccgaatagtgaacatgtgcccaatagttaatgtctcaacccccaccgccccaccaccatccatcctcctaccttatggagtccccagtgtctattactgccctgaataaaaattattttaagagaaatttatttaaacagacaggacagcttattgttcagactcctgatacaatctcaacaga

SEQ ID NO: 497790 - DNA, 172 bp, Homo sapiens
tttacatttctctaatagtgattttaaacatcttttcatgtacctattagccgtggtgtatcttctttggaacatgtatatttaggaattctgttgggtcacctctgtgttgtagagtctgttagtggcctcacaagattcagtaccatgctgtgagtacccatcgcgtgtg

SEQ ID NO: 497791 - DNA, 103 bp, Homo sapiens
  misc_feature (33)..(33): n is a, c, g, or t
  misc_feature (69)..(70): n is a, c, g, or t
tgatccccccccccccccgatatttagggcttncgccctctctcccttgcctttagtgtgaaaagaggnntttatttcaatgcttgacagcagggacagcggc

SEQ ID NO: 497792 - DNA, 117 bp, Homo sapiens
ggggatcccttctcccccacatcccttagatggagcgagctttattcaaccccccttccacattggtcaaccggccccacttatatacacttaaatatacacgtttttcctttttca

SEQ ID NO: 497793 - DNA, 196 bp, Homo sapiens
cacgtagtacgtgtcgtgcagtacggtatctagtgatgagtttgctaatacaatgccagtcaggcgacccccggggttatataaagatgaatggtagggctcagagcactgcagcagatcatttcatattgcttccgtgggagtgtggcgagtcagctaaatactttgacgccggtgggatagcgatgattatggt

SEQ ID NO: 497794 - DNA, 442 bp, Homo sapiens
tatttatttattatattaagtatatagtaaatttatttttaaaaatacataaaaaatctttaaaaataattttttgcaaatttcataacttagcaaggcatattgttttatttcaaaatgtatttctttactagcaaagttgactacttaaaatatatctgtattgaagcaccagaactgctgactattacaagtttgtagggtccataaagtcaagcatatctttatactaatgtgtagaaaacctctttcatttgaaactttatgaaaatcaaaatgattcattaataaaaaatgattcttaaaaatgtattatttacagtttttaagatataatgctattactacttaatagactacagtatagtgtaaacataacactaaactgtattattgtacaataaccaaggaaatctactcaaaataaactttaaaattggga

SEQ ID NO: 497795 - DNA, 365 bp, Homo sapiens
aggacccgaaacctaataacgctagcacccaaacgtgagcaatattaatactctgcaaaatatatccatagattttaaagtgaaactggtttaccttcagagcttggtgttaaatacaccattcactggattccataagtgtataatcactgctatgagatttggtatctgtttctgaaatataacaacatatacctttactttatagggcatcacataatacatcttccttagaagggagcggtagagggcagggaggtaaataacagtcatgcactcataaattatggcttactttcaagctgcgaaagatcagtatagatgaattctgtctcgtatatgacttggttcccgtaattagggtt

SEQ ID NO: 497796 - DNA, 249 bp, Homo sapiens
  misc_feature (69)..(69): n is a, c, g, or t
  misc_feature (78)..(78): n is a, c, g, or t
ctggacctgtgcttgggcatcagcaatgagtatgccttctattgtgctttgtttttgctgacttttctngcaccctgntttcctttggatattcagttctctcaacgctcaagattgagacggtggtgggtatgcttcttccaactttccattattgaacctttcaatggcctgtgttctctgtggacaattattcaacattgctacgaggtcatccttcacactacttgtaagccaagcaaatgatac

SEQ ID NO: 497797 - DNA, 396 bp, Homo sapiens
gtcccatcaataggaacggtatttgccatcataggagggttcattccatgatttcccctattttcagggtacaccctaggccaaacctcgcgcaaaatccatttcccttttaattttatggggggaaatttaacttttttcccccaaccctttttgggccaatccggaatgccccgaggttactggggttaccccgatgcatacaccccatgaaacatcctatcatctgtagggtcattcatttctctaacagcagtaaaattaaaaattttcatgatttgaaaagccttcgctttgaagcgaaaagtcctaatagtaaaagaaccctccataaacctggagtggctatatggatgcccccccccctaccccacatttgaagaacccgtatacata

SEQ ID NO: 497798 - DNA, 953 bp, Homo sapiens
tttttttgggttgagcacaggttacttaattgatggtacatgacaaggtgcggctccctaggcccctcccctcttcaaggtggtctacttggcaactgagttgtggcagggactccccagcagtgaggtgtctctcttcttcctcttgtgctcttgctggggctggtgtgcccaggggtcttactccttggaggccatgtgggccatgagtgtccaccacccttttgcttgtacccaaattctgtggtcataccatggaaatgagtcttgacaaatgtggctcgttagagggcaatgccagccccagggtcaaatggtggaggatgtgggttgctccgcttgtttgaaagttcagaaggaagaacccacctgtgtggtgcctcaggtgttaccccaaggaatgcccctttgaagggtggccccctcctgaacgccgtggctttcacacaacctttcttgtgaaatgttccactcaatatattgtgggcaagagttttttctcttagaacgggcgaggtctcagaggtctcccaccacacgtggaacacacgtttttgcgcacggttggtggcaccacgtgaaaagcgcccagttgcccagttacagcttttccccgtttcaagctctcgagggggaatgaaacttttgcccccaaagagcctttttgggcaaagcgcccgagttagaaggcgccagggatataaagtgttcgtgggagaagccccccgtaggtccaaatcaaaggccaagaagttttcccccgggaaggggggggccccatcaccacaaggttctccctatgggggtgggaccagttgcatgggctaatgggacctgttgggtccaataagtctccttcccccacgaattcccccaatgctttctctggtggggggagacaccttattcttttcccgggtgaccttcttaagccaccttgtgctgtgcttctc

SEQ ID NO: 497799 - DNA, 179 bp, Homo sapiens
ccaagacctgcttctaacctccctgttcttatgaattcgaacagtcatacccccgtattccgctacgatccaactcatacacctcctatgaaaataacttcctaccactcaccctagcattacttatatgacatgtctccatacccattacaatctccagcattcccgctgcaaaacca

SEQ ID NO: 497800 - DNA, 1242 bp, Homo sapiens
tgcaatgcccgaccgtcaggtggcacagaggtagatttccctgcgccccctacgtgggtttttgtctgtcaaacactgtatgctgtgggtggttgctgaacaaaacacatcatggactaacatagggtcgtgtggggaataaggggggtccttgaatagtatgatccataaatagattgttgcgccggggttgtctctttgatacacgcccacctttgtgtgaacttattcaccggcgggggatatatgttggcgcttttttcttaagaatacgttggctcagacaggaagccacccctggtttggtggcccggcccctgttgttttttttcctgtcccccaccacacaccgccctatatttctttgtggggggacactaaaagatgcggcgcgaatgaagggggggaagagtgggcaactactttttcttcttgaatagagaactagctggaagtaagtgtccccccccctccgaaggggcccaaaaagacttctagctgaaggggggcctctctgttgttgggtttttttttctcctggagcgcgttttttgtgacacgtgagcctactcgctgcgaacaccacactaaatggcgagaggtctcataaaccccccgggggggaaaacatcccgtgtaggccaccaggcagatcgtggggaatgaaacacctgttgggcgtgtctccagacttggggcgctctggcacaaacaggaggtatatagtgagaggtgatagactggaatgttcttgtttttgttgtgcgcatatggaggatattctcacatgggttccagatgttccctttctcgccttaggtaacaatatcccccgccctgggtataggaaccggaccatggataatagcttatgccagcctgcgacattttacccttttaaaaatggatcccctgtttgtgctgggtgtgatggccccacagtcttataatccccgcccatatgggaggcccaggaacacaggccagattttaccggaggtctaggagtcccgagacccagccgtgaccaagccatggtgaacaccccatcttcttacctaagataattaataccaatttcgcgcgggcgtggtggcgcaccgccctgtgatccccagttttactcaagaggctgaggccaggagaattgcttgaaccccgggaggcgcgaggttccagatgagactgagattacaagactgcacattcagccctggccacagagcgagagtccgtttccca

SEQ ID NO: 497801 - DNA, 1006 bp, Homo sapiens
  misc_feature (242)..(242): n is a, c, g, or t
tttccagtctcagctctgcacagtctctgagacgctcctggaaacttgtataggttgttgacctggtggtactgggaaaaacgaccttcgctgagaagccgtcattttgactggtgacaattatgagacagaatgctatgtagccgaccgtttggcggtgttcgaggtttcatcgccctaactggttccactacacaactggtaggaccttaattaagcttcatatgatatggttgacacangcctggccaggagtacaacttcggttggactgaaagtactggctacttagtatccatagctccagctgttgcctgtcataatgctctgatgtatacattcgaggatgttacttacaagaatttgtgccttatagctcggtaatagtagatcgtaggtactgacgtgtgtgaatacaacattcactcatgttgtgtgttgtagtggctaactaagatgtcggatgattttatgtgacaaggaagaagtagacaagtggctgagaatccaatttggcttccactctgatcatgaacgaatcttcacgtactatcggacatttcttgccagataagtaacctacagagcgttttgaataacgcgcctttccgtcttggcgtttgacttatgggaacgcttcatttcggcacgacccttaaatcttggacacttatgttcgcgcgattgcctgtatactgcagatccacaacggagaaagttggtgccataggaacactcaagttatattgagcatgcgcacagtgatttgagcaacgggaagtgaaagaaggttcgctaacaccacattaccgtgcattcttcccctgggaattgatcgggatgaattggacccactcgtagaagacatgtgaacattcatgggaagcccctaggtggggtccggaaaagttctatggtttaaaataaggcgatgtcttgtccctaggacaatggttcaagcgtgtgagaggagtgaggttgccagcctccaataaattaatcctag

SEQ ID NO: 497802 - DNA, 599 bp, Homo sapiens
gtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaacgaaatcatttgccacaggtagaccgaagaaaaccaagaagcgttctcacccagtcatcattgatctagatgaggaagatcggcagcaggagtttcggagagcagttcgagaaggctttatgccgccctggccctgatgtagtaatctgtcgatgagggacaccgaatcaaaaactgccaggccagcacctcacaggctctgaacaatatccgatctcgccgacggatggtgctgactgggtaccctctgcacaacaactcattgagtactggtgcatggctg

SEQ ID NO: 497803 - DNA, 416 bp, Homo sapiens
aatgttgtcatggatacctctgcatttctaaatggtgaaaagcttctatgacacatgatggaaaaaaaaagccccatcgtgattttcccactgcacatctattagaatgactaaaagtaacaccaaacccaaacacccagacaatgcgaaatgctggcacagatgtggagcaactggaacccccatacgttactgatgggaatgcaaaatgatacagccactttggaaaagagtttggctgtttctatttttgtatttttagtagagatggagtgttgctctgtcgcccaggctggagtgtagtggacctatctcggctcactgtaaccttcacctccctggttcaaacaattctcctgcctcagcctcctgagtagctgggattacaggcgtgccaccatgaggctagtgggctg

SEQ ID NO: 497804 - DNA, 877 bp, Homo sapiens
gacgcgctcggaagcaacttccttggcctgtcaccgccagcgtaggtgctaccaccgctgccgtcgccgcccgccattttgatgggcagggaagagtccgggttcctggacagcgtgagacagtgtgtggtgactgaaataaattaccaaaggaaagctatttggcgaactatcttctccagcgaggatatggccaagtgtgccttgtgtaacagagccagagtgttttcctattctcccaggattgggctcttatagtaaaaggggtgtgtcattcccaaaagccttttcgattgcaggatcatcaggtcccggataagtctcatgtggtgttgaacctccagatatatggctctcgaaccagtgtgcctgatgaaacctatggaaccccttttgcacctcagatcagaggtcccagcttcctggaaccatagggttttgatttgtcacctcaatggactgcttcacagaagaaacacgctggtccataaaatttgtgcctgatgtctagcagaccttatcacgtgaaacgccctgcgtttgtgatgcccattatgtgatgacttccaggtacatgttgccgctgtgggacccaacgaaattcaacatgtgcagacactttacttgtgacagtgccacgagtacgagtgtgccatgcaacatgtcccagaatggtgggaacacggttctgacatcctgttccacgaagtagctaatggcatctattgttctggtgggaccaaaactagaatgttgctggtcggtgaccatcaatggagacgaggcttctaaatctacagggcgagaatgttacctcgaacggggatggcgctttgcccactgtggctgtgccaaaacacttgtgtgggccctatcg

SEQ ID NO: 497805 - DNA, 1671 bp, Homo sapiens
  misc_feature (512)..(512): n is a, c, g, or t
  misc_feature (987)..(987): n is a, c, g, or t
cacaaaaaaattagctgggcgtggtggcgcatgcctcattcacgtacatgggagagtctacaaagtcacacgtattcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctacagacatattttgctggacaatgattacttgcttttctttttgtttttcttgtatttgcctgtttgattggctcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacatnactgtgtttgtagggggaggtctgatttacagagtaaccacatagtaattataattattagaatgtccagttttcaaaaaacgttacaaggcatacaaagaatgggaaagtgtggctcattcaaaggaacaaaataaagtgacagaaaatatccctaaagaaacccagacatcaaacttaccagacaaagactttaaaacaactgtcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatntgtgggacatcatcaaatagaccaacattcatattctagaaggataaattatgttgttaaaaagtttaccattctttcttttcacctttcttccttcttccttccccctcctcctttttacttttcttcctcttcctttctcttcttctttctctccttcattatccctttcgctgtttctctttctccctttctcttttttcttttctttcaattttctcaattactaagagatgtttaagtacccttagcatgttagtagatacggttatttctccctttagttctcttttgagatttatagtcactcaaataaagagataacccaaacataagcgtcacaaacaggctttcataccattcttaatttggtcctgtaattcttcattgctgtattaattttctgatgcttttaaggatgttttataacaaattgtgtagctttttccaatggaatgtttattctgaattatctaattcatattgtaagtatagagggagtttaatataaaattattaaactaatatttgtgaaagaatgtatttgtgcatttaacaaatatgttaatcctcagactgttattgggcagctgagcatacaggaataaaaataacacaatttttatgtgtacaatatttatggaatacgttactggacccaataaataatttagttaataacaa

SEQ ID NO: 497806 - DNA, 877 bp, Homo sapiens
agcgtggagggggccgaggccccgcccccggtcctctgccccgcccgccgcgattatagccgatgactcagggcggagctccgcatccaaccccgggacgcggacatgttctctggactggaccagaagtttctagccgggccagttgctacctcccgtttagtctcctccttcccctctggcagcgaggaggctatttccagacacattcgcaccgcctctctgtgccacggtcaccccacgagctttaattcataagatggtgcccaggcgccggtttccctggacaacgtcggcggcggagacggggcccactggcgagtggcccggccagagacgtcggcgcccggagccagtgcctccggacaccgcgcccctagtcgggcagaaccctaagcacaggcagtgagcgtccgccattccatgtcgccccatgatgcgaggtggacgtccggcaagcggtgaccgtgaccctgttgtcacccccggatgggagatcaagatcgacccgcagaacggctgagcccttcttcgtggaccagaacaggcgaaccattacgtggaacggaccagagcgttgccctctgatggccccgaagggagactccatcctctgccaatggcccttcccgggagagctctaggctgccgcatgctacggaaggcaccctgtgtaccccctaggtctgaaccagtgctacattgccccattcctggtgcttcctatgacggcggctgaagaagccgcgcagtgtgcaacccttttcccatggttttatccccaagcctggggattgcatccgattccgaaaatgtccggcgggcaacagcgggtccctccgcaagtcccaatcaacccctgccgggggctttcaca

SEQ ID NO: 497807 - DNA, 666 bp, Homo sapiens
ttgaggacttacctttccacgaaatttgctcgcgaacacctaattcctgagggagtgcttaacttcctcgaggcccggaggagggagcccacacgcgtgaacccgggccaaagtatctttcacattcgagaatgaagtttttttgagggaatcacgcacctgccacgtggaagaatgggcgtcacactaactgctaccctcatattcacctgcgctgtggacactgaggacatccgcccgtgtgttcaacgactgccgtgacatacatatcagcgcatagcacctttgtcagtacgaggactgcttcttaagaaaggggaccccccaatatttaatataaagaccttaagcgacaattgaattaaaagtgagaacagtaattgtgacaagccagtgttatcacccaccatagggcatgattaaccaagcgaacctttcccttcccccgagtgattttgcagaaacaccccttttccccttcagcttgcttagatgttcccaaatttagaaagcttaaggcggcgctacaggaaaagggaaaaaggccaccaaagttccctttcactttcagttaaaattaattaaacagcagcagcaaacaaattaaatgaaattaaagaaaccaatgaaataaatattgtgttgtgcagcatttaaaaaaatcca

SEQ ID NO: 497808 - DNA, 109 bp, Homo sapiens
atctcctccttaagtctctcatctgcatctccaggtcagcgttggcctcctccaggacgcgcaccttctccaggtaggaagccaggcggtcgttgagatcaggcatgta

SEQ ID NO: 497809 - DNA, 1951 bp, Homo sapiens
  misc_feature (512)..(512): n is a, c, g, or t
  misc_feature (987)..(987): n is a, c, g, or t
cacaaaaaaattagctgggcgtggtggcgcatgcctcattcacgtacatgggagagtctacaaagtcacacgtattcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctacagacatattttgctggacaatgattacttgcttttctttttgtttttcttgtatttgcctgtttgattggctcctgacataccagaaaatcactgtcaaaacattagcttaacatttgttaaggaaacaaaaagacttcggtgaccacaccttataaaccaaacagttttgtaaatcactttggaaaatttcactaaaaaaaaaaatccttaacaatataataagtaaagaaaatttaaaaccacaaaacatnactgtgtttgtagggggaggtctgatttacagagtaaccacatagtaattataattattagaatgtccagttttcaaaaaacgttacaaggcatacaaagaatgggaaagtgtggctcattcaaaggaacaaaataaagtgacagaaaatatccctaaagaaacccagacatcaaacttaccagacaaagactttaaaacaactgtcttcattatactcaaatgtcaaaaggaaaacataaacaaagaaataaaggaatcagaaaaaatattaaaaagtaggaatatcagcaaagagataacaaattctggagtggaaaactacaatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatntgtgggacatcatcaaatagaccaacattcatattctagaaggataaattatgttgttaaaaagtttaccattctttcttttcacctttcttccttcttccttccccctcctcctttttacttttcttcctcttcctttctcttcttctttctctccttcattatccctttcgctgtttctctttctccctttctcttttttcttttctttcaattttctcaattactaagagatgtttaagtacccttagcatgttagtagatacggttatttctccctttagttctcttttgagatttatagtcactcaaataaagagataacccaaacataagcgtcacaaacaggctttcataccattcttaatttggtcctgtaattcttcattgctgtattaattttctgatgcttttaaggatgttttataacaaattgtgtagctttttccaatggaatgtttattctgaattatctaattcatattgtaagtatagagggagtttaatataaaattattaaactaatatttgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaagcaaaaaaaaaaagaaaaaaaaaaaaaaaaagaaggggggggccagctattaaaatcttatatccggggggaacacaaataacgacaaccacaacgacgtgtattgtagaaaaaggagtcgcaacaaaaaaatagataaaataaaaaaaagagagcggcgcgagtcccaacaaacaaccgaggcgaaatacaaacatgcagacggacattatagagaacacacccctacggtggtagcaataaggcaccaaccacacaagagataagccaggaaaatacacgcggcagtggtggcaacaccaacgtggcgggagaacgtccggatatacacag

SEQ ID NO: 497810 - DNA, 892 bp, Homo sapiens
  misc_feature (208)..(208): n is a, c, g, or t
accataaccaatactaccaatcaatactcatcattaataatcataatggcgagtgactatgataaaaatttaaaaatcaccagagggatttaagagtatatttgcacacacagaggaagccatgaacttgaagagaagaaaatggaaaatactgtctctgagaaacagaaagaataaaaaataaacaatgagcagagactaatgaatntgtgggacatcatcaaatagaccaacattcatattctagaaggataaattatgttgttaaaaagtttaccattctttcttttcacctttcttccttcttccttccccctcctcctttttacttttcttcctcttcctttctcttcttctttctctccttcattatccctttcgctgtttctctttctccctttctcttttttcttttctttcaattttctcaattactaagagatgtttaagtacccttagcatgttagtagatacggttatttctccctttagttctcttttgagatttatagtcactcaaataaagagataacccaaacataagcgtcacaaacaggctttcataccattcttaatttggtcctgtaattcttcattgctgtattaattttctgatgcttttaaggatgttttataacaaattgtgtagctttttccaatggaatgtttattctgaattatctaattcatattgtaagtatagagggagtttaatataaaattattaaactaatatttgtgaaagaatgtatttgtgcatttaacaaatatgttaatcctcagactgttattgggcagctgagcatacaggaataaaaataacacaatttttatgtgtacaatatttatggaatacgttactggacccaataaataatttagttaataacaa

SEQ ID NO: 497811 - DNA, 305 bp, Homo sapiens
tgatcagtgcattgtggggatacttgtggatagcggagaaattccaatcgaactcggagatagctggttcttcccgaaatagctttagggctagcgttatcttagtttaccggagttaaagcactgaatgggctaggggccgataaggttactgaaccctatcaaactctgaatgccggataaatgatggatagcagtcagacagtgtgagataagtttcattgtcaaaagggacacagcccagacccacagctaaggtcccaaatgtgcgctaagtggaaaacgatgtggagttgcgaaaacaa

SEQ ID NO: 497812 - DNA, 1189 bp, Homo sapiens
gtgattcggtcgtgctgttactccggtggctggttgcgtgtgagctgatcgtctagaggtgagtgacagtggggtgagaaaagggtctcgtggatcaccgcagcgcagtatccgctcagacgacgacctctgttcgtgctagtgcctctcgggaaaaatactgaggcgataagtcaaagggagtacacgtgacgtactacagaacctgagagaatcgcgtgtggatatagagacttgtgttgctataggaatcacatcgagaataaattaatgtgagcctaggtcgagagattgaaaatgttgctgagtgcatgtgagaataatccatgtgtacaatcgcttgtgttcaatgcactggtacgaaaggaagatagggtcagtaggataaccttgcaacgctagatctcggtgagggcatcgggtggtttgggtgaatgggcgcgaatgcggaagagtatgaggaattgatgcgcaatggaaacaagttatggtaggagtattggaaattctcggtcattcacttgttttttaaagattaatgttaactttggcattcgaagaacaacacttatattacacggattaacggagaattcgaaaggatacgtgacaaaacgacggttttgtgggcgcagttctggcgtgcggcaggacttccttagtggagcaatgcacgaagattaaagttcagccgcagtacagttatcttgcgtacaagcaggggggaccttaaccgagagaggagaccaacgatcaaaacctgatgtctgaaaaagagggtggacaaccaacgcaagtgtatcccaatagaaaggacgcttgatactcgcacaccgtaagtggcagaacaccctagttcgagtccattaccaacccaattgcagccaggggcagccacagcagttggcacaggaattccacagcacacagcggcaatacacgacacacgctaggaccaggtgtgacagcagccacaggaaaagaggtggagaccgccaggacacaaaacaagaccaacgaaagaaagaggggcaggttagacccagtggcgggagcctattggggaagtaggggagcatctacacgaaggcaaagaacgagcgcgaaaagaccgacaacgcaagggaaactccacgctatacgactcgggaagcgtcacagtcgcacgcgccgcagacacgaggagagc

SEQ ID NO: 497813 - DNA, 729 bp, Homo sapiens
atggtgtcaaccctagatagttacacgaacatctgaagattgaaagtagttaaaaaaaaaaaagggaaggaaataaatatcaccaaggaaaaaaggataaatggtagcttaaatataaaacaaaatcaccagtaaataaaactatacggatctaatacaaaccaaaaccagcctgaaagacccaacctaaaaaaatgctaaaaaatagggcttaaatcctagcttaatattggagttttattatccattctctcttaaccctctattatgtatacattacctgatctgcctctaaggggctaacaagaaaacgttacccggatcccgtatacaatttgacctcaaatgtcctgagcaaagtatcagaaaaactagcagaggatacttaggaggcaaagcttaagacatcataatatcaacaaatacagtattatggatcgtagcgccaaatctaaatccttccactggtccttctggaagaaattaaaccttttacagtgccttgctagcccagtataatgtctttaaaaaagaaaacccaggcaaaatctatggcttaaggaggtccttatttttaaacaaacagataactttgaaatttacaaccttgggagaaccgtcataagactcctatctaccgtgagaaaaatacaaactgtctgacactgttattctcccgatcataggcattgagacttttatcgaatattagtccaccagacgagctag

SEQ ID NO: 497814 - DNA, 179 bp, Homo sapiens
ggttgggcttttctcccgggggtggggcgggggcattgggggcccgggtttggggaatggggcatcaaaaacctgtaagggtaaaaaagggccctgggttgggtcaggttaaaatgggtccgtttccccagcccttggttttgtcatcatgggagtaacaaaataataatgtcccccca

SEQ ID NO: 497815 - DNA, 120 bp, Homo sapiens
gtacctcagtttgattcttgccagtcttctctatcttgaccagacacattgacccaaattctttctttcttttatttttattgagtcttgcactgttacccaagctggaggggccgcgcg

SEQ ID NO: 497816 - DNA, 102 bp, Homo sapiens
ggccggtcctacgccatggggtgaactatattgtttatatgttgtatagagagaacacacaaaagatacgaatataggaattactcactgccgtggttaaga

SEQ ID NO: 497817 - DNA, 746 bp, Homo sapiens
  misc_feature (360)..(360): n is a, c, g, or t
gagactcgagggaccggtagctagcgcctcaactcagtcttcagacttccctgctgtgttgcagcccagccgctccatcatgtccttcagtcgctgaccacgattgctgaattcaatggaggcatttctcctgtttgacagaacaggtgagttccaagatcaccttaagccagcgtcggtgactgtccttcgacgcgtctgggcacaaatctccaccaattgcagaggtcaggaaagttcgtgggaaaccccagcaagtgaagagctgaatgccaaggaaaatcgagtttgaagcaatttctgcctatgatgcaggccatttccaacagagcaaggaccaggtccagcctatgaagactntatgagggtctgcgtgtctttgacaaggaaggcaatggcagcagtcatgggtgctgaactccgccatgttgctagccaccctgtggtgcaaagatgaaatgaggagacgaagtggaagccctgatggcaggtcatcgaagactccacatggctgcatcaactacgaagctttggtccaggcaacgtcagtgtctatctgaactggagctctcaagatgcaagcattgtttacggaacgactggctggaaacttattttaatgcacacccatgaatgaactctccagatctgtttaccatcagttcaggaaaacaaagcaatctggaggtcaagactgagcaggtcccgaatttatgccgtctccaggttccctgaatgattcctac

SEQ ID NO: 497818 - DNA, 200 bp, Homo sapiens
catcaatcctctaccatacatcctgtagaattcactataaatcgcgctgatagcaattctatcttgagagctagagccagttcgtaatacatacagttcatgactgtaattaactctgagaagaaacataatcctaggatgttgtgaggtcaaagtgggctgatcacttgatcccaggagtttgagatcagcctgagcaa

SEQ ID NO: 497819 - DNA, 864 bp, Homo sapiens
  misc_feature (864)..(864): n is a, c, g, or t
gcggctgcagcggggtgagcggcggcgagcggtcggggatcctggagccatggggcgcgcgcgcgacgccatcctggatgcgctggagaacctgaccgccgaggagctcaatgaagttcaagctgaagctgctgtcggtgccgttgcgcgagggctacgggcgcgtcccgcggggcgcgctgctgtccatggacgccttggacctcatccgacgaagtcgtggtcgagcttctacctggagaccgtatggtgcctgagcttctaccgctaacgtgctgctgcgacatggtgcctgtgaggagatgggcgggacaagactgcatggcgtgtcaacgcaccgagggctctggagaccgcagccagcttgggatccagggccccgtcctcagtctggcagcgcaagccaggcctgcacgttatatacgatccatgcacctgggctgcagcttatcgcgagggtcgacaaacgttgagtggctgctggatgctctgtacgggaaggtcctgacggatgagcagtaccaggcagtgcgggccgagcccaccaaaccaagcgaggatgcggaagctcttcagtttcacactcaggctggaactggacctgcaagggacttgctccttctagggcctaagggagtcccagttgctacctggtggaggacctggagcggagactgaggtctccttacccagtcaagcactccggtcagcccctggtcaatcgcaccgaatgatcttgaatctgatcttgtgatagcagaatataggaataagccagcttggaaagtaatcgggagagggaagatagaacaaggttactctggtgagggttgaaggaagaatgacaaaattggggggaagtgn

SEQ ID NO: 497820 - DNA, 519 bp, Homo sapiens
tcggtggagtgaggcagtgacggccggtgagattggaagtggctggcgtgcgtgcatgtgcgtgcacgagtgggagtccgagtgttatgcgtctcaatgatccctgcggaaactgctacgtgggtctaatgaacacgtgatcagtgggtgtctaccgtgggtctctcaagagacacagggtcctgtcccctgttcaacttgcttggcagtatgcatgcgatgctgacatctgccccctcttgtcgactgctgctagctggtcgatacgtgagctgcttggccagggaaacatagctccctggggcagttgtagtctggacgagtgtagagaagcctcatcatggtccatgtggattaacatgtttcggacagacagagtcagcccagaactctggacatgcaacgactcccacacctgaacgcgcgaacgagtacatcaggcacagagaatcgagtaggtgcacagctacctcatgtcccggcaggcgcagacataccacctatgggaaatgaagatca

SEQ ID NO: 497821 - DNA, 171 bp, Homo sapiens
cacgaggcctgccgtgaaggctgtgtctgcgatgctggcttcctgctcagtggcgacacctgtgtacctgtgggccagtgtggctgcctccacgatgtccgcttccacccactgggccataccttctaccctggccctgggtgtgactccctttgccgttgccggaaggtg

SEQ ID NO: 497822 - DNA, 273 bp, Homo sapiens
  misc_feature (15)..(15): n is a, c, g, or t
  misc_feature (74)..(74): n is a, c, g, or t
cagctgtgttgagcnagagagtataaccgccgggaaaggtcgtattggactggaaattgtattgatttcttggnattgcttaacccaatcttaagtctcttcccaccccatgccactgtcctccctacactagttcctcctcatgcatgggccagggggccctgctacattctaggcaactgggcttggagatgtgagattctaaggtcactgagctgctgaaagggggagctgaactcagcacttaagaacttctttaccccctctctcgct

SEQ ID NO: 497823 - DNA, 84 bp, Homo sapiens
attttggttttcttacaaaggtttgacattttccataacaggttgtaagagtgttgaaaaaaaaattcaaatttacttggggga

SEQ ID NO: 497824 - DNA, 1232 bp, Homo sapiens
  misc_feature (1035)..(1035): n is a, c, g, or t
cccacgcgtccggctcgcactgatttattacctgagtagggctagaaataacatactagtctttcattccagtgtctaaccaaaagacaataaagccctcggtatccacagaagtcgtgccatcaaggtatttcctcacgcgagcaaccgcactccagtatatccgtgtctaagtaggctagtccctcgttcagacacagtatactcctccgagacacatgagaccattagagccaactacctacgcaatcagatactcactcgattaattacatcactaattcggctatatgcaattacacaactgaggaactatgcgcgccgctgttcgacgttctaggagtcccaggacggtgatacccgaagggcacacccatacctgtacgaatccggtctctgtcctattctatcttacgacgaatggacgagaaaatactgacgcgccgcgcagtcttcgaggatcatgatgacacgaagagtgctcgtctcctcaacgtgaaagcgttgaagcccattctccgtcagcgtctcatcaagtcatttatcgcagtcagtaggccagtgcaggtctggaggctggaattaaaaccgaaaaaccgcagcgtacgccaagaagtccttaggcaatacctccgttcaaaggttagccccaacattaaggggaaatggaagtaacagtaaaggcaaagggtatgcgtaacgccggtttaaccgagaacccccgttgaaacgagttaaacaccagattgtcgtataagatcttgtaaaagcctacttcttgactacttgtagttccctaagacttaactaacccggcagtttccctaacgtaactccaaaccggttacaaacattcccaaggcagccaatcgaacccctaactacataatctcggcacctggaaaccaaaggctaaacatggacctggaacacccctttaagttccattccaaccttccttctaccgcttagggaaggggcatgtgtccccccggggtataaccggggtatattgggcccacaatgggggccctntattcggcacagaaaattctcacaaaataaaacacaattagggcgtacaatacatgcaccccaaccatcaattagtgcacaacaattaagccatctccttaataaccgtccatatacttctaacactcataagcgctcttatatcatacattccctcacccttcttaaatgatcaacaaagaatctacacccactat

SEQ ID NO: 497825 - DNA, 553 bp, Homo sapiens
  misc_feature (74)..(74): n is a, c, g, or t
  misc_feature (90)..(90): n is a, c, g, or t
ttactgtgggtgtagccactgcataaggctgcttactgtgtgaacagtgccaacagggaactctggaactggantggaaggtaactgttncactgcactttggggtctttcaaacacaagtggcttatttttcatctaacaagtatttttcctggggtatctgccaaagcaggtgctgtctggccactagatgtttctggagcaaggaaggctgggaaagattagaaagtcttgggactctagggagacaaagctccacactctgaaagcacacagggcctacccattggtagaaccactggcataaattgtactcatttttttccccttcaaataggatctcacagtaaaaccctgagtggcttgagacttgatataagatatactcatctcaaactcagagaccctcctgcctctgcctcccaggtgctaaaattataggcaagtgctaccacacctggcctcatttctaaagcttaagttctttaacaagcctaaaggtatttcacaatcttctcctttgttttttgagataaaatactaattagccctg

SEQ ID NO: 497826 - DNA, 168 bp, Homo sapiens
ctcgtgccgacaaatcactcattttgctgctgttggatatgtagccaagggtatatagatctttgaagtagaattgctggatcttatgggtaattctatttctaacttattccttcaagacagactctgaggcccaggcatggagttcaagggcacaatctcagctca

SEQ ID NO: 497827 - DNA, 538 bp, Homo sapiens
  misc_feature (103)..(103): n is a, c, g, or t
  misc_feature (407)..(407): n is a, c, g, or t
  misc_feature (516)..(516): n is a, c, g, or t
atgactttctgggagtccagagtatatgccatactctttctgatagtctgacttatcagaaagagtccagattttgggattcagtgagttgtgtttcaaatcncaggtcttccattcatgagtatgccatcttgaataagtaaattttccaaaacctcagtttctgtgtctgtaaaacgggggtaatcataagaccacaacagaactattgaagtaaacattgaatgaattggcagttggcattatcaattttacatggataaaattgggtcatattaactgggtcaagaggctggagatgagataaattggtgaaaatctcctttcatttatatgggaagaagagttagaggactgatggaacatcttggccagaaagatggcttggaactttgaggcagcagcanatgactggctcttcaccatctctcctgccttttgctatgacagtgtggagaaagataaatggcagaggcacttcctgtgaggcaacaagttccaggataaaccttaccncctcaggcttctgaaaaaaaaa

SEQ ID NO: 497828 - DNA, 341 bp, Homo sapiens
agggagggacagagaaggtgcctgcgaggccggggaggcggggagccttacatggtcctttgcagaagagtccggagacagcacagcttttaggacttcgtcctaggggcacagaaaaagctctcggttaacataggtggacacctgttggtcaccagatgaccctggtgagacagcttacaatggggagcgtgtgtaaagagcagcctgtgacagctttgccttgggggactagtgcaacctagtgcttgaaaaatgggaggacagcgttggattgtgagcttgctggcccatgtccttgtgaccgccacggcatgcctgcccttccccatgtagcaggc

SEQ ID NO: 497829 - DNA, 319 bp, Homo sapiens
  misc_feature (9)..(9): n is a, c, g, or t
  misc_feature (26)..(26): n is a, c, g, or t
  misc_feature (79)..(79): n is a, c, g, or t
  misc_feature (120)..(120): n is a, c, g, or t
  misc_feature (129)..(130): n is a, c, g, or t
  misc_feature (168)..(168): n is a, c, g, or t
  misc_feature (221)..(221): n is a, c, g, or t
  misc_feature (230)..(230): n is a, c, g, or t
  misc_feature (242)..(242): n is a, c, g, or t
  misc_feature (248)..(251): n is a, c, g, or t
  misc_feature (254)..(255): n is a, c, g, or t
  misc_feature (261)..(261): n is a, c, g, or t
  misc_feature (270)..(270): n is a, c, g, or t
  misc_feature (314)..(314): n is a, c, g, or t
cgagtacantacaccgatccattccngcatctcttacacaaagtagaaccagtaacaacacaccatcacccggcgctanatgtcaccgacactggtatctgctacgttctttaatgtacnccatcacanncaccgactaattaacggtctatatacaccctatgctgnccgcctcatcgaacgctcactctatatcgcacccggaagcgtggttggccccncccctaccncccgctcgtcgnacgacnnnnagnnatcgtnccataggancgaaacttacaagccaagcgactaaagcctgtgttctgtccccnaaccc

SEQ ID NO: 497830 - DNA, 308 bp, Homo sapiens
tgaggacagaaaagaggtatgagagggtgaaccgagaaggactagatcttaatagctctgtagcagaggaggcagcggtggtgagataaaagaacagggactggacgaggagtcagaaggcccaagtccaagccctaaccttaccttagtataccagctatgtgatctagagcaaaaatcccttcactgtctgtggatttgcatatcctggtcggtacgatagatcatttcaatgagatcaggtctgggattccttcacatgccgaaatccgattctgtcctcatgtacgtgccggggtaccgagctc

SEQ ID NO: 497831 - DNA, 278 bp, Homo sapiens
tttgaggctgcagtgagctatttttgtgccattgcactccagcttggccaacagagcaagacctggtctcaaaaataaacaattgaaattaaaaaagcggccaggctttgtggctcatgcctgtaatcccagcactctggaaggccgaggcaggccgatcacgaggtcaggagttcaagaccagcctggccaacatggtgaaaccccaatctcaattaaaaatacaaaaaataagccgtgcctggccggacgcgatggatcacgcctgtaaattccag

SEQ ID NO: 497832 - DNA, 276 bp, Homo sapiens
  misc_feature (9)..(9): n is a, c, g, or t
  misc_feature (47)..(47): n is a, c, g, or t
  misc_feature (63)..(63): n is a, c, g, or t
  misc_feature (86)..(86): n is a, c, g, or t
  misc_feature (104)..(104): n is a, c, g, or t
  misc_feature (115)..(115): n is a, c, g, or t
  misc_feature (266)..(267): n is a, c, g, or t
tgctcctantctccgtaactgtagtgttgccttttcgagaatagcanataaataatcatgtantatgtaacattctgagacaggcntcttgcacccagcataangcctttgagantcatccagatcgttgtgtgtatcagtagtttgtttttattactgggttatagttcattgtatggatataccacagtttctttagccattcacccactgaaagtcatttgggttgtttctaggctttggtgattatgaataaagctgctatnnacatccaaa

SEQ ID NO: 497833 - DNA, 1082 bp, Homo sapiens
  misc_feature (37)..(37): n is a, c, g, or t
  misc_feature (158)..(158): n is a, c, g, or t
  misc_feature (216)..(216): n is a, c, g, or t
  misc_feature (243)..(243): n is a, c, g, or t
  misc_feature (251)..(251): n is a, c, g, or t
  misc_feature (272)..(272): n is a, c, g, or t
  misc_feature (299)..(299): n is a, c, g, or t
  misc_feature (387)..(387): n is a, c, g, or t
  misc_feature (448)..(448): n is a, c, g, or t
  misc_feature (479)..(480): n is a, c, g, or t
  misc_feature (564)..(564): n is a, c, g, or t
  misc_feature (594)..(594): n is a, c, g, or t
  misc_feature (610)..(610): n is a, c, g, or t
  misc_feature (668)..(668): n is a, c, g, or t
  misc_feature (681)..(681): n is a, c, g, or t
  misc_feature (739)..(739): n is a, c, g, or t
  misc_feature (801)..(801): n is a, c, g, or t
  misc_feature (826)..(826): n is a, c, g, or t
  misc_feature (833)..(833): n is a, c, g, or t
  misc_feature (867)..(867): n is a, c, g, or t
  misc_feature (888)..(888): n is a, c, g, or t
  misc_feature (892)..(892): n is a, c, g, or t
  misc_feature (908)..(908): n is a, c, g, or t
  misc_feature (911)..(911): n is a, c, g, or t
  misc_feature (927)..(927): n is a, c, g, or t
  misc_feature (941)..(941): n is a, c, g, or t
  misc_feature (946)..(947): n is a, c, g, or t
  misc_feature (949)..(949): n is a, c, g, or t
  misc_feature (955)..(955): n is a, c, g, or t
  misc_feature (964)..(964): n is a, c, g, or t
  misc_feature (975)..(975): n is a, c, g, or t
  misc_feature (981)..(981): n is a, c, g, or t
  misc_feature (988)..(989): n is a, c, g, or t
  misc_feature (999)..(999): n is a, c, g, or t
  misc_feature (1001)..(1001): n is a, c, g, or t
  misc_feature (1004)..(1004): n is a, c, g, or t
  misc_feature (1075)..(1075): n is a, c, g, or t
acctatggagaggtcaatctcaggccaagtacatganaggagggagcactggctcaccctgtcctagtcctgagggcccccaggtttatgctgacactcactcattgggcatgacctgggggtgacgccaccacaacgtcctttctgtgaaagaggcnccatgattcgaggacccattcctgctgggaaaaagctcagccaccactcataaagagngttgtcctgtctggaggctcacttttncctcaccnttttcatgaaggaaacctccnctccacctccggatgccgtagtctcgnagcttctttctcgtcttctcgtgcagctcctctctctctgcagaggtcaccacccgtacgctcctccacacgctacgaccacgctgantgttcttaatgccccccctcacgctcctcctctcacctgcacgctatctctggatcccctncttcaggtccaggactgtggcactctgcacnncaaccacgggcattacttctccatccatcttgcacactcggaccgtcattgcctggccgtattctagggctatttgggagtggncttcttccagagtaacctggatcggcagancgcagagcagcgggtnctgcaccaccatagccagaccctcctggaacacgtccatggcctcggagtgcggcacncctctacttcgtnctcatcttcctcttgcgcctcgggcccacccgcggcctccgtctcctccagggccgcncctctcagccgggctctgccgcactgccagcccgcactagggaggccaagcgcgcacgcagngaactggggcccgccccagcgaggncgcccanccactggcgcgccgggggggatggggcggctgcngtcaccaatgacaagtgcganacancctgcagcagggccgngancgcagaatcgccctgnctattggttggttngtgtnncnggaagntgccaggancaatgtgagcncgaggngggcggnnatcggccctnancgncagttggagctgcgggagtgggagctgcggactcgagacatgcggtgtgctgcccggctgcggaacggctnatcgtga

SEQ ID NO: 497834 - DNA, 420 bp, Homo sapiens
  misc_feature (10)..(10): n is a, c, g, or t
  misc_feature (30)..(30): n is a, c, g, or t
  misc_feature (44)..(44): n is a, c, g, or t
  misc_feature (406)..(406): n is a, c, g, or t
aaccccaaanatcctagaaaatccacatgnaaatggaatttatnctgtgacctttttcaaaatagccttcattatttttataaaagggatgtatgcctcaatgaatgaaaagaaagtcagttaataaaagtataaacaagctgggcatagtggctcacacctctaatcccagcactttgggaagccaaggcaggcagatcacctgaggtcacgagttcgagaccagcctggccaacatgacaaaactccgtttctacaaaaatacaaaaattagccaggcatgatggcacatgcctgtggtcctacctgctctggaggctgaggcaagagaatcgcctgaacccaggaggcagagtttgtagtgaggtgatgtaacgccactgcgctccagccttggcaatagagncgagacaacgtctc

SEQ ID NO: 497835 - DNA, 473 bp, Homo sapiens
  misc_feature (101)..(101): n is a, c, g, or t
  misc_feature (204)..(204): n is a, c, g, or t
  misc_feature (206)..(206): n is a, c, g, or t
  misc_feature (341)..(341): n is a, c, g, or t
  misc_feature (343)..(343): n is a, c, g, or t
  misc_feature (345)..(345): n is a, c, g, or t
  misc_feature (370)..(370): n is a, c, g, or t
  misc_feature (411)..(411): n is a, c, g, or t
  misc_feature (430)..(430): n is a, c, g, or t
ccacgctctgactccaggtgcggatggaggagacgcgtcaggcctcccgagcgtagatggaaggagcagatatgacataaatcccttgagggtctacattnttcagggcgattccaatctacggacgagcttcggaccatccccggaaccctcctgcgtccttaggttgttgagtgcatccgggagtgcgtggactgacggctncngggtcccagccagcaagcgagacccagcatcctgggagtggccacggcggcgcacgtggaccagcaagagcgcagcgccgccacgccgcggccacgagcagtcccagaccggaggcaaaaggtagcgctgagggntncngccttgagcccgcgggccgcgggcnaaggcgttgcgccgtcggggtgcactgggaactcacaccgngctcccatgtagccgggtncaagcgcagacgaggccggagaagtgggcgtagcagcggtcgc

SEQ ID NO: 497836 - DNA, 236 bp, Homo sapiens
  misc_feature (226)..(226): n is a, c, g, or t
ggtcatgtttgacagcttctctgcttttctgacggatggcttcctgttgttcacaattttcttactgtaaggctttcagaggtggtgaggctttagattgctgtttatagacaagttttcaaggtctattttcccctcattctaggctgggggtgtcatagaaagtttaccaatttactagagagtgacactttgagtacactagaccacttagtgctcttcactntctttgtcca

SEQ ID NO: 497837 - DNA, 273 bp, Homo sapiens
gtcggaatgaaaagatatgcagtggagagaggtgtatacttcaaagaaatggcagaagtgatgatgcgatctcagcatagaaggtggtcgtttcccctaacaaaaatgggttggagttgccacaccagccaagaaagcatggtatcactccaggcaaaaaggcagcagcaacacctgccaagaagacagttacaccagccaaagcagttaccacacctggcaagaagggagccacaccaggcaaagcattggtagcaactcctggtaagaagg

SEQ ID NO: 497838 - DNA, 169 bp, Homo sapiens
tatctaaacatgaatctgaatgagcctgaaccaaaacatattctccgaagagattaaataaaagtgttcttctatcacttatgtgtctattttagaaccttccaaattctaaagttttcaaaaatactggcatgttctttaaaagtatggccagttccttaattcctgg

SEQ ID NO: 497839 - DNA, 309 bp, Homo sapiens
  misc_feature (38)..(40): n is a, c, g, or t
  misc_feature (156)..(156): n is a, c, g, or t
ggtggggtgggggtctgtggtggtggggaggagggtcnnncccttaggagaagcagaacactcttacacggggaggcagagatggcacagcaagaggcatgcccccagaatgccaccaatgggcagggggggcccacccatggaaccattttatcnggataacctgggaggatggggtggaatctgaggggtgagccttcttccccaggctggaagtgggcgacacgagactggcacctctacatctgattgtcccccaaacccatcatttatgtgggggggggagaaagaaatcatgttacttcttcc

SEQ ID NO: 497840 - DNA, 372 bp, Homo sapiens
aaaaaaaaaaaaaaaaaaaaaaaaaaaaaaaaaaaaaaaaaacgtgtgtgggcgggcgcgcgcgcgcgggccccgcgagaaaaagcttttaaaacacaacctgcgggggggcggcgcgggggccccaaagagaggagaaagagagagaaaagggggaaaagaggggtttctcttgagggaaaccggggggcaaagaaaaaggagggggggttttctcaccaataaaaaaagcgcgggggggacaacagagggaggtgttttgagaaacaaaccccagagagggggttcgtgggggtctctatgggggggttttttaaaggggggccccaagggggccccgagaaaaaaaattaacccccggtgggggggggt

SEQ ID NO: 497841 - DNA, 465 bp, Homo sapiens
  misc_feature (420)..(420): n is a, c, g, or t
tatagagaaaataattaatagagaaacaatgaatgatactcttcaactcagcctcctgcagggaggacagacagctcttgcccaagaaagcataagtggaatcataaaaagtaataaaggttcttttggacctgtaaaaaaaaaaaaaaaaaaaaaaaaaaaaaaaaaaaaaaaaaaaaaactcgtcggcggcactactatgttgcgggtgggggcaaacaagagggtatcatagaacgctgctgcacgttgtgctccatctcggggttcttctcctctaacccccatcttctttgtggacaccaaggggtgtaaataatctgcgcggcggcccccaataaaggagggggcggcgatataaaatagtagtaaacacacggtgtacccctgctttaatataatcgatagcgagaaaaaaangcgcaatcacacccgcccacggcaggagaaatgtagaccacgact

SEQ ID NO: 497842 - DNA, 364 bp, Homo sapiens
ggcacggattgagagtgacacggtattttcaagatggataaacatatgaatcttaaattaccatattcttttattttttattttttgtgagacagaggttttcctcttgctgcccaggctggagtgcaacagcatcatctccactcactgcaacctccgcctcccaagttcaagcaattctcctgcctcagcctcctgaatagctgggactacaggcgtgtgccaccatgcccagctaatttttgtatattttttagtcgagatggggtttcaccatgttggccaggatggtcttgatcccctgacctcatgatccgcccacctcggcctcccaaagtgctgggattacaggcgtgagccacca

SEQ ID NO: 497843 - DNA, 238 bp, Homo sapiens
tgggacagggtggaactgggtttcctgggctttgtggctggaggtgtctctattgcggtccctggcttcccactagagctgcgggctaatggctgctgcgcctgaggtggatggctggggcacgtgaagcgaggttccctagctaagctgctgcgctttcccccatggtgatccagcagaggctggcatgaccaatcaacaacatcagcctgatgaaaaggcggctccaaggaagtac

SEQ ID NO: 497844 - DNA, 283 bp, Homo sapiens
cagcccccccgggggtccttcttttttgttcccccaggttatggggaggggggggtccaggtcacctttccaagggggttgtttttgtggccccccccctcctccccccccaggggggttttggttgttttagccccatgggggccccccccccttgtccctcctcagccaccaagggcccagggcaagggacagggggacaggggttttcctttcccccaaaaccccacccccgggtttcccccctggggccggggtttttaaaaaaaaattttttttgtta

SEQ ID NO: 497845 - DNA, 376 bp, Homo sapiens
tcgctgcatgtctgtaaacatcagaaattaaagaagcatatccatcaaatatgtacatcgcatgacatattacgcattatacacttgacaaccaaaccacataaaaagaggacacgaaccccatcctacatgataggaatcaggtgttcaccggtcccgtatctggcgactgtacactggatcaaagggcagccgaggcaacaggcaattacttcagaggacactgaccagtatgatctggaagcactgtatgatgtaacccaatgtcatgtaccacactccttactccaaggtggtctcatattactagaatggccggtccagctgttacacaatgcagacagacaacataacatttactctgtgtcgatcgtgg

SEQ ID NO: 497846 - DNA, 241 bp, Homo sapiens
acgagggtaggttccaccacagagcaccccgtgtgggtggaaacagtggcatcatagacctaactactctttgaagactggggagtaaattcttcggtctatagtgactatagcagaggtcactgtggtcaagactctcatcaagtgaatgcagacaaaattagtctatcccgtgtgagttacaggataaataatccgcgagggtgtgtgtgtgtgtgtagtgtgtgtgtagtgtgtgtgt

SEQ ID NO: 497847 - DNA, 221 bp, Homo sapiens
acactttcgtccgtgatcaccatccggagaggtcaactgtcatacatcatctttactatctgtaggcgccacaccctgtagatgtcttccacatcggcagggaccatatatgcccaaagcgtattcatattcactcctggcaggctggccttatccttttcgtaagacttgatgtgattataccaacgtagggcatgacacaagtcgtcttgcgggggctg

SEQ ID NO: 497848 - DNA, 1279 bp, Homo sapiens
tctcagtcgcacagagtgcttggctcttattccacaaagggggggagggggcgcttttgtctcctcttatcacttccctggtcccactctttctcgcttctggtgatattgtatcgcaaccaccgccgtgttccctgtttgtgtaacaagtggtccccttcttagagcccgcaaattgtgtggtgtctgccccgcctcgccgttgtttggcaccgcgcacgggttgttatataaaaaggggaatacgaggggtatctcatcagataggtttctcttcttggcgcctcatatctatggacggacgtgtggagtatgaccacccctctggggggtttgtataatatctcttgggggccgaagccacataaccttgtggggcacacttcccgcctgctggggtgccccacgacttatgtttctgcgcagcctctgtctgtagatgattaatgggttcacgtgtactctgctctttccccagtgtatgaccctcacgcggcgctctttttccaccgactctctcgttgattagaagggtttctcttttggtaactcctgtgttttttttggcggggaccatttcgggggaagcttcatgggccttcttaaaccacatcctccctctccccgcttatggttaggccctgttaatccccagccccccccggttgttgtcagtcgttgtcacccaggggcgcattttgcccacttttaaggcgcgccccccctgggggcgtcgggtcccagacaccactgggcgtgctgtcgcactttatctcgtgagatagggggcgcttatatagcgacatgtggtggcttcgcccccctctccccccgccgcgttgtttaacatgagaacctgtgcaataaatagtacctttgtagtccctcggccaggactgttgagtactcgagcccctatgctcgtgcccctgcccagccctccagaattgtctcggagccttttgtggagaagaaacatttgtgtggcggcgctaggagccaccaccactggcgactcacctggtttttcgtgtccccgtggcgcccgcggttttgggcacgtcaagcggctgccaggcgcccaccctgaatttccacctttgggctcagccaacgacgggtaatttatatgggcgcccttgccggcgactgtggcccaccatgccgcgtcatcattcctcgtttttttattttttttgtaactcccccttgtccctatccctgtggtttcccccccccttcccatgtgtttgaaaaaaaaaaggtggggaaaccccca

SEQ ID NO: 497849 - DNA, 198 bp, Homo sapiens
gggcagcgtgctatgatgctagctactcaggaggctggggcaggaggatcagttgaacctgggaggtcaaggttacagtgagccatgattgtgccactatactccagcctgggcaacagagtgagaccctgtctgaaaaaaaaaaaattaaccggtgtacggcccgatgcaaataaaaacttagattaccgattcctg

SEQ ID NO: 497850 - DNA, 546 bp, Homo sapiens
  misc_feature (111)..(111): n is a, c, g, or t
  misc_feature (114)..(114): n is a, c, g, or t
  misc_feature (116)..(116): n is a, c, g, or t
  misc_feature (118)..(118): n is a, c, g, or t
  misc_feature (124)..(124): n is a, c, g, or t
  misc_feature (127)..(127): n is a, c, g, or t
  misc_feature (377)..(377): n is a, c, g, or t
  misc_feature (471)..(471): n is a, c, g, or t
  misc_feature (474)..(474): n is a, c, g, or t
aatttcactttccttctcaggtctcacctcagccccccccttctccctgatttctcggcctctctctctgtgtgaaggggcctctccctaatgtctcctccttcccccctnttntntntcctgnggnccagcctccctctccctcctccattcctctctccctgcccttttcctgcctgaagagcagaggtgaggacctgggaccccttaggggcaggccaggaggagctcgggcgcaggccaggcccccttggtgaaacagaggctgaaggaaaggggtttgggtcttgtccctaggaattctcctccctcaggaaattgggggttgggggaggcaacgggtgatggcttttaaactgaagctgaacccagggctntgaagctgaacccagggcctggctgtggtttttttggtcttgctgccccctgtgacccaaaggcatgggatggacaaaaatgcctgcccccgtnaanctggttggggagggcagttccccagcatccataaagtaataaagtccctgtgtgtagacccggaaaaaaaaa

SEQ ID NO: 497851 - DNA, 234 bp, Homo sapiens
ttagtattatcctataaacttaccataaggatcccaaatgctcgccaagaatcagataacatacacacaaaaatatattcctgcagcactgttaagtagtaagaacaaaagagaaaccaactcaagaatccatcaagagaggaccagttaaacttgtggtacaatccacagacctagagattctactgcacgctactcaaaaagcaatgagatatctgtacatgctgactatga

SEQ ID NO: 497852 - DNA, 520 bp, Homo sapiens
  misc_feature (111)..(111): n is a, c, g, or t
  misc_feature (114)..(114): n is a, c, g, or t
  misc_feature (116)..(116): n is a, c, g, or t
  misc_feature (118)..(118): n is a, c, g, or t
  misc_feature (124)..(124): n is a, c, g, or t
  misc_feature (127)..(127): n is a, c, g, or t
  misc_feature (445)..(445): n is a, c, g, or t
  misc_feature (448)..(448): n is a, c, g, or t
aatttcactttccttctcaggtctcacctcagccccccccttctccctgatttctcggcctctctctctgtgtgaaggggcctctccctaatgtctcctccttcccccctnttntntntcctgnggnccagcctccctctccctcctccattcctctctccctgcccttttcctgcctgaagagcagaggtgaggacctgggaccccttaggggcaggccaggaggagctcgggcgcaggccaggcccccttggtgaaacagaggctgaaggaaaggggtttgggtcttgtccctaggaattctcctccctcaggaaattgggggttgggggaggcaacgggtgatggcttttaaactgaacccagggcctggctgtggtttttttggtcttgctgccccctgtgacccaaaggcatgggatggacaaaaatgcctgcccccgtnaanctggttggggagggcagttccccagcatccataaagtaataaagtccctgtgtgtagacccggaaaaaaaaa

SEQ ID NO: 497853 - DNA, 1343 bp, Homo sapiens
  misc_feature (252)..(252): n is a, c, g, or t
  misc_feature (718)..(718): n is a, c, g, or t
gcctcgctcgtccgtggctcctcgtaggagtgccattgcttcaaaatgatgcttatcatctccttcaccgagccgactgtgtaggaccacagagactcagatacggagagtggaactggattgaagatcgcaacattatcgccatctttctatatataccaatgctgttatggcacactatcatcgcttgcatagcttgacatctgctgggttagcaagacatcgtggatcaggggttcatgtgcgtccatnacatccaagtgtatcggcgaatgttacaataacaacgggctactcccccctagtgagtattggcatgaggttgttcctatggaacccatctaggttaccgttgagagtcactgcgcctgacataccgtagagcgtaaacgcgtgggcagtttcccgtcgtctaacgacaacccgaggggaaagacctcgtggggcgcattcctgagactcgacggagcagagatccatgatggcgccgtgtttgtagtgcatacggtaggggaaatggtcgagaaaatccttgtgagtttcgttcgctcttccacacgcattagcgatggtaattgacgctttgagaacaccacacaaagggctagccagggacacggaggtactgacaattagctcgtcgtaggacgcctagagaagcatggggactcaatctttgatcacgagtgagccctgcttcgaaaagcgtttccctgtntgggttggccctcccgagaacagttagttccgttaggcgaggaacatagctccggagcacacgcccagtttttaatacgataacgctctgttgcctttccttggatatacgccaaggcgcacttgtgagatgtcgtctcaggtccccaggcacgtaattgactttggggttccatgcacaaaggtggcctgcgttgttacattatttcaacacgtgaaacgcgttgagaggatatgaaatcgccatgagcagaggacccgatattagtgcaacccaccaggaggaaggtttacctgggagcggaattgcttgtgatttcaagcagtcccgaaacagtttcgttccaacgttggcggagagtgtattctaagaatgggggccagaggtccggtaatttctgcaatcctttgaaaaagaaactgtcggaaggtaggttaggccaaaagggaacacagagagtgacgagttgaaagcaaagggtctttgcgaggaaactcaattgccttaacaaacttttgttgtgggggccctagagaggaaaattgtaacgcggaaggggcctaacaaatcggacgaaaaggggtgtcgcaggggaatgcgacgtattgtgggacggagattgatg

SEQ ID NO: 497854 - DNA, 736 bp, Homo sapiens
gcagtctcacaatcttctttcatttttttctgtctctgtcccttttaggcccacgtggaagtgtttctgatggtagaacattctcaaaaatctgtgggtcttctacgtatgtcacatgattcacacattcagaaaagagggtcctcacagatttttcctgaacaacccatctctattctggcttctgtgaaacagtcaaataaatccacaaggttaatgccgtaacctcttcagcactagccaaaggttgtcaagacacaccctgggcttatctacagagcacacttttctaacagtgaatctcctaattttagcatctcttttttttagtttaacaatcattcagatggggaattcaggctcaagaattatacccagtcatcagatacggattcctttggtccacttatatagttcatgtactctttaaaacaaacattttttgtgaaggtatcagagatgaggtctcactctgtcacccaggctgacagagtagtggtgcacacaatagctcacttgtaaccatcaaactccacaggacctcaagggataactccggcatcagccattccaagtagctgggtctacaggtgcaatgaacaacaagccgggcataattaaaaggcataaactagaagagactagactatgcaaagacgtccaggaatgatctccaactcatagacacaagcaatcacaaccataaggcactcactaaagtgcggataccggtgca

SEQ ID NO: 497855 - DNA, 5215 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccccctcaagcagtactcccagcttcacttcttcgatcaccaccaccgactcgatcgtcaccaccgagaccacatcccacagtactcccagcttcacttcttcaatcagcaccactgagaccacatcccacagtactcccagcttcacttcttcgatcaccatcactgagaccacctcacacagtactcccagctacactacctcaatcaccaccaccgagaccccctcaagcagtactcccagcttcacttcttcgatcaccaccaccgagaccacatcccacagtactcccagcttcacttcttcaatcagcaccactgagaccacatcccacagtactcccagcttcacttcttcgatcaccaccactgagaccacctcacacggtactcccagcttcacttcttcaatcaccaccactgagaccccctcacacagtactcccagcttcacttctttgatcaccaccaccgagaccacctcacacagtactcccagcttcacttcttcgatcaccaccaccgagaccacctcacacagtactcccagcttcacttctttgatcaccaccactgagaccccgtcacacagtactcccagcttcacttcttcgatcaccaccaccgagaccacctcacacagtactaccagcttcacttcttcgatcaccaccaccgagaccacctcacacagtactcccagcttcagttcttcaatcaccaccactgagacccccttacacagtactcctggcctaccttcgtgggtcaccaccaccaagaccacctcacacattactcctggcctcacttcttcaatcaccaccactgagactacctcacacagtactcccggcttcacttcttcaatcaccaccactggaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattccccgtttctcttgctctcattccttgtatcttctccccttctgagcctgtccattcatcggtggttctgcccctactcccccagccctaaataccccagctgctgttcctccccatcaccccgctactggattctccatttttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 497856 - DNA, 4842 bp, Homo sapiens
  misc_feature (423)..(423): n is a, c, g, or t
  misc_feature (460)..(460): n is a, c, g, or t
  misc_feature (462)..(462): n is a, c, g, or t
  misc_feature (466)..(466): n is a, c, g, or t
  misc_feature (468)..(468): n is a, c, g, or t
  misc_feature (473)..(474): n is a, c, g, or t
  misc_feature (477)..(478): n is a, c, g, or t
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaggaccactgagaccacctctcatagtactcccagcttcacttcttcgatcatcgccaccgaaaccacctcacacagtactcccagctncacttctttgatccactgccaccgagaccgcctcacncngtantnccacnncannctcgatcgtcaccaccgagaccacatcccacagtactcccagcttcacttcttcaatcagcaccactgagaccacatcccacagtactcccagcttcacttcttcgatcaccatcactgagaccacctcacacagtactcccagccagcttcacttcttcgatcaccaccaccgagaccacctcacacagtactcccagcttcagttcttcaatcaccaccactgagacccccttacacagtactcctggcctaccttcgtgggtcaccaccaccaagaccacctcacacattactcctggcctcacttcttcaatcaccaccactgagactacctcacacagtactcccggcttcacttcttcaatcaccaccactggaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattccccgtttctcttgctctcattccttgtatcttctccccttctgagcctgtccattcatcggtggttctgcccctactcccccagccctaaataccccagctgctgttcctccccatcaccccgctactggattctccatttttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 497857 - DNA, 5101 bp, Homo sapiens
  misc_feature (409)..(409): n is a, c, g, or t
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaggatcaccaccaccgagaccacctcacacagtactcccagcttcacttctttgatcaccacctctgagaccccntcacacagtactcccagcttcacttcttcgatcaccaccaccgagaccccctcaagcagtactcccagcttcacttcttcgatcaccaccaccgagaccacatcccacagtactcccagcttcacttcttcaatcagcaccactgagaccacatcccacagtactcccagcttcacttcttcgatcaccaccactgagaccacctcacacggtactcccagcttcacttcttcaatcaccaccactgagaccccctcacacagtactcccagcttcacttctttgatcaccaccaccgagaccacctcacacagtactcccagcttcacttcttcgatcaccaccaccgagaccacctcacacagtactcccagcttcacttctttgatcaccaccactgagaccccgtcacacagtactcccagcttcacttcttcgatcaccaccaccgagaccacctcacacagtactaccagcttcacttcttcgatcaccaccaccgagaccacctcacacagtactcccagcttcagttcttcaatcaccaccactgagacccccttacacagtactcctggcctaccttcgtgggtcaccaccaccaagaccacctcacacattactcctggcctcacttcttcaatcaccaccactgagactacctcacacagtactcccggcttcacttcttcaatcaccaccactggaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattccccgtttctcttgctctcattccttgtatcttctccccttctgagcctgtccattcatcggtggttctgcccctactcccccagccctaaataccccagctgctgttcctccccatcaccccgctactggattctccatttttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 497858 - DNA, 4871 bp, Homo sapiens
  misc_feature (423)..(423): n is a, c, g, or t
  misc_feature (460)..(460): n is a, c, g, or t
  misc_feature (462)..(462): n is a, c, g, or t
  misc_feature (466)..(466): n is a, c, g, or t
  misc_feature (468)..(468): n is a, c, g, or t
  misc_feature (473)..(474): n is a, c, g, or t
  misc_feature (477)..(478): n is a, c, g, or t
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaggaccactgagaccacctctcatagtactcccagcttcacttcttcgatcatcgccaccgaaaccacctcacacagtactcccagctncacttctttgatccactgccaccgagaccgcctcacncngtantnccacnncanngaccacctcacacagtactcccagcttcacttcttcgatcaccaccaccgagaccacctcacacagtactcccagcttcacttctttgatcaccaccactgagaccccgtcacacagtactcccagcttcacttcttcgatcaccaccaccgagaccacctcacacagtactaccagcttcacttcttcgatcaccaccaccgagaccacctcacacagtactcccagcttcagttcttcaatcaccaccactgagacccccttacacagtactcctggcctaccttcgtgggtcaccaccaccaagaccacctcacacattactcctggcctcacttcttcaatcaccaccactgagactacctcacacagtactcccggcttcacttcttcaatcaccaccactggaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattccccgtttctcttgctctcattccttgtatcttctccccttctgagcctgtccattcatcggtggttctgcccctactcccccagccctaaataccccagctgctgttcctccccatcaccccgctactggattctccatttttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 497859 - DNA, 841 bp, Homo sapiens
  misc_feature (384)..(384): n is a, c, g, or t
gcctgcagctccccacccagctctgagttcatggatgttaattgagagccctgggtcctgccacagaaaaaaaaaaaaaaaaaccccctgggttttttctcggttggggtcaaccgcggttttgctttggcgcgttggtcgttgccctggttccctgtgactcgagcgttctatggttcgcaggggtgcggtggtacttctgtgcgtgccgtcctctatgaggtgcagtcttgccgtggaattgcagctgggtcgcgggtcttcacccctgtctttgatggggacgtcgcgcagacctgtgtttgccctttccagccagtgacccctccctttctagttcttatatttagtggtcggtgccctttcccttcttcctcagcccangaggttgttctggcgatgggtggtggatgggggtttcaccgtgaacacagaggtgttttttcttattgagggcctgttataacgtcctgatgtaccggctctcacgctacgttgaccaaacccaactcagatgatgaggacgatggggatgagaaagaagatgacgaggaggataaagatgacggtcccttgggccctcaacgtggggggcagcctccgagaccctgtagccaagaagacaggctggggcccagctctgagagtccacgaacaagtgtgcccggttcctcctgggacaattgcctttggcaccatctcggttggccccaagtgcgaacaacgccaggcaggttgtccaccctgcaaacgtgacctccatgggccagcgacgcacaccccctgaaaaagtcatgccagcgaattgtatcgtgggaccacataaaacgtacattacgga

SEQ ID NO: 497860 - DNA, 5155 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttctccaccaccgagaccacctcacacagtactcccagcttcacttcttcaatcaccaccactgagaccacctcacatggagacaacctcacggagttctcccagcttcacttctttgatcaccatcactgggtccacatcccacagtactcccagcttcacttcttcgatcaccatcactgagaccacctcacacagtactcccagctacactacctcaatcaccaccaccgagaccccctcaagcagtactcccagcttcacttcttcgatcaccaccaccgagaccacatcccacagtactcccagcttcacttcttcaatcagcaccactgagaccacatcccacagtactcccagcttcacttcttcgatcaccaccactgagaccacctcacacggtactcccagcttcacttcttcaatcaccaccactgagaccccctcacacagtactcccagcttcacttctttgatcaccaccaccgagaccacctcacacagtactcccagcttcacttcttcgatcaccaccaccgagaccacctcacacagtactcccagcttcacttctttgatcaccaccactgagaccccgtcacacagtactcccagcttcacttcttcgatcaccaccaccgagaccacctcacacagtactaccagcttcacttcttcgatcaccaccaccgagaccacctcacacagtactcccagcttcagttcttcaatcaccaccactgagacccccttacacagtactcctggcctaccttcgtgggtcaccaccaccaagaccacctcacacattactcctggcctcacttcttcaatcaccaccactgagactacctcacacagtactcccggcttcacttcttcaatcaccaccactggaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattccccgtttctcttgctctcattccttgtatcttctccccttctgagcctgtccattcatcggtggttctgcccctactcccccagccctaaataccccagctgctgttcctccccatcaccccgctactggattctccatttttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 497861 - DNA, 293 bp, Homo sapiens
gtcagataatcgagctggtaccctcccaaagtgctgggattacagggggtgagcactgtgcccagcagaacctccgaatggatctgtcactttgtccttagtctccttcagtctgtattcagcagagatggagtttcaccatatgggtcaggctggtctcgaactcccgacctcaggcgacctccctgcctgggcctcccaaagtgcggggactacaggcgtgagccactgtgcctggcctctagaagggtggtaacacagatagttggaacaaaaaggtatttccatcctcc

SEQ ID NO: 497862 - DNA, 4433 bp, Homo sapiens
  misc_feature (4271)..(4271): n is a, c, g, or t
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcaatcaccaccactgagaccacctcacacagtactcccagcttcacttcttcgatcaccaccaccgagaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattccccgtttctcttgctctcattccttgtatcttctccccttctgagcctgtccattcatcggtggttctgcccctactcccccagccctaaataccccagctgctgttcctccccatcaccccgctactggattctccatttttattctccacccctttctctcacccctggagccctgcgggtgggggcagggcatgagttccccagtccccaaggaaaggcagccccctcagtctcctttttgttttttttcttccattttctttttttttgtcttttaaacccatttttttttanttctttttttttgggcaggggcctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 497863 - DNA, 278 bp, Homo sapiens
gcaaaaaacagggttaattgggcttacagttccccctgggtggggaagccccacaattttggcaaaaggggaaagggcccaaaccccttttttttggggggccaccggcaaaaagcttgggccgggcaactccctgcccttagggtttttaaaaccatcaaatcttgtgagaatcattcccttttataaaaacagccccggaaagacccccccccattatttatgctccacccatgacccgggggaattgggggaattccaaattaaggggaatttgg

SEQ ID NO: 497864 - DNA, 211 bp, Homo sapiens
aaatttaggaaaacccctttttgtttttaaagtgatttgtgatttgggcgggataaaccggataaaaggttttgtttttaaagggggattttcattcctttgggggcaggggtcgcccaaacatttcccttgtaaaagaacccagtggaagatcctgtcctgattttcaaaaatttttttttttgtatgattaaaagttttttccctttta

SEQ ID NO: 497865 - DNA, 3981 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcaatcaccaccactgagaccacctcacacagtactcccagcttcacttcttcgatcaccaccaccgagaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccatctcctgccctctcctgatctaactccctgctgcatctcttgctctcattccttagacgtcctccccttttgaccccgttccttcatcc

SEQ ID NO: 497866 - DNA, 212 bp, Homo sapiens
tatctaagcgggctgggagtcatgcccacagatgggttttatttaacccggtatatcatggatttactcttaccaaccctgagcatctggcataacgattaggagtagaaagaatgcaacatccagaaatatttgtaccctggaaagcacgtttgctttgccatgttttgatggcactgcaaagctgttctttgtggggaaaactttgcatc

SEQ ID NO: 497867 - DNA, 4177 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcaatcaccaccactgagaccacctcacacagtactcccagcttcacttcttcgatcaccaccaccgagaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattctttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 497868 - DNA, 4119 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcaatcaccaccactgagaccacctcacacagtactcccagcttcacttcttcgatcaccaccaccgagaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattctttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 497869 - DNA, 219 bp, Homo sapiens
tagtgtctcaaacatacaggtccaagggtaggcaatgaatttaccaaaaccagcaagttcattacagctggctttcttccacccgtcatccccagtgtgagctcttttttttttttggagatggagtttcactctcattgcccagaactgggagtgcagtgggcgcccttctcgcgctcacgtgtaacctcccactctctccgattcgaggcaatttct

SEQ ID NO: 497870 - DNA, 290 bp, Homo sapiens
caaagggaaaaaaccccaaaattcccccaaatggtctgtggggttctccaggtaatttaatttggctcccccaaaccggtaggaattacctaatcaggtggtctttggataaaaaggtttgacataggggcttacttttgaattggaacccacctccaggatgtccaaccctaatctggggttgtgatttaactgcttcacaaagccaccatctaccacatatctaagaagaatcaaagcaagttaagtttctggaaaataaaagaagacttgttaattgttaaaaaaaa

SEQ ID NO: 497871 - DNA, 3559 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcaatcaccaccactgagaccacctcacacagtactcccagcttcacttcttcgatcaccaccaccgagaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacaagcctacgaactctcaccccttcgtctgtgggttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgcacatcaagagacccgagatgacctcgtcctcagtgtgagccctgcggggccccttcaccaccccctccgccctgccccggacacaagggtctgcattgcgtccatttcaagaggtggccccaggacgcgggcagcccaggctcctgctgttcttgggcaagatgagactgttcccccaaatcccatccttctccttccaacttggctgaaacccacctggagacgcagttcacgtccaggctcttccactgtggaatcttgggcaagtcagtaacgagcctcagtttcctcacctgcaaaacgggtacagcattcctgtatgatagctcacgccgttgttgtgaaaaccacatagacttggtcaattctcggtcctactctgccctcccgtctcagccctcgtgttgccattgcctctctcggatcctccaatcctcacgtccttcacctggtctctggccctggttcttattttctctcaattccctactgcctgtttcttactttgaacctggaggcagcctgcagccccatcccatctcctgccctctcctgatctaactccctgctgcatctcttgctctcattccttagacgtcctccccttttgaccccgttccttcatccatcctgcaccccagtcccccagccctaaatcctccctcctctcctcacatcctggtccctagcaaggtatagatagcctctgtgtcttaggataccccgggtgctgttccctcggtcaccctgttgcccagttccccgtttctcttgctctcattccttgtatcctttccccttttgagcccgtccattcatcggttctgcccccgactcccccagccctaaataccccagctgctgttccccccatcaccctgctgcccaattctttattctccacccctttctctcacccctggagccctgcgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttggggacaggaagtcggcacatctccaggtctccatgtgcacaatatagagtttattgtaaaaagc

SEQ ID NO: 497872 - DNA, 420 bp, Homo sapiens
  misc_feature (35)..(35): n is a, c, g, or t
  misc_feature (40)..(41): n is a, c, g, or t
  misc_feature (44)..(44): n is a, c, g, or t
  misc_feature (46)..(46): n is a, c, g, or t
  misc_feature (49)..(50): n is a, c, g, or t
  misc_feature (52)..(54): n is a, c, g, or t
  misc_feature (57)..(57): n is a, c, g, or t
  misc_feature (63)..(63): n is a, c, g, or t
  misc_feature (72)..(73): n is a, c, g, or t
  misc_feature (79)..(79): n is a, c, g, or t
  misc_feature (84)..(84): n is a, c, g, or t
  misc_feature (93)..(93): n is a, c, g, or t
  misc_feature (121)..(121): n is a, c, g, or t
  misc_feature (123)..(123): n is a, c, g, or t
  misc_feature (129)..(129): n is a, c, g, or t
  misc_feature (132)..(133): n is a, c, g, or t
  misc_feature (142)..(142): n is a, c, g, or t
  misc_feature (184)..(184): n is a, c, g, or t
  misc_feature (215)..(215): n is a, c, g, or t
gataccatggctgctgaaatcacaaagcggatggngcctnnagnanccnntnnnggngagcgnccaatctcnngatcgnagcancccttaaanccggctggctggtggctgttgctaggangngcacantgnngtgggacangagggggcaccttctccagatgatgtcctggagggggcaggnggtacctccctctccctctcctggggcattngagtctgtggctttggggtgtcctgggctccccatctccttctggcccatctgaactgctgacctgagccccggttctgtcagggtcccataaaggaggacactcagggactgtggacagagcagggcggaggcctgcatgtgctgttgcctctaggtgactttccaagatgccccccatacacacctttctttggaacgagggc

SEQ ID NO: 497873 - DNA, 1666 bp, Homo sapiens
gggatgatcccaataggagaacacatccactcttctcatctatagctgcggtcgatagatcatcgtcagtgatgccatccaggtaggggttgctcgagcacggtggctagcgtcttctatgcgtgatcctggacgtgtacttgaggctaccgcagtgccctcaggactgagatcgtctctcgatccgaccattgagaatcgacagtccgagccacgatagatctacggacaacgatcacaatatcgtgtgtgctctgacgtgcagccaaggctatgctatgtcgcgagatggtgggacggtcatacgagttgcgtatttgatttcgttgccatcgtgaacgttgagcaaggattacggggcgacgacgcgcttgtaattgactgtaatcggtgaactacggtgtcacatacgtaatctacatgcatacttgcttgtacacatcggtcggtgacttggttgacttcgcttccccaactggccttcgtctggaaattggaattaggcccacgagggaagcttgttcgatcagggcgcttatgggattggctaccctccgaggtaggagtcgcaacagatttagtacgactcttccttgaagtgggcgctcgatcaggaagaacatctcacccgaaaatcgtatactagtacacgcgacccgagttccgacgagagatacgaattctcgaggggggcaaatgaagaccattaagatttccaatatataagacattccctttgatggaggaaggagacttaggttcaatcgttgaggagattcgtgtgccctcggctccgtatcacccaggcggattcaacggctttaccccttcaattcaaactctaaataaacatcatgcaaccctttgctacattcaaacttgggcaagggttgctcctaaacgctatggcaattatgcgccattcggtccccgtacatgtcatgtgccactgacacagcagggggaattataacaccagatgcgcactgagggacattggacgagtgccgagaaagcagagttgagatagtggagaccttgccaaaaaccttataactgagaaggagatctacaaaggaacgggcacctcagggatccacaggtcgtctggcggaaggcgccggtcgcgtaagacggaagcagtaaaccaagtaagtaccggggagcaagaaggacacaaagggtgggagccacagcaacaaagacaaagcggattaagggcaaggggcaagaaagaagaccgcgtgcccccggagtggagacacggaaagacagggagacagcactaggcgcggcaggaaatcgtgcgacaccgggccctgtgacaaacatgggaacgagcggcgcggtgccccgaatgaagagccagccggcagccgaaggagaaagacccagcgacgcacaaagaggcacatcaagcaacgaagtcaaattggtgcgacaaaaggggcaacagtaatacagcacagcgggaagcccagtaaaccagaagaaggagacacagagcaccgactacccgggagggacgggggaatatacagaccacccagcgcactctgagagaaacagggcgtgagaaaacaaacaacttgtgggggggaggtgcggcagcaacacagagagagacgacagcactgcagcgacgccagtgactacagagacagaa

SEQ ID NO: 497874 - DNA, 503 bp, Homo sapiens
  misc_feature (21)..(21): n is a, c, g, or t
gcaggtgttatctgtgtgtanagtcctctattattttggggaggcataatgatggaaagttccagattttatatttctaaagaaatatttcaccgaaattagtaggctacaatagaaatgctgatttttcaattctaccatgtacagccagtaaaaacaataacacaccactatctcctgtcaccatcatttcatttaacaaaaggatatttccattcaaacaatttgaaagaacagaatctctcagaataaaatatttttaaatggaatcatttagctatatggaaaagtttactttcagaccagcctggccaacatgctgaaacctcatctctaccaaaaatacaaaaattagccaggcacggtggtggatgcctgtggtgccagctattcgggaggctgaggagggaaaattgcttgagactgggaggtggaggttgcaatgagtgcagattgcaccactgcactctaacattattgacagagtgagaccccgtctcaaa

SEQ ID NO: 497875 - DNA, 290 bp, Homo sapiens
  misc_feature (16)..(16): n is a, c, g, or t
  misc_feature (37)..(37): n is a, c, g, or t
  misc_feature (124)..(124): n is a, c, g, or t
  misc_feature (135)..(135): n is a, c, g, or t
  misc_feature (238)..(238): n is a, c, g, or t
taggctgaagcgcagnggaatggtctcagctcactgnaacctctgcctcctgggttcaactgatccgcccgcctcagcctccctagtacctgggactatagatgagcaccaccatgtccagggntaattttgggnttttaatagagatggggtttcaccatgttggccagactggtcttgaattcttgattcacctgtgtcagcttcccaaagtgctgagattacaggcatgagtcanctgcctgggcagggtcttggctcttttatccaacttggcactcttgtgactt

SEQ ID NO: 497876 - DNA, 656 bp, Homo sapiens
  misc_feature (184)..(184): n is a, c, g, or t
gttgttactataagggagactgcattgcttattgatccaaaaatttcctgttcttcatcccgccagtgggttgctctggttgtgggacatgaacttgcccatcaatggtttggaaatcttgttactatggaatggtggactcatctttggttaaatgaaggttttgcatcctggattgaatatntgtgtgtagaccactgcttcccagagtatgatatttggactcagtttgtttctgctgattacacccgtgcccaggagcttgacgccttagataacagccatcctattgaatattacaggctatctgcttcctgtcataaccctgaatcacactgtctgccaggtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccgcaggtaatctttaatagcttgagatagaaatggagagaaagtattgtcactctatccaggctgggacattttatttttgttctgaatacttaactcaaggtcaggatccatgtaataaataaattagccttatttgaaaaaaaaaaa

SEQ ID NO: 497877 - DNA, 417 bp, Homo sapiens
ccgagaccacctctatggcacagactacccagaggagagtgtatcggtgagtcttccctggggatatatcggtacatggctgtgcaacacataacagtggtcacacttactcagtagaaatgcatccacaacccgaagactctcctgagggcctgcacgtgaatacacgcgtatagttactaaatctcattggcaagggaccatagatagcgatgcgtcagggcctggagaaagaacctggagtgatgcacgtacggatgtggacacatattcaaggaagcagactggaccaagacgaatgagtgatcactacaggagcatcggtcacgctcacggaacgcagaaggcgctgagcagtatcagggtacacttgcgcaactggtacagcgatttattgctcacggacgtatatcgtgt

SEQ ID NO: 497878 - DNA, 517 bp, Homo sapiens
agctctaagggatgacaggaatcatgttctattcaactttattattattagttactacatttttttgaggaccatcgttatacattatgagtgagttaaaggcagaaaaatgtaagttagaagggttttcctagaaagcgttttatgtaattcagtattacaggctatctgcttcctgtcataaccctgaatcacactgtctgccaggtcagtgtgggccatccatctgaggttgatgagatatttgatgctatatcatatagcaaaggtgcatctgtcatccgaatgctgcatgactacattggggataaggactttaagaaaggaatgaacatgtatttaaccaagttccaacaaaagaatgctgccgcaggtaatctttaatagcttgagatagaaatggagagaaagtattgtcactctatccaggctgggacattttatttttgttctgaatacttaactcaaggtcaggatccatgtaataaataaattagccttatttgaaaaaaaaaaa

SEQ ID NO: 497879 - DNA, 407 bp, Homo sapiens
gacgttgtattttgcccctcccttgttatgacctcagacattaaaatgtcagtctctatcaagacatcgtaccaaagtcgatacaccattactgtagatgggcaaacagttgtgctagttctggcaaggtgcagtggctcacgcctgtaatcctagcactatggaaggctgaggtgggcagatcgcttgagcccaggagttcaggaccagcctgggcaacatggtgaaacgcatctctacaaaaattacaaaaattagccaggcgtggtggcaagtgcttatagtcctagctactcaggaggctgaggtgggagtatcacctgagcctgggaggttgaggctgcggtgagccatgattgtgccactgcaccccagcctgggtgacagagtgagactgtctcaaaaaa

SEQ ID NO: 497880 - DNA, 865 bp, Homo sapiens
ctaaaaggcaaaatgggaaaggaaaagaactcatatcaacagttgtcgtcgatggacacgctagattcgggcaagtccaccgactactggccatctgatctataatatgcggcggcatcgacaaaagaaccattgaaaaattcgagaaggaggctgctgaggatgggaagagggctccttcaagtatgcctgggtcttggtataaagctgagatagctgatgcgtgatacgtggcttactcgaccagtgtgatagtctcctttgtggcaaagtttgaaattcagtcaagtactatgtgactatcattgagtgccccaggacacagaggacgttctagttcaaaacacacggatggattacagggacgatctcagggctgactgtgctgtgctgatggttgctgctggctgttggttgaatttgaagctggtatctccaagaatgggcagacccgagagcatgcccttctggtcttgacacactgggtgttgaatagatagtaattgtcggtgttcaacagaagatggattcctactgtaggccacccttacagtccagacagcagatatgcaggaagatggttaagggagagtcaggcgcttacatttaagtaaagattgggtactagcccgacacagaagcatttgtgccgaatttctggtgggaatggtgacaagtgctggagccaagtgctatcatgaccagggttccaacgggagtggaacagtcaccccgtatgggatggcgaaaagcgagtggaacccaccgctgatgtgagggctctggactggatgctagcaccaactcgtccagctgaacgaggcccttgacgctggctctccaggatggtacaacgtgggggaag

SEQ ID NO: 497881 - DNA, 923 bp, Homo sapiens
  misc_feature (156)..(156): n is a, c, g, or t
ttttttttttaatttaaaaatcttaagttttttttagtaagcttaagatgtccagtagtttattggcagacagcatttttaaaaagtgaatagatgtttaactgaagttaaatacaaatttatgtctgtgtaccctctgggtaagatataacaaanactagaacatctaaacttttccttgggacaattctctctacttcttcaacaagtctggtcgggcaggtacaaacatggtggtgactttaccttcgggttaatagttctatagtcacagaagaaagtccagcgaagtttactggatctcagcttgcactccagaataggggatttagttccacttgggttattttcacttctaccctaaattcatagtccctgatacttaagctttaccctgtggcttaccagttttcatggcagcgagtaactggcggagtagcagagccttgggttactgtacaattggacaaaaagtatgtccttttctagcaggagcagataaatgataatggtcttagaactgtcgcaccctgctttttcgggaacggatgacctgcttagatggtgacaatgatggtccttttcccacccaagttgtgcgcctaccttttattaacagggcgaacaacccaagggcgatggtgcccgaataaagggagaactacgcgggcagaaatccgtgggaagggacgcttaagggacatggccgcggaattcgggggagaatattgggctcggcccgttggaagtgcctctccacacagaatttagccggctttcaaacaacacccgctttgtgagttcccccggagagacgggatcgtacacacgtggcgcgccggaacaagaggtagtctcccgactgtttggccgaccaaaggagaaaacaccacaccatcctcgtttcttcgttccatgaaaga

SEQ ID NO: 497882 - DNA, 233 bp, Homo sapiens
attcgcggccgcgtcgaccccaggtcatactaatggaagaggtgggtgtgagacatggggacaaaggggatcatttcggaattttaaggttaatgactgccctattggattttggacttgaatggggccggtagcccctttgttttggccaatttctcccatttggaatggttccaaagtttgtatccccatgtcgacgcggccgcgaatttatttatagaagtctaacccgg

SEQ ID NO: 497883 - DNA, 896 bp, Homo sapiens
gggaggcgctcggcacgaggccgtgctccgccgggaagatggggaaagtgagggggttgcgcgcccgagtgcaccaggctgccgtgaggccgaaaggggaggccgcccccggccccggccccctgccccggaggcgaccctccgccggcctcggccgggggaaggactgggcgttcatcaacaccaacatctttgccaggaccaagatagaccccagcgccttggtgcagaagctggagctggacgtgaggagtgtcacttccgtcaggagaggtgaggcaggctcgagtgcacggagcgtcccttccatcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcagggagagcaacaagccccggccctcagagctcagccggatgagcgcagcccagagacagcagcttctcgaggaagaaaggacccggtttcaggagctgctggccagtccggcctacagagccagccccctggtggccatcgggcagacgctggcccggcagatgcagctggaagatggcggcagctctgaccagggcagcgggcatgccacaaatcctcaggacacatgtgggccaagtagagagcgccggcccctcaaggaccatggcctgagcctggtggacgcccttccctctggtcggttgtggggctcaataaatggctctgtgaacttcccctgcactgccagggccgttccc

SEQ ID NO: 497884 - DNA, 1037 bp, Homo sapiens
gggtcagatggacgcggttgtggtggtcgcggaccggagcttgcgcggggggtccggtcccagtatagctttcatccgcatgccggtctagctcgcgagttccttcatgtgtgatccggggtttgcatcttggtagacgaggtaccataatcatacgtcggaacctaggtaacgtcactgtgtgagcggggaaccgtgcatgctgctcggtacgatcccagtatcgagggacggagtggtgatgtgcctggagacactggcgtgggagtccgtacggtcctccttgtgcctcggttatacccgagatacagtcgtcttcgcgagttattagcgacgatcaaacagacaggataactcatggatgttgctgctcctctgtgacgatctagcgcctggattgtccgagggtattagaccgccaaagttccatggcgtcctatgaatggatgaatgtcggatgcatggaaccgttcgtggggaagcaatggaccactcaggtctactagctctccttatgaagctaaattcgacctcttgatggagctggccccagcgggcacaaaggttccagcgccggccggcatctgcaacgatgaaacacactcttgattcgaaactagggcactgcgtgcgatcatgtacggccatattgattggatgggatgaagaagcttttcgctgcaagtttaccgtggggagcatgccttggagtggtagtcgctactgtaacggccaccgtttacgagtgggcccacttgtgtcaataggctagtcgtaaccttgggactcctggactacctggactggcccatgaaagtgttctgcgcagggaaacgccagagctggtggctcaaaggccaggaacccgtagggtacaccccgagttttgggttgggaaacggctggcattggcctagttggctgttcgctagaccggagtattgcctcggtatcgaaaaggaaggcgggtctttccaaaaacgtacgcttagggggagcggaacaaacaggtggtttgaaccttaagaaatgaacca

SEQ ID NO: 497885 - DNA, 851 bp, Homo sapiens
gggaggcgctcggcacgaggccgtgctccgccgggaagatggggaaagtgagggggttgcgcgcccgagtgcaccaggctgccgtgaggccgaaaggggaggccgcccccggccccggccccctgccccggaggcgaccctccgccggcctcggccgggggaaggactgggcgttcatcaacaccaacatctttgccaggaccaagatagaccccagcgccttggtgcagaagctggagctggacgtgaggagtgtcacttccgtcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcagggagagcaacaagccccggccctcagagctcagccggatgagcgcagcccagagacagcagcttctcgaggaagaaaggacccggtttcaggagctgctggccagtccggcctacagagccagccccctggtggccatcgggcagacgctggcccggcagatgcagctggaagatggcggcagctctgaccagggcagcgggcatgccacaaatcctcaggacacatgtgggccaagtagagagcgccggcccctcaaggaccatggcctgagcctggtggacgcccttccctctggtcggttgtggggctcaataaatggctctgtgaacttcccctgcactgccagggccgttccc

SEQ ID NO: 497886 - DNA, 782 bp, Homo sapiens
gggaggcgctcggcacgaggccgtgctccgccgggaagatggggaaagtgagggggttgcgcgcccgagtgcaccaggctgccgtgaggccgaaaggggaggccgcccccggccccggccccctgccccggaggcgaccctccgccggcctcggccgggggaaggactgggcgttcatcaacaccaacatctttgccaggaccaagatagaccccagcgccttggtgcagaagctggagctggacgtgaggagtgtcacttccgtcaggagaggtgcagaggccaagaccgttttgcccaagaaggagaaaatgaagctgaggcgtgagcaatggttgcagaaaatcgaagccataaaactggctgagcagaagcacagggaggagcggaggcggagggccacggtggtggtgggggacctgcaccctctcagggatgccctgcccgagctgctggggctcgaggctggcagccggcgccaagcccgcagcgaggaagaaaggacccggtttcaggagctgctggccagtccggcctacagagccagccccctggtggccatcgggcagacgctggcccggcagatgcagctggaagatggcggcagctctgaccagggcagcgggcatgccacaaatcctcaggacacatgtgggccaagtagagagcgccggcccctcaaggaccatggcctgagcctggtggacgcccttccctctggtcggttgtggggctcaataaatggctctgtgaacttcccctgcactgccagggccgttccc

SEQ ID NO: 497887 - DNA, 303 bp, Homo sapiens
  misc_feature (25)..(25): n is a, c, g, or t
  misc_feature (68)..(68): n is a, c, g, or t
  misc_feature (75)..(75): n is a, c, g, or t
  misc_feature (81)..(81): n is a, c, g, or t
  misc_feature (97)..(97): n is a, c, g, or t
  misc_feature (172)..(172): n is a, c, g, or t
  misc_feature (215)..(215): n is a, c, g, or t
agatcattgtctttgatgttcaggntgggtcatttaaaatagagatgcaatcaggaaggttggggganttgggantgtggntgaattgagaccttgntgatgtattcatgtcagcacttgagtcacagcccaggtgcccggaagcagcctttttgcataggcagtgatttgngattactttaaagctcaccttttttcttcccctctctgtttgntgctgtcagcataatgattgtgttccttccctatgggatccatttgttttgtaaacaataaagcgtttgagggagtgtaaaaaaaaaa

SEQ ID NO: 497888 - DNA, 310 bp, Homo sapiens
attgaaacccagttttcatttagttgctaaggcttttaatacattttgaagggcccccaaacaaaataagtcaaaatggccagtccttttttttggaggaaaaatttgaacaagggtctccaatgtgttgtgttttgtcatgacccttcatttttttcccttgtaattagagcctgctacgggtttatggaactgaaagctccccaggggggcaataaaccgagaaatcatgaaaaatgtttaatcccatgggaaaacctgtatgccgtttttccccaacccctctcccaaaataaaaatttccaatgta

SEQ ID NO: 497889 - DNA, 102 bp, Homo sapiens
gcttacggagaagaaggaagttgtggaagagtgagaaaatggaagagacgcccctgtaacgggaatgctaatgaggaaaactggggagcaggagtgtgacaa

SEQ ID NO: 497890 - DNA, 780 bp, Homo sapiens
gagtggttgcggcgggtttcggttactgaggtggcagactctgtctggccggcccttggcactcgccaggattgggggcttcactcactcgtggctttccgaaggctgctgctcctgtacgacacagtggagaccatgggaaaagactatagtcatcagaccttctagattctatgacacgggcgtcacacgaagtatattgagattctacattgcatgactgggattccagtagcaattttcataactctggtgaatgtattcataggtcaagctgaatctagacagaacttccagcaggctatgtaccagaacacctgggaactattataagcatcccatatcacgctggattgcaccgtaattttctatgatagtcctgaacgatatatgacagagcatatggacgtcctacagattgaagctgcaaaggctgaacttacgggtaccggagcgaccgtgcgaaaattgatgcatgtgcagaggagatcggacccaggagcacataccatgaggaccaacttgacaagctaaccccgatagagaccaagcatccgaaacagcaaatcccgggaccaatacggcatttaaacccccgactacacgtgactcaccaacaacggacaaccaaatacccaactataatctggaaaaggcaaacgagcacacgcacgagcacggcataggcacaaagagaggaccgatagagagcagagagaaagcccacaccaaacaggcaacgacacaaaagaacaacaggcacccacgcacaccagccgc

SEQ ID NO: 497891 - DNA, 104 bp, Homo sapiens
actctcaggatcttttttaacaggtctcactcccatcaactcagtattttgttagtagtttgtttgtttgtttgtttgtatttagtagatatagaagagtgcag

SEQ ID NO: 497892 - DNA, 362 bp, Homo sapiens
  misc_feature (208)..(208): n is a, c, g, or t
gatgcatgtgcggcaggaaacgtgtgcattccctgctctccgttttctcctgcagaactgcttgggggagtcctggtgacaatctgaagagcgcatccccactgcctggtgtgggtttccatctttactggccttggaggcaagccccatctccagggccagtttctatccttggggtctcattgtcagaattactttctcactcggnccctcccgcatgtcccgctttcctgctgtaattctcttcctagcacttatttctaacatactatgtattttacttactcatttggtttgctttcttcttcattagaatataaactctacaaagacagctatcttcatggttctcttcgtgtggt

SEQ ID NO: 497893 - DNA, 262 bp, Homo sapiens
acttctagaggatcagtaggtagacctaacataaccagagtcatctggggaaaagttactcgggcccactggaaacagtggcatggttctgtgccatagttcagaactcttcttcctgctaaggccattggacacagaatccgagtgatgctgtacccctcaaggatttaaactaacgaaaaatcaataaataaatgtggatttgtgctcttgtatttttaagtggattaaaaaacttactacctgggttaggtctacctgg

SEQ ID NO: 497894 - DNA, 263 bp, Homo sapiens
tgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtggaaggatcacttgagcccagaagttcaaggctgcaatgagccatgattacaccacggcactacaaccttggtggcacagtgagaacctgactcttaaaaaaaaaa

SEQ ID NO: 497895 - DNA, 146 bp, Homo sapiens
atacgtgcaagatctccagagtgagaacagaaccatggtactattatgagtcaccaaagggctttgtgcttcaactcactaatggctggaacaagtgccagtcttggtcagccatccatgatattcatcacatgaactcacaatct

SEQ ID NO: 497896 - DNA, 1675 bp, Homo sapiens
ttccttacaacagcttgaaaatcattattattaaactccttaaatcactgtgtctagatcattttctacattgtgtgccatagacttacccatgggacaacagagctccttacattattaggaccaactcactgtcaatcatttttgttttcagtgcaacacacatggcaagtgtgccgggggtaaatcatggcccagtcacaacacattcatcatcacaagcgcagtacaaataactcatagctagtcagattgcatagacattggatatatagtacgcataagcacgtgtaagtgaccattatgataatggagatattcatatacagacacctatgtagtcatgaccccataggcagaccagacagtacggcccctagacccgtttaggtgatagaggacatcacgacgtaccaggtaggacatgaaacttacaccgtgaaaacaggaaacaaccaacagtgaatgagattgctggcaatagggggccatcaaacaagcacataccatacggcgactgaaagcgaaaatgacaaacaaatagataacaaagtgtgaaaaatgcaacaactgcgacaaagagtgcaatggatgactgagtgagaaaacaaccacgccaacagagataacaaggcacaagcctccgaaagtcccagggcatacaccggtcagcaccagagtgcgacgcagatgcaagaagggagcacgaataacgacaggggaacaccgaacaaagagacccagcaaaacagagagagtagccacaaaagaacgagcagacgagacgatcggtgccctgggggacaagacaaaaacacgaatgggcgggcaatgagaggacacgcgcgccagccagcgtgggacgcccacaacgccaaggagcaagataacgcgcggcgagggacacaacagaacagaggccacctaagagcaatggaggacaggaaggaaacggggcagttgacacccacacaacgggcaacagggagatgagacaccttgcccccggcactgaagccaccacacaaaaggccacaaaccagacatcagagagcgagtgcataaagaggccagaacactgagaaagagccacgcagaccacagcggcaggcatagcaaacagagaaaggggcgcccagccagacagggacaacgacgagcggggggcgccaagcgacaagcgaggctaaagggcacaagccatgccggcgagcagacatcggcgcgcgtgccgcggactggctgtggtcgacgccatgacagacacaacggcgccacggggcagcaaaggaacggagaagcacgcagaaaaacgagagcaggcgaggcgcggcgggccgaccggacgccgagcacgggcagacgggcaggaggagagcagacaagagagagacgccgacggggggcgggagacgggagaggagggcgaggcgcggcaaggggaggcgggaggaggggcggcgagtgagaaaggaagggagggagagcaggaggggcagcaggaggcgcgcgcagctagcgcggcggaaggcaggcgggcggagaggcggcaggggagagggaaaccgagggcgagggggagcacgagcgacggggggaggaggagggaggagggcgggggagcggagggaggggaggaggcggagcgggcgggaggagaggggggaggggggct

SEQ ID NO: 497897 - DNA, 1603 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcaatcaccaccactgagaccacctcacacagtactcccagcttcacttcttcgatcaccaccaccgagaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccacctcacacagtactccagctacactacctcaatcaccagcaccagacgggacct

SEQ ID NO: 497898 - DNA, 3214 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcaatcaccaccactgagaccacctcacacagtactcccagcttcacttcttcgatcaccaccaccgagaccacctcacacagtactcccagcctcagttcttcaaccatctactccacagtcagcacatccacaactgccatcacctcacattttactacctcagagactgcggtgactcccacacctgtaaccccatcttctctgagtacagacatcccgaccacatccctaagaactctcaccccattatctttgaacaccagcacttcattgactacaaccacagactttccctctatacccactgatatcagtaccttaccaactcgaacacacatcatttcatcttctccctccatccaaagtacagaaacctcatcccttgtgggcaccacctctcccaccatgtccactgtgagaatgaccctcagaattactgagaacaccccaatcagttcctttagcacaagtattgttgttatacctgaaacccaacaacacagacccctcctgtactgacgtcagccactgggacccaaacatctcctgcacctactactgtcacctttggaagtacggattcctccacgtccactcttcatactcttactccatcaacagccttgagcacgatcgtgtcaacatcacaggttcctattcctagcacacattcctccacccttcaaacaactccttctactccctcattgcaaacttcactcacatctacaagtgagttcactacagaatctttcactaggggaagtacgtctacaaatgcaatcttgacttcttttagtaccatcatctggtcctcaacacccactattatcatgtcctcttctccatcttctgccagcataactccagtgttctccactaccattcattctgttccttcttcaccatacattttcagtacagaaaatgtgggctccgcttctatcacaggctttcctagtctctcttcctctgcaactaccagcacttcttcaaccagctcctctctgaccacagctctcactgaaataacccccttttcttatatttcccttccctccaccacaccctgtccaggaactataacaattaccatagtccctgcctctcccactgatccatgtgttgaaatggatcccagcactgaagctacttctcctcccaccaccccattaacagtctttccctttactaccgaaatggtcacctgtcctacctccatcagtatccaaactactcttactacatatatggacacttcttccatgatgccagaaagtgagtccagcatctcacccaatgcttccagttccactggcactgggactgtacccacaaacacagttttcacaagtactcgactgcccaccagtgagacctggctgagcaacagttctgtgatccccctacctcttcctggcgtctctaccatcccgctcaccatgaaaccaagcagtagcctcccgaccatcctgaggacttcaagcaagtcaacacacccatccccacccaccactaggacttcagagacaccagtggccactacccagactcctaccacccttacatcacgcaggacaactcgcatcacttctcagatgaccacacagtccacgttgaccaccactgcaggcacctgtgacaatggtggcacctgggaacagggccagtgtgcttgccttccggggttttctggggaccgctgtcagctccagaccagatgccagaatgggggtcagtgggatggcctcaaatgccagtgccccagcaccttctatggttccagttgtgagtttgctgtggaacaggtggatctagatgtagtggagaccgaggtgggcatggaagtgtctgtggatcagcagttctcgccggacctcaatgacaacacttcccaggcctacagggatttcaacaagaccttctggaatcagatgcagaagatttttgcagacatgcagggcttcaccttcaagggtgtggagatcctgtccctgaggaatggcagcatcgtggtggactacctggtcctgctggagatgcccttcagcccccagctggagagcgagtatgagcaggtgaagaccacgctgaaggaggggctgcagaacgccagccaggatgtgaacagctgccaggactcccagaccctgtgttttaagcctgactccatcaaggtgaacaacaacagcaagacagagctgaccccggcagccatctgccgccgcgccgctcccacgggctatgaagagttctacttccccttggtggaggccacccggctccgctgtgtcaccaaatgcacgtcgggggtggacaacgccatcgactgtcaccagggccagtgcgttctggagacgagcggtcccacgtgtcgctgctactccaccgacacgcactggttctctggcccgcgctgcgaggtggccgtccactggagggcgctggtcgggggcctgacggccggcgccgcgctgctggtgctgctgctgctggcgctgggcgtccgggcggtgcgctccggatggtggggcggccagcgccgaggccggtcctgggaccaggacaggaaatggttcgagacctgggatgaggaagtcgtgggcactttttcaaactggggtttcgaggacgacggaacagacaaggatacaaatttctatgtggccttggagaacgtggacaccactatgaaggtgaggggctaaagagggggaccccaaggaactctcccagcctccattccagaatccctccccgacccccaaccagggcagggagggggctgggctcggatcggcagtgacctccctgtcagccctaccagtggct

SEQ ID NO: 497899 - DNA, 626 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccccctcaagcagtactcccagcttcacttcttcgatcaccaccaccgactcgatcgtcaccaccgagaccacatcccacagtactcccagcttcacttcttcaatcagcaccactgagaccacatcccacagtactcccagcttcacttcttcgatcaccatcactgagaccacctcacacagtactcccagctacactacctcaatcaccaccaccgagctacctcacaccttcctcccaacttcacgtctttgatcaccgcctcccagaaagattg

SEQ ID NO: 497900 - DNA, 518 bp, Homo sapiens
  misc_feature (455)..(455): n is a, c, g, or t
  misc_feature (465)..(465): n is a, c, g, or t
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcaccaccaccgagaccacctcacacagtactcccagcttcacttcttcggatcaccaccaccgagaccacctcacacagtactcccagcttcacttctttgatcaccacctctgagaccccntcacacagtnctcccagcttcacttcttcgatacctccacagcccccagaagcaggtttcgtt

SEQ ID NO: 497901 - DNA, 178 bp, Homo sapiens
ggtatgcgagctcaaattcatcgacatgctgtctgcttcgtagggaggctggaggaagattcatcccaccggcaagatatgtttattctttcagatggagaaggaaaaatatggaaccagtcgaattgatggagagccccttggatgaatgaaatctctgtgaatagtggcaagtggt

SEQ ID NO: 497902 - DNA, 434 bp, Homo sapiens
  misc_feature (13)..(14): n is a, c, g, or t
  misc_feature (18)..(18): n is a, c, g, or t
  misc_feature (434)..(434): n is a, c, g, or t
ccattatggccgnnggcngatgctttgtgcctgtttttccagcactttgtcaaacagaggggggtcgaaaccgatgtcaggacttcatgaccatcctggttagcacagcgataccctgtgtctacgcctacagaacattatcctcgcgcgtggcggctgcttgtacgcccacggtaccggattgctgtgcggtcgatttgccaacccctcggaggctgcccttgctgcagcacgattccgccagactgactgcaggctgctcgacagtacagactgttctctatgtggagttttacacatacctctctctaggttgctatctggaccactgatagtgcgtgtctggcccacagaagcacatgttttcgggaggctgctggatcgaggatagattgatactagaagcctcaggatgtacggccttggtgggcccn

SEQ ID NO: 497903 - DNA, 398 bp, Homo sapiens
  misc_feature (342)..(342): n is a, c, g, or t
  misc_feature (345)..(345): n is a, c, g, or t
  misc_feature (353)..(353): n is a, c, g, or t
  misc_feature (358)..(358): n is a, c, g, or t
  misc_feature (360)..(361): n is a, c, g, or t
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttcttcgatcaccaccaccgagaccacatcccacagtactcccagcttcacttcttcgatcatgatcancancaccgagnccacntnncacagtactaatgagtgtgaacggtgatcctctagag

SEQ ID NO: 497904 - DNA, 350 bp, Homo sapiens
ccgagtagctcggattacagacacacaccaccatgcccaactaatttttgtatttttagtagagatggggtttcaccatgttggccaggctgatgtcgaactcctgaccttaagtgatccacccatctcggcctcccagagtgctgggattacaggcgtgagccaccgcacctggtctgttttttgttttatgagatggggtctcactccagcctggatgtcagaatgagactccatctcaaaaaaaatggggaaggaaggattaatttttcatttcaaatttagttcctcggccacactgcccatagttcaggggctcagtacccacatatggctggggactgccatat

SEQ ID NO: 497905 - DNA, 364 bp, Homo sapiens
  misc_feature (209)..(209): n is a, c, g, or t
  misc_feature (230)..(230): n is a, c, g, or t
ttctccccggagccgtgtcatgggctgggtaggcatttatcagccccgtcttggtgggggtggggcccccccccccctccaaacaaagcaacaacaggtagggggccagaaggtttttgggccttacgcctgagcagtggaggtcccccagaagtttcagttgccgggtcaggcattaagggggccccgtggagaaaaaggggcccctnaaaaattgtttttgggttttnacccctccccccccccccggggggattaggggggggggatcccggggggggggtttttcctccccccccaggggatcaagcccttttcccggccctcaataaccccccaataaattttttctttgtcaatcaga

SEQ ID NO: 497906 - DNA, 280 bp, Homo sapiens
gggttttttttgggtttaaaatgcccggcctcccaccccggggggggggggcccccttggttttttttttggggggcggggttttttgggaggggtttccccccccccgggggtttaaggggggccccccctgggccccaaaaattttttttggccaaaatttgggggggtttttttgggcccccaaaaacgggggggaaagggcccttgggggtaaactccggcccttaaaagggggtttttggggggggggggccccccaaggggtttttttcccgga

SEQ ID NO: 497907 - DNA, 655 bp, Homo sapiens
atggggtgccagcttcacttctttgataaccacctctgagaccccgtcacacagtactcccagcttcacttcttcaatcagcaccactgagaccacatcccacagtactcccagcttcacttcttcgatcaccaccactgagaccacctcacacagtactcccagcttcacttcttcgatcaccaccaccgagaccacctcacacagtactcccagcttcacttcttcgatcaccaccaccgagaccacctcacacagtactcccagcttcacttctccaccaccgagaccacctcacacagtactcccagcttcacttcttcaatcaccaccactgagaccacctcacatggagacaacctcacggagttctcccagcttcacttctttgatcaccatcactgggtccacatcccacagtactcccagcttcacttcttcgatcaccatcactgagaccacctcacacagtactcccagcatcacttcttcagtcaccactgccgagaggacatcccacagcactcccagctacgctttttcgattgccaccagtgagacaccctcacacactgttcccagcttcacttctttgatcaccaccaccgagagcacatcccacagtcgtcccactaacttggcgtccttaatcacc

SEQ ID NO: 497908 - DNA, 168 bp, Homo sapiens
gagatcgtgccttggcaccccagccggggcaataaaagtgagactgtcccaaaaacaaaacaaacaggcggggcatggtggctcacgcctgtgatcccagtagttggggaggccgaggcaggcggatggcctgaggtcaggagttcgagaccagccgggccgaggggg

SEQ ID NO: 497909 - DNA, 456 bp, Homo sapiens
  misc_feature (456)..(456): n is a, c, g, or t
aaaggactttatatcagcaggactttagggctgtggttccactgtttttatagtaaaatacactaatggaggggtagaggttggtgaacgaggtggaaacattcgatacaaggcaacatgacagacagggggaccctaactagactttaaggaattaattctatacagacggggggagccctacataattaagggtcacacttataaaaatatgactctgaattcagggataagaggcataagcctgtagatacaactccatctggagatactaactttaaattgaaagaagacaaacactcattgcatttatattacgtgttgaggtccttacatattcctaaatccatctactaattctctgttgtgatacaatggacagctatggtaagatgattaccacagccctgattcatgtgtggtctttagctgcagaaagtccatcggtcatgtagn

SEQ ID NO: 497910 - DNA, 447 bp, Homo sapiens
acgcaaagtaattctctttacaataatcaagtagcacactatgttgtttatatccagacctatgtattcttaccactgtcgaacagaaacaacacccatgtctgacaaccctccaaagtaaacaaatcacaccattatttggtttgcacttgagtttctgatacagctatcacctttattcagtgaagataaatagtctacctgcagaaggaatccatgttgaatcgtaaagaacttagaatagagcaactgcacagcccaggttagcatttccaactctcatgtattattctttgtatgttgtgttttttttagtttgagttatgttaatgagacagctggaattacaggtgtgcaccaaccatgcccggctaatttttgtatttgtagtagagatgggatttcaccatgtcggccaggctgttatcacactcctaacctcaagtg

SEQ ID NO: 497911 - DNA, 180 bp, Homo sapiens
gagtcctcattaccgccaatgcaacagtagccccagtaaagcagagaactgaagtgcagccatcatggtggacagcactcatgagatacgctgagtgactggcggtgctcgaaccatttggatgcaaatgtcgatgcttaagaaaaccggccacttcatgcaacagcccttttccccagg

SEQ ID NO: 497912 - DNA, 263 bp, Homo sapiens
gatcgagagactctgatcatagcttagcacgaacttcagaatacggacatagtcttcataacacttcacagaactggaatccctgtgtcctaaaagcaggctaaactgatgggttctagcggatctacatcactcagctactgaaactagtgtgcctcaaacgttacagggcagaactcacgaggctgggcaggatggggtaaagagcacagctacattactctctagttgcatctggcacaaggaggcccacgcataacgag

SEQ ID NO: 497913 - DNA, 583 bp, Homo sapiens
  misc_feature (132)..(132): n is a, c, g, or t
aggaagaaagactgaagcctgctcacatacctggacagatgttgcaaaccgttgtctgctatgtgagcccaacagactttgtcccagaacactgtatattcttcaagcccactgaattcccctgaaaatcanttactagccccctgaaattacccacacttccccattgctcatctgtaccccatttcgtggtggggcagtcactctgatttccccttgcatgctaatgaatgtgtattccatttctattctgcttttatgagctgacttttcagtgaaccttcagagggtaaaggggaagttttcccttggcccctgcaccgcagttggtaaggtccaaaatgttaaatggaaaattccagaaatagctggtcgtgatggctcctgcctgtaatcccagcactttgggaggccgaggtaggtggatagcttgaggtcaggagttcgagaccagcctggccaacatggtgaaacctgtctgtactaaaagtaccaaattactgggcgtgtgcgcacgcctgtagtcctgctacttgggagctgaggcaggagaatcacttgacctgggagcagagttcagtga

SEQ ID NO: 497914 - DNA, 234 bp, Homo sapiens
atgaagacggaggagctgctgaaacaggtggacgacctgaatgtggacgctgtcccagctgcacgtcgccaaagtgacatgtgcggtgcggcctccaagctctctaagatccgagtctgtccggaaatccatagcccgtgtactcacagatattaaccagactcagaaagaacacctcaggaaattctacaagggcaagaagtacaagcccctgagactatgcgaccaggcgta

SEQ ID NO: 497915 - DNA, 878 bp, Homo sapiens
  misc_feature (462)..(462): n is a, c, g, or t
agagagcgatgagcagaagaaattcctaaaagtcgatgtatttttggtacataagataataaacgagaaaaaagatccaccagagaaggttacaatccgacttcatgtgtccccataaaagtcgatgagaggggggttcaggaggaagccatatcagcgggggtgacctgggatgacagcccgcgaggtgctgtgctgcttcaccccgcaagacgtccgcgcttcgtacacggctaggagcttgctcggggtcgatctcgctgcgtcggtgttctccccctgcgtgccctctatttctgtctccctctgtggtggggtctcgtgcacgctgcaacgacggtcttctatgcagtcgccgcatctcgtggacctccagcgggggcctcgtcggtctcttttccgtgccttccacgtaggccttcatggggccatgtggggtcctgtgtcctggtcccggtgagntaactgcccgatcttcgcaactctggagcccacgggcatctggccctatgaaaacacgccctcgcgtcacgcaacactggactttgggcacacaaaccctcaggggaggacgtgcagaaccattcttgggttcgctaaccctgatcgcgcgtaaacctttaacctgctcgctgctcgtcctcccggttttgcacgcaagggcccccactggtgggtcggcctgagggagaacgggccaaagggtggtaaccccctttgtgttagagtaacaacctgggtaaaccccggcaaacgagtttgttatttacacaaacaaatttccttagcaattcgctggaatgttccgtggaaaattggttaacaatacctgtcctacttatggtgcccaacaatcctgcccccttccaactcgccca

SEQ ID NO: 497916 - DNA, 497 bp, Homo sapiens
accatccagttgcaggaaaaaaaacttaaaaagccgcacagatactacattatgcatcactacctaccggtcagactctccaggtccagaactttctccgagatcagcctccatcagaccaagctcatgactcacaatggcctatttaggcccattagcctacctcaaggcagtttcagcagatcaggctactggctcacaagagcctccacaggctcagctccacgcgttgcaatggcctctttaggaccgcagctcctgcctcccagccttctctccaggccctgaacttcctcaagtcgacctcaccaggcccagctcatgcttcttggcagactctccaggcccagctcctgcatcttggcagcctctccaggcccagcctctgcctcccgtcagcctctacagtcccaacatctgcctcacagcagattcttcaggcccagcatctgcctcactgtggaccacccaagccaagctccaaagcctgttaggcc

SEQ ID NO: 497917 - DNA, 146 bp, Homo sapiens
tatctgcactattggagcgccacttagcattcaccttacttcctctcatatctcttcacattctattctctgctatctagaatcgctgtcgccttatccagcctcgtttcacacttctagtaggctctacctgcacgccacacata

SEQ ID NO: 497918 - DNA, 463 bp, Homo sapiens
tatgtgcatcagccgccgaggtttgcagtgggtgcactttgctgattcctgatatagtgcccccagccagtacctgggtgttccccaccttggccatcatgcaccacaacaaacaggccactgagaatgccaaggcggaagtgcggcgcattctggggctgctggatgcttacttgaagacgaggacttttctggtgggcgaacgagtgacattggctgacatcacagttgtctgcaccctgttgtggctctataagcaggttctagagccttctttccgccagaactttcccaataccaaccgctggttcctcacctgcattaaccagccccagttccgggctgtcttgggcgaagtgacactgtgtgagaagctggcccagtttgctgctcaacagtttgcagagcaccaccctaaaacggacaaccacggcacgcgacgggtcacgggaagagacgcaga

SEQ ID NO: 497919 - DNA, 383 bp, Homo sapiens
  misc_feature (189)..(189): n is a, c, g, or t
aagaatcgtgtcatatttattttagaatggtttaaatcaaatacatttgggcacagtagatatttgacatgaaaagcagttgtatcagaatggtcatcagaaaaatagtaacattttacacataataactagaaaatattttctgtctgatcacttgagttagaaatcctgagaatgttactcattgancaattagaatctacctcataactgaaatttgctcagaaagaatcctcttaaaagatgctctgaaggccaggcagtggtggtgtacacctttaatcccagcatttgggagacagagccaggtggatctctgagttcaaggccagcctggtcaacagaacaagttccaggacagccagggccacaccagagaaacc

SEQ ID NO: 497920 - DNA, 100 bp, Homo sapiens
tgatccccatacagagtacagaccgtatatggtacattcacattgagagaaatgtaaacaaacgtaaagatgcacacggtactctgtatgggggatctcg

SEQ ID NO: 497921 - DNA, 410 bp, Homo sapiens
  misc_feature (10)..(10): n is a, c, g, or t
  misc_feature (151)..(152): n is a, c, g, or t
  misc_feature (156)..(156): n is a, c, g, or t
  misc_feature (158)..(158): n is a, c, g, or t
  misc_feature (161)..(161): n is a, c, g, or t
  misc_feature (167)..(167): n is a, c, g, or t
  misc_feature (179)..(179): n is a, c, g, or t
  misc_feature (193)..(193): n is a, c, g, or t
  misc_feature (197)..(197): n is a, c, g, or t
  misc_feature (216)..(216): n is a, c, g, or t
  misc_feature (219)..(219): n is a, c, g, or t
  misc_feature (229)..(229): n is a, c, g, or t
  misc_feature (237)..(237): n is a, c, g, or t
  misc_feature (239)..(239): n is a, c, g, or t
  misc_feature (245)..(245): n is a, c, g, or t
  misc_feature (258)..(258): n is a, c, g, or t
  misc_feature (272)..(272): n is a, c, g, or t
  misc_feature (282)..(282): n is a, c, g, or t
  misc_feature (294)..(295): n is a, c, g, or t
  misc_feature (309)..(309): n is a, c, g, or t
  misc_feature (316)..(316): n is a, c, g, or t
  misc_feature (325)..(325): n is a, c, g, or t
  misc_feature (332)..(332): n is a, c, g, or t
  misc_feature (371)..(371): n is a, c, g, or t
tgttggtttnggggcacagcctggtcccgggaggcccctggtgcacaggtggtggcccagggccacagtgctcgctcttgggggacgcgcggccgggggacgcggcctgtgtccggcccggggctcccggcgggctccggcggcagggacnntggngnggncgctcnccacttgaggangaccatcccggccngagnacggatgatagacccagcnccnggaagaggancttgagcngncggtcnctctactcctccngctcctatgagccnggctctaccnggaaggtgatgnngaggaaggtgccgnccgaccnggccctgcngcagcanggacgccacgctgcccggcacgccctgaggcgctctccnatgcccaggcccaggccgatgcccagggggatcatggcg

SEQ ID NO: 497922 - DNA, 138 bp, Homo sapiens
cttagtttaaccataccttactgatttaggtattactaaacatgcatcctaaggtacataaatccagcacagtgaaactgccatttccactgatgatagaaatggtgtctgtttctaaactgtttagtactcaagctt

SEQ ID NO: 497923 - DNA, 454 bp, Homo sapiens
caagcgcgttaatagtgcaatcttggaatctcccatagcccgatgaacagtagagctctctgctgtacgtagatagctatagaaatagtgtaacgctctacaagagcttttacgaaacaccagtccttggctaaggatgcccctctggggataacatctggctcgtgggctccatcggcctgtcgatgtcactccacttccggatcctctatgtcgaaccccagccactcatcttccagatcacaccgcttaacgtgacccagtggctgatggtgctgaaaatctccttgcccgtcattctcatggatgagacgctcaagtttgtggcccgcaactacctgaaacctggtagagatggtgtgcaggcggccatcaaatcctgctcgttctcggcatgcaccgatgggatttcctggccgattgtgctgcgcataatgcccctagtgatctgggt

SEQ ID NO: 497924 - DNA, 394 bp, Homo sapiens
  misc_feature (177)..(177): n is a, c, g, or t
cacgacctggcacatcctgtgggctggaggtggccggaatgggcgggcttgggaacgtgatgcccgggtaccgtgcctacaaggacgctgggtcatgactgttctctggaggctacgggtgccctgcagagtggaggcacgcggagggcctgggggggctggggatccagactgctngagcgcctgtttcccaccacaaacagcactgcggagtgccagccttgttctcgagggtggggcagcaccaccccaggcctcctgccaggccgcagggagccctgaggcagggcgtctgcccattctctcgtgccaacaccccgcactgcccaacatagacataagctggcccagggctactgaacagggccagggagggccggcaaagcctgcccct

SEQ ID NO: 497925 - DNA, 344 bp, Homo sapiens
  misc_feature (102)..(102): n is a, c, g, or t
  misc_feature (294)..(294): n is a, c, g, or t
tgagaaagagtctcgctccgtcaccaggctggagtgcaggggcgcaatctcggctcactgaaacctccacctcccgggttcaagccattctcctccctcagnctcccacgtagctgggactacaggcgcatgccaccacacccagctaattttttttgtatttttagtagagacggggtttcgccatgttggcctggctggcctctaactcgtagcctcaggtgatccgcccgccttggcctcccaaggtgctaggtttataggcgtgagccaactgtgcccagccaattaatnaactttttaaaacatgaaacgatttagtggagaaaagcggccggtttttt

SEQ ID NO: 497926 - DNA, 182 bp, Homo sapiens
cagtacctcgcattttatcaccccaacaggggtatgggatccctggctacaagaaggaggatcgcccatcaaatacaatcaaggatggcagatgtcgcctttgccagttaagccatcgagaaggtgagggagttcagtggtcagcactacagtccggcggaagccattacaggggggtggta

SEQ ID NO: 497927 - DNA, 153 bp, Homo sapiens
aaggagcgtgagcgaaccttggcactggaggaggagcagaaagcaggacaaaaagaagccggagtaggagggaacgggtaaaaggatgggctttgctcagctatttttgggccagatggggcctggcccgatagaataaaagacttttttacc

SEQ ID NO: 497928 - DNA, 209 bp, Homo sapiens
aagagatatccaggagagtcagagacccagaagggaacaggatccaggaggcctcatctcccagcactccagactgagccagccgggttatggaacatcactgagcaataaaaatattatcaacagacaaaaacagtttattgaataccaacctcaaaggcatcaacagtcctgggcccaagagatccatggcagggagtcacgagtac

SEQ ID NO: 497929 - DNA, 638 bp, Homo sapiens
gagtctggacttacgttcattgagttgtaaacctggtgctggctgtggtgttatgtggtgtctggggtacatcgcgtaccaaggaaatttgtgacattcctatgagaaacatagctagttgattctggggcacagtggcatcgacacttgtaatcctatcacttcggaggggttgaggtgggaggatcccggggatcccttccaggctaggagtttgaagccagcctggataatatagtgagatccccggctctacagaaaataaaaattagctgggcgtggtagtgcactcctggagtcaccagctactgggaggctgaggtgggaagatcacttgagcccaggagttggaaacaagcctgggcaacatggcaaaaccgccgatctctataaaaaatgcaaaaattagctaggcatagtggtgtgcaagctgtagtcccagctagcctggagggctgaggtgggaagatcgcctgagtctgggaggcagaggttgcagcgagctgagatcatgccactgaactctagcttgggcaacagagcaagaccctgtccccccaaaaacaaaagaatttatttcagctgtgcttaaaaagaatgagagcagagagggcagtttcccttgttgcatgttatct

SEQ ID NO: 497930 - DNA, 230 bp, Homo sapiens
taattcgcgtgcgggatctagagaatgcatcacgaacgcggtgaagctacatgcagattcgcgcgggatgacgaggttcagaaattgtcaggaatagggagtaaacagtggattcatgggtcggcaggagacacacgggccattgtaggtatactgccatctcccagtcatgtgtgcggagcgaagttcgccctatgactatatccggcaggctacaagtaggacggcgg

SEQ ID NO: 497931 - DNA, 820 bp, Homo sapiens
  misc_feature (476)..(476): n is a, c, g, or t
ggttcttgtcccggggatagcttgcttcacatgtctcggatcacctggtgttctccaggaaggacccatacgagtccagggtgaacgactttgtagtgcattcccagggctctattcgattcaagcctaggcctctccatcccacccgctcacggacttgatcgggcctcactggaacgccctgtggtaagtaggctcccgctctgggagctactaggctctcccatccgcttgctgctgcccttcgcagtgcctgtcattttcttctacggggcctctccccttcggtgctggctggtgggtgacgccgtgaacgggatcccttgctctttcatgggctactacgcgccatccatgttgccggtactccagggagcaggcagccacaccagcgggcctttgcaaccttgtcagagaaaacggcgtatcatgggcccgtcaccctgccgtgtctcccgaagcaggttcgagctcancatagggctcaaccatggaggcccctggagcccagatctgtcatctggtgctgccagctgtgctcactgtgggttttctgctcagggtctgaagcagctgctgtctccctcctctgcccccatcccctggctctcccctgggcacagtgccactcccttggaagggacgggaaccactccgtgagcacccagggcgttgggaagccatgaggcgggcctctgccatctccctgcccccagcacaattggcagagatgaggcgggtggtggacggctgggctgtcgtggcagggtctgcaacagggcaatgtcctggctgtaacccaggcagtgggaggtctgca

SEQ ID NO: 497932 - DNA, 160 bp, Homo sapiens
tgatctagaggatcctgagaagacgacagaaggggaagcaggaggggtaccacacactgagtctctgctctcatcctagcttatctggccagctgcccctttgtcatttcccttctctgtgaaatggctcttgggagactggctgaggagattgcagggg

SEQ ID NO: 497933 - DNA, 320 bp, Homo sapiens
catcagtacatggcctgaacgcactttacagtcattgaaactcatgcagtcattcatcccagtctgacatacctttgtctcaaatgttccacagtgcaactgtctttgtggcctaacaaaataatactcataggagttaaacatagacatcattataataaatactaacactttaaatgtttacgtcgacaaaaccagattagagtaacctacaccacatgcactatacagtagtaagcacaaaattccacagaatgaagcatcacaaagttctgctcagggtggctaattccatctaggtaaaatagctgggattttca

SEQ ID NO: 497934 - DNA, 130 bp, Homo sapiens
actctacgaggatccccgattatactcactaaatggctcagattatgattagcattttgagcaagtgaagtatttttaaattaaagtatatgcatgtagctctttttagacattatgctattgaaacggt

SEQ ID NO: 497935 - DNA, 317 bp, Homo sapiens
gatagaccatctgaggcatatagtaagtgacgaggttgttgccgtgagcagctctgtctatacaggcttgaaccaaactacctatgactcaggctttgaccactacacagattcacattatgcagacggagatgcataggaactaattgatcgatcaggctatgtgctgaccctgtgcttatgcgtatgtaagtggacatgtctagacgtgatacatctctatgtagccactacaatggagtgaactacatgagtgtagagactttgtaacgtgatggagacagtggccatatgatgatctgacctgtgttgcgcgt

SEQ ID NO: 497936 - DNA, 853 bp, Homo sapiens
agcggtgttaatcctagctgtgtgcagtctctcttacccttctgtgcccagctcagtcttccctagggctgggtgtattaggactggctttgtcccacagcttggggccatcggtcctgtctcccctctgctggccgggcacagctgtggtgaggttgggcagctgaacagtgttggctttcatgaggaggcagaaagcagaggctggcctcagactcatacagaaggtgggggttggctgggtacgagggatgtggagcacaaaagcctctcatcccccattaaccagggcaccaagcccacaggtgtccccagcccactggatcagaaagagttcagtaagaccggaagctcctggtacgggtttctcccagttctctagggaaggccacctgcaggtcactgaaacttcaagcaccagggaagatctaacatttgagtcccttccaggccatcagaggcctagtcagccacatgggaaacttccaagacctgactcaggcatcattccaccatggctaaggcaccagccggggaagacttgaaagaaaggggcaggagctcagatgaagagaaatcctaagttacctttctaggtcaaggcctgtccctggccatctctgaacttcagctagagcttcaagtctgtgcctggagctcctgggaaggctactcaccttgaacaccacgctttgacaggacagcatggtgcatgccgtgcatccgtgagcagtgtgtctcctgcatgcagaaagggagcagagaaggccaggggcttttgctaaaaatagtggccagaccagagctctggagccacctgtcccacctcaaatgggtctgggggtcaggaggc

SEQ ID NO: 497937 - DNA, 410 bp, Homo sapiens
aggaattcggcacgaggccaaggagaagctcccgcggtactacaagaccatcggtttgggcttcaagccccccaaggaggttattgagggcccctccattgccaagaaatcccccttcactggtaatgtgcccattcgagggcggatcctctctggggtggtgcccaagatgaagatgcagaggcccattgtcatccgccgagactatttgcactacatccgcaagtacacccgcttggagaagcgccacaagaacatgtctgtccccccccccccctgcttcagggacgtccagatcggtgacatcgtcacagtgggcgagtgccggcctttgagcaagacagtgcgcttcaacgtgctcaaggtcaccaaggctgccggccccaagaagcagttccagaagttttgag

SEQ ID NO: 497938 - DNA, 1530 bp, Homo sapiens
  misc_feature (564)..(564): n is a, c, g, or t
  misc_feature (718)..(718): n is a, c, g, or t
gcttcccagaaactggggacggaaaactgagacctcctggtcacccgccgccggtgccttttagaaactcccagaatgctctgccttccctccctggtccctcttcagagcccctcttaggtatctgtcgacggtgtaacgagtaagctctcatcgcttactctctcctctaatccagccccttctggagtaggacaagatgacttaacagctcgggtcgcagctagccatccagacagcgcgccggcagctgcagcgcactgagtacctgaaccccgtttactcgctcaccctcgtcgcgtccaggacctcggcagcctccgcggtgagcatggtggtgtcggcatgcatagggagaccagaaggagtctgagacaacgcgacgcgtcatgccgtcacttcgcagggagttgagacccgcggcctggagccagcatggacactcggcgacatagctgtacgcatgcaacacagaaggtatacgagaaggttctctccgcgtaggctcgcgcggccaacggcgggcggtcccagtccgtggatgtgcatatggctctctcgagntccccggggttacctttaatcccgcaaaggcgaggggcacacaaagaatgccctcaatgcgcggtgagcgcgccatctggcaaaatcgcgggcccctctgggaccgcaatatgcgcgcgaatgtccaagccaatctggaatcctgggtcctttncatgcccacgagcggaatcgcggccgcacatcacttcgacaagcaaaaaattgcttggcgttgtacatagccgacgttcgtccacggggcatctgcgcagcgtgccaccgttttaccattcattgctctcggcgagattcatataaggttcatgccccctatagacgctatcgcacttggcaagcggactgtgtagcagaaacccagtgtcccgtgcttccttcgccagggaaccttgccgtccaaaccattttgtaacacactttcttgccttgtagcatgggcgaaggttagttactttgtcttacagcattacaacaaagtcccacgttatcacagtagtcccggcccagggaacaattgtccgtagtgtccgctttatcgtattgatcatggctgacaccaagtgcaagaactccattgccccgaacagcgtgggtaactcccccagataaacgctgaactttccgatatatcaatggaactccccaccgttgcaacacttagttcccaactgaacaagcctaacacaattctggaactagccccttgttcacgaacatatcctttgtaattccctctgataaaacacaccaatatccagtctccacttcgaagatctatatcaaacacctttcattaactctttacgctaacctttcccttgaactcgattctaagccctcctccatgaacagtttctacatctccaactctttaccctaacttttacaacaaagtagcatataacatggccattatagtatatatccacttgtaccctccacgtccgcattcccacttctaacact

SEQ ID NO: 497939 - DNA, 377 bp, Homo sapiens
ggtggtcagaaacagcgtttgtcgattgctcgtggggttgttgggtcccctaaaattttgttttttgatgatccaacctcagctgtggatgcgcgttcggaaaatctggtgcaagaagcacttgataaagaattagctggcacgacaacgattgtgattgctgaaaaaatcagctctgtcttgcatgccgatcgcatcttggtactagatgacggccgcttagttggcagtgggttgcatgcggaattgttggcatcttcagccatttatcgggaaatttatgagacgcaaaaggcaaaaggtggtgacgaagcatgcatgattttcaacgcgcgaatgcgctatttctatcgatacttgaaacgctactggctgag

SEQ ID NO: 497940 - DNA, 393 bp, Homo sapiens
  misc_feature (10)..(10): n is a, c, g, or t
  misc_feature (95)..(95): n is a, c, g, or t
  misc_feature (97)..(97): n is a, c, g, or t
aggcctaaancgggaggatcctcaccctggggttcaaaagtttgggaaccagcctggcccatcatggtgaaaccccgtttctgttaaattagctnantgtggtggttcagacttgtaatcccagctacctgggactctgaggtgggaggatcgcttgaacctgggaggcggagattgcggtgagcccaggatgaaaccactgcactccagcctgggcgacagagcaagactctgcctcaaaaaagacaactgagaatctggctgggcgcagtggctcatgcctgtaatcccagcaatttcggaggccgagttgggtgcattgttctaggccaggagttcgagatctgcctagccaaacgcagtgaaacccgtctattaaaaatacaaaaaaaa

SEQ ID NO: 497941 - DNA, 727 bp, Homo sapiens
  misc_feature (139)..(139): n is a, c, g, or t
gaatcgactagtccgtgggattactcccgataagaagaatatgatgggtgagctatatgatcggtccccactggatgctatacacttggtacatcgattacaatacaatcgcgattgtactgatatctacgataggtgnataaaaggatactcttaaagggattagtagttcgttggtcgatttgtctaaaatgattcttttgtggagaagtatcatggatggaagaataagtggtggtggatctcgtggtactgtgttgtacctattgattatattggtatcaacgcaatatattgggagagcatcggagatgtaagtagtccaggataggagattgaaaacgtgtatgaggaggtctacgtggggagcatagattaaattgtgtcgtatgagtatcctaccttatagatgagggtggcgaaggctaactcttgacatttgggtcgacgttgagtataagaagatgctatttcgaaacattggttagcagaatgtgtgttagtgttgtatactagcgagtttcgtgggagaagaccgattttgaaaactggtagatcacacacattgaattgtgatagtggactttgatgctgcgacaggactccaggttgctgagtgaatcgtatcccgatagaaactaaaatgtactgattagtaaaaccgggtgtgggttgatatattgtgtatgtatggatgcaggtgggggaggatgggtactaagttggg

SEQ ID NO: 497942 - DNA, 182 bp, Homo sapiens
  misc_feature (40)..(40): n is a, c, g, or t
atgagcaaaggaaggagtatatatgtgagtagcccacttnttggtcaaaaggtaaatatatcggttgtttcggtaaagtgcttgccttgataagcagaaagacctaagcttgatccgcagaacccacatttttgtgatcccatacctggggaggtggaaaaaggtggatctcacggcttgct

SEQ ID NO: 497943 - DNA, 483 bp, Homo sapiens
  misc_feature (12)..(12): n is a, c, g, or t
  misc_feature (28)..(28): n is a, c, g, or t
  misc_feature (359)..(359): n is a, c, g, or t
  misc_feature (367)..(367): n is a, c, g, or t
  misc_feature (410)..(410): n is a, c, g, or t
  misc_feature (456)..(456): n is a, c, g, or t
caaatgtgcccntgggtattatacctgnaccataatccacccggcatatttatcaccaaatggagtcattcatagactgctttgggccatagactatggatctccaccttctttactctatttaaggtagttggaaacctggcctggcgatggcactcattctcatttaacttgctccattcaaaagaaagtgctaactttcttttacgccttattgcaaaaaagaatgagagaaaagagtaatctgaaaaatataatttagtgagaagagctgacaaccctgcagtatatacgtactgaattcacaaacgctgagcagtgcttgcaggttataaatagacttggcaagcttgaactgnccacactngtctgagcttgagcaaagcctgcggcagctgaccacttagtcnaatggggtatcacaggtgatggtccattgggcatgtgtagccagcnggttcagggagcctcctcccctcggcg

SEQ ID NO: 497944 - DNA, 377 bp, Homo sapiens
agactcacccacagggagttaatgtcgacagcggggctcaagttcaacacgaactggcggaatcgccagatcaatagacacccagatctccttcagagaggaacagagtccagtgtgttatgtcaccagaaaacatacaatcacaagactaaagaggcatggacatccagctggctgcgtttattaactgtgagaatgagtcatcaggcaactctccaggcaaatgtaaggctaaactggcttattgttgacaactcatcaaaaagttagaacgacaggaagctgaagagcgagccaactctaggctaaaggtaagaaggggaagagtacagacacacaaaggcctcaccaagagacccagggtcagcaaagacctc

SEQ ID NO: 497945 - DNA, 107 bp, Homo sapiens
cactgcgagtaaaggtagggatagtgtacaggataatatactcagatattttaaagtaactacttaataataagaatagcctacccttgtccattgctacaagaaca

SEQ ID NO: 497946 - DNA, 740 bp, Homo sapiens
gaccaacttgcgctctgggacctggtatgatgactgggcaatggaggtgatgcacaatgggacgaccatcctggatgaatactgtggcacaatctggacctgcctcaaggcagtgtgacacggtgtggcgtggtacggcgtggaggacgggactctccacttctcttgtcaactggcgatgactcacgggccctgcctgcctggaaccgtgcccaccgaggacgtcctactgctgatcagatcgagtcatctaatggaacaggacggcccccagggcaagccatctgttggcactgacagttggcacgagtggcatcaccagttcccttgacacaccacataccccttgagagcggcacagcaaaccacgggcttgctcatacccaacgctccctacccagataacccacttccacgtggaggcccacgggaggggctatccattgaacaccttggatggcctttacacaaataccatggaataggaaacaccggacaatgttaacccaggccaaacgttcacaatccaaccttaaaacacgcgggcgagcgaccccaggacagacccagcacgacaccacttcaaacgacgcccacacaacagcctggcgtccggcacaacgtcgcgcacgactatcgaaaagatgggcagacgtgcagccaagatccggaatacaagctcagctcacccatagacccccgcgaggcccagccattggacgatgacgaatctcgcgaag

SEQ ID NO: 497947 - DNA, 1575 bp, Homo sapiens
ctcaagagatccgcaacaggacgttggactcatatataccaataatacgtgggcaatgagtcattgagcacgtacttattggcggagcattgtagacgcggtacgcttcatatgcgcaagcccggatccttagagggccatcgctttaatgtcagaacctctgatgagtggtgagaccgagccaagagtctaaccaatcgtagagttagattcgaacacgaccctactgacaattacgtaatcagatctctagttccaattagctatattagccaatacatcatatctgtgcagtgagtttaagtgacacaccattgcaattaaagttctgcgcaagcgtcataatttagagtcagagctggaccctcaacgtattcactcgcgtcagatttataacttctgcggttgactcacacacgaactcaattgagaggcttttcctcgcaccgtccattaaaacacttaacaccatttcaatacgtcctccttcatcgtaccctttggtcttaccgcctactcccttgcttaattaccgttagcgtacgcgtcgccgttgcaggccaattgcgtagacctaagtgatgttggaggaacagggctccgtgaacggccatgcgcacatctaagggctatggggaacaacgttaccttaccccaatccccctgttgaggcacgtggcagatcatgaaactccttaaaaaccacttcgtgtacgtcccttctcgggtaacgcatcaggtcaagacggctagttcattcccctccctttattcactatcacgtgagggggcccgagttcgggatagtttctccctactttgattccataatccaagaagtggggattccaattactacaatttatatacaaattcccaacgatgagaccaaaatttaaattccgccaataatttacccaaaaacacccgccccttggttcccatttcaggtccctggaaattcacccggataaccgtgacacctcccaattcactggtccaggggtcccttggtaaatcttctgcttcccctaaaatttcttaactttatgggcaaagggttcccataaaagtcttcggtcctggtgacatcttcaattcctacctaaaggttaatccttaatagccgttggcactcgggggccaaattaacctttttattatcgttatacagttccaatcttcatgtaaccgcggacacacaccccgttttctgaaagaacaaggcaaggaggaatgtataacctctccggaaagtaccctggtaaccgcgtgaaagaggacagcgggaaagtatccctgccaaattttttttatggtagtgccaacaccactcggtaaaagtttcttgacaatttttgctcgggggtcatacacgccagggaggcagttttgacgaaatcaactatttattgccgataacataggggcgagctgctcgaaacaaatcaactcgtcggccaccactattatggggaaacacgcttcctatgtggaatctcagccatacgcgaacatctggtggacgcagcagtgtcggtgatacaccacaagagaggagtggcgacctgacag

SEQ ID NO: 497948 - DNA, 426 bp, Homo sapiens
ctaccacgttgtgcatgatggccttgaactactgacttcaaacgaactgcccacctagacctcgcaaagagctggaattacaggcatgagccaccacttccaacatgggatgactagcgcaaactatttatgagatatttcactgtagccttatagaaatcctactaatttctgtatgaagactgagcatcctggaactttactggatcacgtttataattggtgaaattgttcataggaatttttagatggactctctcagttgttgcaaagataagatcatactattgccaaacatggacagtaagatgcattgtatcccaaatcggatgccttaatcaacctgtgaagcatgactgatctatccaggaatactaggactacgaatgaacctccagagtgcggggctatccttcaccgtgccct

SEQ ID NO: 497949 - DNA, 433 bp, Homo sapiens
gagagagagttagagagagagagagagagagagagagagagagagagagagagagagagagagcgagagactatagagagctagcgcgatatagattgatccctatcttgtctctcttctccttctctttctcttcctctttcttcctcttcccctttctctctttcctctccttcttttcttttctttttctcttccttcctcctcatctctctttcccctccaatcttctttcctctttccttcctccttccttcttttcttcctttcctttctctttcttctccttcctcctcttcttctttctcccttctccttctctcccttcttttcctcctttctctcttttccccccttcttttctcttttctttctttctcttccttctctcttcctctctctttcctctccctctcccctcttcttttttctc

SEQ ID NO: 497950 - DNA, 1043 bp, Homo sapiens
tccgggactgcggagttgtactgtgaagccgggaacaaggaacgcggctggaacgacccgccgccagttctcatacgggcgtgcagacccaggccggggacccaggcgctcgctgcttaccaagagggtagccgcaccccaggatggatccccacagagtccccgcatcagagacttctcctgggtctcccccaagtggggtctccagtctccttcaagtaaggctcccaggtccccacctgtggacaatgtggtccgtgccttcttgtgggtggaagccccacaagttttcccagtcggagtcttgaggcttcgatttgacttgaacggatgttgcttgaagacccttgtgcgaaccaggtgccttttgggacagaacttgcccgtggtccaacaacatggcgatacgccaggatactgtcgacttgacattctaacacgaagcgccctgggctaatgttgttggcacgtgcaaccagttggggtctgccacgcgaacagtttgtctcaaattaccctttgtaacgtgcaaatcacgcacacgtgggcgtccattacccgagtggctggccaacagaagtctttttacaaggcccctatccgtgtttggtgggtcaccatgccactgtcatctttgtgacatttccacaacgggtgttccccctaccaagtgcgattgtgaccccatttgtttgcaactgtgaacggtgtccggtgtccccagagtgcacatttgcgactagacacagtttttacgtaccacagtaattttcatactttcgcgctatacactcactactgatgtgcgctgtgtccctggagtgtattccacggatacgttagtgcggcaagtgctcaaatgtggaacatcgcatagaacgatctgtctttggcattagcaccatacaagctcgttgctagataacgagcaactctcaaattatacacacaaataacgcttaggtgcttttccctatcgcacatcgcgcgttctccctagtaaaagttcgctttcggtggtagttcctccctcagtgaattgt

SEQ ID NO: 497951 - DNA, 594 bp, Homo sapiens
tgcccctcattcacataaagatattatagcgtatacatttagccatcatcacttctaggaatagctaaatcatatcgctcacacctcatgatcctccctactatgcgctagaaggaataatactatcgctgttgcatatatagactactctacataatcgcctcgaagcagcccactcccgtctttagccaatgattgtgcctattgccgatactagtctttgcctgcctgtcgagaagcaacggtgggcctagccctagctagtctcagtctccaacagatatggcctagactacgtacataactaaatcgtaatccaatgctagaactaatcgtcccaagtatctgtattagttactcacatgacattgactttccaagatcactaccgataccttctgcattcaacacaacctacccacagactaattattagcatcattcctcttactatttgttcaaccaaaattcaaaaacaatctattaacctgttccccgaacgctatacactaccgacacgctagacagcccggcctcctaatacttaactatcttgacatactttgcccttcacactcgctggaaatcaacaca

SEQ ID NO: 497952 - DNA, 772 bp, Homo sapiens
  misc_feature (83)..(83): n is a, c, g, or t
  misc_feature (130)..(130): n is a, c, g, or t
tgcaattcaacatcccaccgccgccaggacaaaaccccattgtgaatcatggatattccaatcctgcagtgttctctctaagncagattttaagacaccaaggaactgtgtggccgtgaccccactatancatggtgggacacttgacagaattgtgtacctgttccctgtggccattatagaaccgttgatgaacctcgttaactcgcccaagattcccagattattctggttatcctggaagccctttccaatatctttcaggctgctgagaaactaggtgaaactgagaaacttagtataatgatttgaagaatgtggaggcttagaccaaattgagagctctaccaaaccctgaaatgagtctgtgtataaggcttcgttaagcttaattgagaagtatttctctgtagaggaagaggaagatccaaacgcttgtacccgagaactacctctgaaggctacacccttcccagttcacggatggggctcctgggacccttaacttttagatcatgtagctgagacataaatttgttgtgtactacctttggtattttgtcttattgtttctctactaagaactctttcttaaatgtggtttgttactgtagcacctttttaccctgaaactatacttgaaccgttcccactgtacatacatactgtatgaagcttgtcctctgactaggtttctaatttctatgtggaatttcctatcttgcagcatcctgtaaataaaccttcaagtcccccccttttttgacttcca

SEQ ID NO: 497953 - DNA, 443 bp, Homo sapiens
aaggtcggaaaaggggacctccctgggagatcaatcccctgtcctcctgctctttgctccatgagaaagatccacctacgatctctgctcctcagaccaaccagcccaaggaacatctcaccaattttaaatcggatcttctcagcttagcggctgaagactgatgctgccagatgactttggaagccccctggaccatcacagatgcccagctttggataactcttacagtggaggacaggaatatcaggtctctgagcccaagctaagccatcatatcccctgtgacctgcatgtatgcatccagatggcctgaagtaactgaagaatcacaaaagaagtgaaaatggcgcgtgcctgccttaactgatgacattaccttgtgaaattccttctcctggctcatcctggctcaaaagctcccccactgagcaccttgtgac

SEQ ID NO: 497954 - DNA, 1309 bp, Homo sapiens
gcaccatggctatggtgggcaaggacatccggtctacatgctgcagcagccaggagtagcagctcccccatgtaccttctggctggaagtaatcgacaaggggatagatcgctgagcaagtgtcaagtagcactggtaggaacatattgtccacggtcgcacggcgcagggacgggggagagtcgatggagttacgaccaccagtcctggcacctccgatcgaggatcagctttgtcgggcagcgatgggcgcgctaccaaggtagtgtcgagtcaccagatccatcctttggcgtccagccatatccagcagtaaggccatggactcagccgtgaaatgtgtgagccatcatgcagcgcaaaaagcacccagcgaaggataacccagtccggagaccatgcaaccggatggcgccgcgcttcggaagtggtggcttggcgcaccagggtgcagccaaaagggccttcaggagtagccttggcgaggaacggagtggacgcgcaccgcgatatttccgcgcggcatgacgcgcggctggaggcgagcggccaatgacgagtggtcatatggcccggtcaatgcacccgatcgatgctctatgtgtcgactcagcgtgacaatggtggcacacacactgacgaatgagcgcagggggagagttaaaccatggcgtgatagctggtggtcaggaaatattcgaatcccggggatgtcctaattgttcaagcacatacactggggcaaccctctgtactgtgatcgcctagagagggacccacccaattccgttgggatgggttccccccttgggggaaaggcaaccggttgctggaataatctggtgggggaagaaaaacggagaggagtggcgacatcacacatggggcaaagagagagcacaggggagggaaaaacacaatcccggctccccgtagtcaagcgcggggattcaactggaggcggcccagggcccggatgaagccactcaacattgaggcgggacaggcagcatggaggcccgtgaaacaagccaaggttccctgggatgagatcaggcaaccggctggtcggggtagcaacggaatgccgcgggcccaggtgaataaccaagggggagaaaagagcacaaaaaaccactaaggcacagggcacgcagcagcacacaaggccaaaaggtgaaacagacatgggagcccagcaaaagcagccggaaggacaacgagctaggaacccacacgggcacgaagtcattcaccaacagaggggaggtggaagacaacgagatcacgacaagcacaaggagcagag

SEQ ID NO: 497955 - DNA, 240 bp, Homo sapiens
gccccctgcggtccagcccaaaatcgggtgcttcttcataccaatcacgaggaggtcaacgttgcccgagaggtcgataaggcgtcgacgggttctccggacagcacgcgggtctcgacctcgacatggggatgcttattagcgagcggcttgacgacctcgttgagtcgtttgagggcctcgtcgtgcacctcttcggagtcgttaccaggaaccgtcactgcgagcagcttgcagcca

SEQ ID NO: 497956 - DNA, 954 bp, Homo sapiens
gtctgtctaagaaaaaaaaaaaaggaagaaactgtcataactggtttacatgccctaaagtcaacggttggtttcatattggattggttctggtcagtgtctatggtctggatagtagttggtcaaagtttggcatgtcaagacgttgatattggcccaagacgtctaagtaaaaacttcttcaaagtccttagtgctgatttttggtcacaggaggttaaatttctcatcaatcatttaggctgaccaccacagtcctgtcttttctgccagaagcaagtcaagtgttggttacaagaacaagtgtgaaaaacattggcctgattaagatttctagcaccatgaaaggtggtaagtatttagatcggccatactcctcgtccaagtgattagacctcctctaaataaaccagtagtgagttcaaaacagccaccctgcagatttccttgctcacctctctggtcattcggtaactttacctgtgcccttagtaaaacactgtgtaaagaaacgtacgcccatacgggcttaacttcgtagaagattcttacgtcggtacctctggtggtacatctcccatcttcaagacggactcagaagtagtccttaatccaccttgggtcccctggccccatatcgcggggagaatatacggtatacggggtgcgaacagaaagggttataccgggcgtcacagggaccttggcgctctggatctcgaagtccttgtaaaaccccgggaagaaaaaggacagcgaagcagaggacagcagcaggaagcgaaagatcgattcgagcggcggcaaggggaggccaccagaaagagaagggttgaaggagaccacaagagaaatggggcaccggcgggacacgcaaaagagaggagagacgacaacagtgggaaaaacagggggagcacggaggagaacagggggcgcagaagcacgggaagg

SEQ ID NO: 497957 - DNA, 247 bp, Homo sapiens
  misc_feature (4)..(4): n is a, c, g, or t
  misc_feature (104)..(104): n is a, c, g, or t
  misc_feature (218)..(218): n is a, c, g, or t
aacntttgtgggtacatagtgtgtgtatatatttatgccatatatggcatattttgatacaggcatatgaataggtattaatcacatcagggcaaatgaaatanccatcaactccagcatttatcatttgtattacaaaccgattctacacttttagttactttaaaatgtacaagtaaattgctattgactatagggtcattttcatgggtataatnaaaattatatacaagtataaataaaatcc

SEQ ID NO: 497958 - DNA, 777 bp, Homo sapiens
cgcgggggctcacgcctgtaatccgtggaaaagaactgagagtccaggccgggcgcagtggctcacgcctgtaatcccagcactttgggaggccgaggcgggcggatcaccaggtcaggagatcgagaccatggtgaaaccccgtctctactaaaaatacaaaaaattagctgggcatggtggcgggcgcctgtggtcccagctactccggaggctgaggcaggagaatggcgtgaacccgggaggtggagcttgcagtgagctgagattgcgccactgcactccagcctgggcgacagagcgagactccgtctcaaaaaaaaaacaaaaaaaaaagagaattggagaattcggggaaattaacccaccgtttccaggggccacatgggaactttctcaaccaggggggctggaaaccccttccacaggggggaaagagacattggttctctcaggcaaattggtgtgcgctgggaccaggtgggtgattatcccattgtggcaaaacaaattggagggcggaggagccttgtgaaacatatattcctctaataagcacaaattttacccccacaatttgtgggccaaaagaacctctatgtgtgtgttgaggcgacgctaacaaccgaaaaattcttctagaagagaaacaccactgaggcggagtaaacttcttcagggaacctgtgggaaacaaggagggggccccttagaggccccacaattaaaagggttgtgagaccaacagacaaagactctctattttttacagcttgc

SEQ ID NO: 497959 - DNA, 308 bp, Homo sapiens
gcacatgtggatatcaaggggacgagaggagcttggtcctcgctgacatactcctacttatgcgcgagatgtacgtgtggatcctagcgtggattcaccgatgagagatcgtatcgggtgagaatgaacacataactagcatttattcttgtcctctgatccactcccagctgatcctctttgtgcatgctgtgagcatgagcccctttgacagggatgtgcggctgatctcccttggctcccggcagaacctttgtgtaaatgaagacgtgaaaagcctaggtactgtgcagcttatcaacgaccga

SEQ ID NO: 497960 - DNA, 464 bp, Homo sapiens
tacgtccacagagacattcactcattctctgaaagctgaaatggaatgctttggcctctgtcaagaaaattaaagactctcggtgacaatcaagtctgcaggagatgtttcactttctccagctggagaaaattaaaattacctggattatcaaaacagttatgtttctctaaagtctgagactgatagtcctaaatttggtgtctttgattatagactggacttataaaatatagactggacttacagactttgattatagactggtcttattatgacctataaaaaacgctgtcttcagatgacaaatcccaactaagcatcattgaaaacaagcaaaaaaagggaactatattgtggttttggctattcctaatcctatctgactcaggctagcgtaaggtagcattgtgtcttcttttatacaactgtgctattagcagtaatgagtactgattccagac

SEQ ID NO: 497961 - DNA, 1026 bp, Homo sapiens
accatctcgtcagagaaccagagcaccggccagcaatcggttcaggagcttgtctgtggcgcaccatactagattcctccgagtattgaggccgggctctagtaccctgaggagcgctggtgatacacgcaatgattgaggaccgtggaacaacgaggataactgagagtgcgtaagacgacggtcgcaggggtgcctgctggagtggaagcatgggtcatgcagagcgctcggaggcgtaggagaaagatgaagcgtagaagccgtggctggtcctccaagcaggaagccattcggagcatcaggtggagagtagtggagtttgtgacgatgtccttcgagtgtacaagtacttgagccacaggaacctgagaaataacgtgggggatcgcaacgccagaaagattcgctagcagcattgcacacgttgcaacagcacttcagatggcacggtgtttttcaagagctgggactgtgagagcgattgaggagacgtagaggactgagatgatgtgctggacgagtgacagctaccagagatgccagggacgactatgaggaaagaaggtcctgagccgcaaggattcaggacgtgtacggaagggctcaggcaaaggcttcgggttccatcccgtgggcacggggtggacgtcgagtgtaggtagggggacagagggggagcaggtacggcagagtggttcttagacattataggccactagtgaagtgtacgtgagacacaaaagaagtgagagagatgttggtaaggaatgatgaagttgtcgtaggcagtggtggatcatgggcaaggtgatactgtttcgggggggaacaagacatggtatacagaatgttatactttaatgtaatgtcaaggtttgaatgtaggctgagagtccgtgttggagttgttgcagaggataacggatggatgaagtgagagggacaattgagaatcttgggatgacgaacggttgagtcaggataaaataccacaatgtagggttgtgcttggcgacgtctcga

SEQ ID NO: 497962 - DNA, 225 bp, Homo sapiens
ccggcccctgtattatatagaagttgtggtcatcggacctgtggtcgctacgtgatgtgtaggaggaagagctcaggtggaaaaggagggagctactctcaggctgcgtccagcgacagttgcccagtggctctgactgtgtctctcacagcttgacaaagcctgtagacagcttgtctatgtgaagggactagagaatgcagtgatttctatcactcctcccct

SEQ ID NO: 497963 - DNA, 860 bp, Homo sapiens
gacatcccggttgtacttctgtgccgggggtcttcctgctgtcatgaagcgacgtaccgggctacctacagcataggcagagactccgcggcccgggcagcccgctgatgtggcaccgtctggaggagctctacacgaagaagttgtggcatcagctgagacttacagggtgctatgagtattgagtgcaggatccagtagcatatttgcccgaaaggatgatgggtcctcatttaaagctttatgaaacacgtttagtcaggtagaactttgagagccacaggtgtgaaatccctcgtgatctcctcggtggtaacatcagttccttacagcggtagggttcggaccacgagagacgtgagtccctaagtgtggcgtctatacgttttctgggtgaaagactcggtgagaacgtgtgacaagagtaggtggatagacggcagatgactcctgtggtataagaacaggcaagtttggaatgctctaatagattaagagcactcggggaggcctacagtgttaccaggaatggaaagcatagatgagacgatgtttgaacgcagaatgctctacaggccttcctggtgtgacatcggttcacaggtcgtgtcctagtagatctctccatgtaaattactagtcagaagcaatcggggataccatcgcgttcctactacccaaggattgctctgcggtatgataaggggcctgtgttgacatccgaggactctaccaggagctctgagcagccaggaagagagccttcacgctggggctagcaggactactcggcgaagggagattataaccttttggagaactcctcatgcaccctggggcttggagtcctgatgcatacg

SEQ ID NO: 497964 - DNA, 414 bp, Homo sapiens
cgggtggatcacgaggtcaggagttcaagaccagcctggccaagatggtgaaaccccgtctctactaaaaaatacaaaaaattagccaagcgtggtggcaggcacctgtaatcccagctacttgggaggctgaggcaagagaattgcttgaacctgggaggtggaggttgcagtgagctgagatcacaccattgcactctagcctgggcaacaagagtgaaactccatctcaaaaaaataaataaataaataaagtgctgggctactctgacctgggtgctgtgtgtccctgcgctgatcgcttgacatttctgagccagtttcttcatctggggcctggagtcctgccttcctcccttgcagggtggacttggaggtcagtgggagagacaagtgtggacaccccagagcagt

SEQ ID NO: 497965 - DNA, 373 bp, Homo sapiens
cggccttccatcctgggcataagagctgctggcctgtgtgccggggtgggggcctgcctggcaggcacaggcccacttaagttatccattggcagaagcggcaggtgccccgtcttgcagggctgagcttggagcagactgctgtgtgctgcagccacgcccgggctgctttcctggagggtgggacacccattctcatcctcacacctgcctcccttgagactcggcgctgtagcttttcctcttcgtggagcaccacctgggctggctcctacctgtctggcggccccttcccgtcccctctgccctactcccctcctcccctcttagctcttattgcccaggctggagtagctcttattgcccagggggg

SEQ ID NO: 497966 - DNA, 885 bp, Homo sapiens
  misc_feature (94)..(94): n is a, c, g, or t
tcctgatacgtgcattcatagaacccctttcttaagtcgcaaaggggtgctatccatagctggctaaagccggagacggagatacattagcaanagtgactacaaactcacacacatgaccgcgcagagggtgcccacgcaaatcgatagctgagggcacacctttaccctggcatagcgtcaacaaatttcacatatgcggctagaaagactgagtaagactgttcttattcacccaaagacgaacgtcccgcgttaaaagcccgtgcgaagaactcaacaactaggccttgtaatgactcagatccgatccagcaccctgtcattctccttcacctgatgcgtgtctgcagtgcctagtgagaaagcgcagctatgcaccaacaaccaactggcttggaagattttcttgtgcgcatgacggacattggtgaagatatgatccagtccagggactaggctcagccatctgtttccttggtccagaaaaacggtgacgattaagaagctttcaggaatgattctatggattaaaatcatacaaactggtggcgtgttctgagaatcagtctgggtattgatttccttttccagtgactgggctccaggccatgtctaatgaccagctcgattccctgtgcagttcagagagcaagtgaacccaaccaacgaatgtcgtcatctaagccctgaccctagccagggactcccatgctgctgttggtccagtctctccagaatgcctcctttactttttcaagtttttgcccttcctttgctttaaaagctattctcacatagctttatttcctcctcctttacttcaaacactgtaagcagcactctggagttttccacctgtgcacattagctcacctgtatgca

SEQ ID NO: 497967 - DNA, 209 bp, Homo sapiens
gtacagcgtacatacaacacatccaccagcgagcgcacactgcggtggtgcacctgctgacccctcccagctcagcctagctggctcttgcatgggctgcggagatgggcgcggagtgagtgctggtctttgtccagctcctgacccacaggcccctcaggactcctgcatttcccccccacgagcacaccctgtaccctgccaggaat

SEQ ID NO: 497968 - DNA, 427 bp, Homo sapiens
ggggaccctaagtaactcgagctaataccccagctgaagctataagggaacacgatctaggggcggctctagaactagacccgcgagaatcgcgaggttagatacgacgacgttggaatcccgaagtagaatagctaaacagctggaaccaaaatgaggggatacggcaaacaaaagtgaaacttactcgttatcgatctaagccgtcaagtacccgatctccgcgacccattgcactcaatttgactggagaatagcacggacaagcaggtggacacgctgtgaaagagaaactactaatagcctgtagacagcaagcggcccaagacgacagaaggctgcaaagggacgagcgtcgattcgagaaaaccatgcactgatttgcttatcctaccatggtagtacaggtttggaaaatttggagaaa

SEQ ID NO: 497969 - DNA, 966 bp, Homo sapiens
caggttcaggagatgggaagccagttttctgtgaaaatgcttgaagcagaatcacagggatggctgtattaagcattttcacagaaaacaggtttcaggagatgggaagccagtggtgcaagacttaaaaaatccttcacatttatttagaagtttctgttatcagcagaatgatttcatgtttttatgatttttatttggaaccatcattgagttccttttttttttttttaagttggattttgggttataagctgctggtatatatggtttttaatttttataaacaaatcaatttaagtttatagttcttagtatttaagaaagcagatttccagtagattgactcgtgttaatccgggtaaatatcgcagaatttctgggaagtgttatttctcccaggtggaatatttcaccgtgatactcaggatgtgtcaagataaataatattagaggtaaacaaaaggtagtgtggggggaattgcaatttggacatgaaggtgtattaaagccaggtgtaatcaagtgtagttaagatacattttaaatcaacttttcaaataaaattttagaagccattcttctttaaattaaactcacaagtcagacttttttcttaagtttatcaaggttcacagaatatccattcttacagcctaaacaccgtgtagcaaaacaggacaaattcgtgaatacgaatttagtttccagactaaggttgcaatatattgtataaagccattcgaaatatgcgaaacacatgttgagcctcatctcgaaatgtaaaaaactattgtccactttccagtggattatagagagatttcccaaagtagaacacaagcttaactctggtaggagacgcccccccgatggttaatcacaccaatgccaaaggtgtcatacacgagatgatactcccaacaaagtatacaagctaaggacttgtaaaatgagtcattacta

SEQ ID NO: 497970 - DNA, 221 bp, Homo sapiens
tcgcagtggtacctattatgttatgaaaaccctcgatgttcatggaatggtttaaacttttatgcgcaactacaaaatgatgtctttttcctatgactcaaagatgaaagctgtttcatttgcgtcagattgtctcagattgaccttaccaagtgggtcttacttggtaaatttatctgttgtccccttcctctcctcgtgccctcccattcttgtgccct

SEQ ID NO: 497971 - DNA, 130 bp, Homo sapiens
atcgtgctgtgtgtcgtgtgctgagcgtccgtgtgctggtgctcgtgtagtagtgctgtgtgtgcgtgtgtgctgtgcgtccgtgtgtgctgtgcgtctgcgtgtgtgctgtgtgctcgtgtgtgtgctg

SEQ ID NO: 497972 - DNA, 571 bp, Homo sapiens
gcatcctaacagtgctcttttcacagctatcatctttccctggcaggtggtgaaactgagtggacagacaagtgtccatagtacagctgcctcgtgtgggacccactgctctaacgagccagccccgacacagaagctgagcacccccaagctggggaacctagagagacctgcacccgggtcccacgtggaagactggctggtgccattttgtcttctgtggatgggtgagagtcccctttgcaccctcccccagtaatatcaggtaagctaggaaataaaagcctttggctaagcggtcagttccccacggtttaggtgccttgaagcacattcttgccaccccttcacctggttctttctcctctgactccattttattgctccactttggtttcattttcagtcctaacatgtatgtcttgtttggagtcttatgtttgctttcgactttctgttaattgtatttgggcaattgtttaaggcaggacacttggttgtgagaggtcccctgtcgtgttgactctgggataccagagtcacgttgtcacgttgttctatgtactgtaac

SEQ ID NO: 497973 - DNA, 855 bp, Homo sapiens
actgtatggctggagggctattgtggtaatagatgctatctaaagatgatctccatgaaagtatggacgtacttggtgctgggaactctacttctagtccgttactctgttcaaacctgcatcatcagtatgtcatacacccgtatatcagtatataacgatcgggctcgttgtagagtaggtggatcacgattagtacctccaattccgataattgtagaacgagtcctggaattcccggtgtccaaatggaggagggtaacactcactgtactcaaggttatagactctagcattggtgagagtcaggccaggacttgaaagaattccttctgtagcacttattcctcgaatgcatcctaaatcacaggacagcgggttcgcatcttcatgatattgagaggtcgatagacagatacggtgataatggtgagtcaattccagaatacgttccgttagattgaatgcttgtaccaggagtgctgattgtatacatacttcgaaaaattagggctacgaaaggagaatatatactacacctttgtttaatgtgtcattagtggggagtggactactagggaataattcttcagtttatgctatgtgaattctattcttgtggtcttccacgattgtttgctacagacgaatttcaactcaaatagtaaaagttgtccgtgaagagatatcagagtggatttacgagaatgatcgcagtttccatgaagagcacctgtatgctggtaatgaagcagaatttaaggttggtacttattaagcgtgaatgtcattcaagggagttacatctttattgttgtgacagaggaggatcattgactactggtcggtcagaaa

SEQ ID NO: 497974 - DNA, 388 bp, Homo sapiens
  misc_feature (28)..(28): n is a, c, g, or t
  misc_feature (33)..(33): n is a, c, g, or t
ttcatgcacgattgagatctcacgaagnctacnaatatcaagtcaagcaagaatcatggccaaaatattgctatggaactcatagaaaaagacctgaacaacaaagttctaagtggagacagtaaaaaaaaaatccatgtttcttaaacagcccaaccatccacaaagaaacaatcagggctgggtatgtggctcacacctgtaatcccaacactttgggaggccgaggcgggtggatcacgaggtcaggagatcaagaccatcctggctaacacggtgaaaccccatctttactaaaaatacaaaaaattaactgggcgtggtggcgggcgcttgtggtctcagctactcgggaggctgaggcaggagaatggcgtgaacccgggag

SEQ ID NO: 497975 - DNA, 120 bp, Homo sapiens
ggccctgggcctgcggcacctggtggtggtggacaaccgcaatcaggttgtcgggttggtgacctggaagtgatcatattttggatatattcggttaaataaaatcagcggttaggattc

SEQ ID NO: 497976 - DNA, 130 bp, Homo sapiens
gttactcaccgtatgtgacctcacgcggagcttacctcacccgtagctgtacctcacccgtagctgtacctcacccgtagctgtacctcacccgtagctgtacctcacccgtagctgtacctcacccgta

SEQ ID NO: 497977 - DNA, 587 bp, Homo sapiens
  misc_feature (7)..(7): n is a, c, g, or t
  misc_feature (333)..(333): n is a, c, g, or t
  misc_feature (342)..(342): n is a, c, g, or t
  misc_feature (366)..(367): n is a, c, g, or t
  misc_feature (369)..(369): n is a, c, g, or t
  misc_feature (378)..(378): n is a, c, g, or t
  misc_feature (383)..(383): n is a, c, g, or t
  misc_feature (390)..(390): n is a, c, g, or t
  misc_feature (405)..(405): n is a, c, g, or t
  misc_feature (427)..(427): n is a, c, g, or t
  misc_feature (461)..(461): n is a, c, g, or t
  misc_feature (501)..(501): n is a, c, g, or t
  misc_feature (506)..(506): n is a, c, g, or t
  misc_feature (511)..(511): n is a, c, g, or t
  misc_feature (556)..(556): n is a, c, g, or t
  misc_feature (560)..(560): n is a, c, g, or t
  misc_feature (563)..(563): n is a, c, g, or t
  misc_feature (567)..(567): n is a, c, g, or t
aaggagncaatgtctgtaagtctaaatcagactgtacaacagttacagcagttgcttcaggcggtaaaacacagctcacaaaggagaaagagcactacaggtggttagagtgaagtaattgggaaactgttcctttgaggataaaaaaggccttgtattatattttgcccaattaaagccttatttatgttttccccctttttactttgtcagaaaccctgaacagagttttgtcttttctaatccctgttagactactgatttaaagaaggaaaaaaaaagcccactctgtagaccccttcagagtttagttttataataaaaactgtttgnataattagncctttccattcctgaagataaacnngnaatcttttntcttnttttgcnccataaaattgttcngaagatcaaagtggtaaagccnatgtaaaatttaaccttttaatactgatgttggnccctgttttacttaaccttttgggaagtaactgcctttgncttcnactcnaaaaaacccttttttgttgctaatgtaatcggtttttgtaatggngtcngcnaatnaaaggatgcttttttttcca

SEQ ID NO: 497978 - DNA, 949 bp, Homo sapiens
  misc_feature (22)..(22): n is a, c, g, or t
  misc_feature (127)..(127): n is a, c, g, or t
  misc_feature (132)..(132): n is a, c, g, or t
  misc_feature (141)..(141): n is a, c, g, or t
  misc_feature (153)..(153): n is a, c, g, or t
  misc_feature (157)..(157): n is a, c, g, or t
  misc_feature (168)..(168): n is a, c, g, or t
  misc_feature (170)..(170): n is a, c, g, or t
  misc_feature (249)..(249): n is a, c, g, or t
  misc_feature (256)..(256): n is a, c, g, or t
  misc_feature (268)..(268): n is a, c, g, or t
  misc_feature (311)..(311): n is a, c, g, or t
  misc_feature (314)..(314): n is a, c, g, or t
  misc_feature (332)..(332): n is a, c, g, or t
  misc_feature (345)..(345): n is a, c, g, or t
  misc_feature (373)..(373): n is a, c, g, or t
  misc_feature (399)..(399): n is a, c, g, or t
  misc_feature (403)..(403): n is a, c, g, or t
  misc_feature (412)..(412): n is a, c, g, or t
  misc_feature (435)..(435): n is a, c, g, or t
  misc_feature (523)..(523): n is a, c, g, or t
  misc_feature (558)..(558): n is a, c, g, or t
  misc_feature (581)..(581): n is a, c, g, or t
  misc_feature (588)..(588): n is a, c, g, or t
  misc_feature (637)..(637): n is a, c, g, or t
  misc_feature (649)..(649): n is a, c, g, or t
  misc_feature (652)..(653): n is a, c, g, or t
  misc_feature (670)..(670): n is a, c, g, or t
  misc_feature (677)..(677): n is a, c, g, or t
  misc_feature (679)..(679): n is a, c, g, or t
  misc_feature (681)..(681): n is a, c, g, or t
  misc_feature (689)..(690): n is a, c, g, or t
  misc_feature (695)..(695): n is a, c, g, or t
  misc_feature (697)..(697): n is a, c, g, or t
  misc_feature (703)..(703): n is a, c, g, or t
  misc_feature (719)..(720): n is a, c, g, or t
  misc_feature (739)..(739): n is a, c, g, or t
  misc_feature (758)..(759): n is a, c, g, or t
  misc_feature (761)..(762): n is a, c, g, or t
  misc_feature (780)..(780): n is a, c, g, or t
  misc_feature (786)..(786): n is a, c, g, or t
  misc_feature (798)..(798): n is a, c, g, or t
  misc_feature (807)..(808): n is a, c, g, or t
  misc_feature (812)..(812): n is a, c, g, or t
  misc_feature (817)..(817): n is a, c, g, or t
  misc_feature (819)..(820): n is a, c, g, or t
  misc_feature (823)..(823): n is a, c, g, or t
  misc_feature (826)..(826): n is a, c, g, or t
  misc_feature (828)..(828): n is a, c, g, or t
  misc_feature (831)..(831): n is a, c, g, or t
  misc_feature (833)..(838): n is a, c, g, or t
  misc_feature (842)..(842): n is a, c, g, or t
  misc_feature (850)..(850): n is a, c, g, or t
  misc_feature (861)..(861): n is a, c, g, or t
  misc_feature (948)..(948): n is a, c, g, or t
tggatccgaagcagctgctgcncccatcccttccctggaacagtccattagagtgaagggggaaaaaaaaaataaagaaagaagataggaagtctgcagaatgcggccagagctgaaagaggatganttcantgaagaggnagcatttcaacnaggnttgagcgttcncntgctgggggggtgaggaagaagggaataaatgagcagagacatgggagtgggaggtgtctgggaaaaggaagaatagtngggaggnttccagaaagtnatgtgggaaatgcaggtagggaactggagtgcaaggataaggnatnaaaagtattggtggtttntgagcagtagagnagtgtgaggagtaggaagttaggaaggntaatggataggtggagagagaatggnaggnggaggaggnattataaggaggatgtgattttntaggtaggtgggaatggagtttgaatttggtgagagaagggaaaaaaagaagagaaggagggggtgtgttgacgcatccacgcacgcntacacgcgcagtacgcgcgactgttccactccagngtagacagcgtagcgaccccaangctctgngtcaaaggttcgtcgctgctcgctcggccctcgtcgctgacgtcttaanccctcgctcgcngtnngactgctcgtccgctcngacgggnangngcttcttnngcgtngngggggnaagggttcgccctcanncccacccccagacgctcgngccaccgacgacgtcgacnntnngacaaacctcgttcaggngtccancgagcacacacngagaagttnngtgntgtcnannggnagngngtnannnnnnccancaccaagngccttgcacanctgcgtacctgtcctcccacgttcccggctggtgctcccctcccaaagtcggcgtgggaggtgctcaatgaaggaacatttgcccanc

SEQ ID NO: 497979 - DNA, 157 bp, Homo sapiens
  misc_feature (11)..(11): n is a, c, g, or t
  misc_feature (48)..(48): n is a, c, g, or t
  misc_feature (130)..(130): n is a, c, g, or t
  misc_feature (141)..(141): n is a, c, g, or t
ctagtttaccncttagtgagcattgaggattagggttcagattacttncttaggctgacatggctggtaaggattggagttaggattgcaatctgggtctttgctatagccattattctttccagtatantttaggaaagntctcctgttgtgtcct

SEQ ID NO: 497980 - DNA, 498 bp, Homo sapiens
  misc_feature (250)..(250): n is a, c, g, or t
  misc_feature (395)..(395): n is a, c, g, or t
  misc_feature (422)..(422): n is a, c, g, or t
  misc_feature (442)..(442): n is a, c, g, or t
  misc_feature (448)..(448): n is a, c, g, or t
  misc_feature (481)..(481): n is a, c, g, or t
  misc_feature (487)..(487): n is a, c, g, or t
ggccagtgaagaaattaaggaaaatgaaaaatttcttgaaacacatgataatggaaacacaacatactaaaacctatgagatatagggaaagcagtactaatagggaggtttatagctctaaatgtctacatcaacaacaaaaaacccttcaaataaataacctaacaatgcatcttaaggaactagaaaggcaagagcaaaccaaatccaaaattaataatagaagaaaagaaataataaagttcaatnaaaaagtttttttaaaaagttaaacaaaattgataaacctttagtcagactgaggaaaaatagaggacctaaataaataaaatcagagatttaaaaggaggccgggctggtgggcttcacagtactttggggaggccaaagcggncggttcttttgaggtcaggggcttcangaccagcctgacccaggggntaaaantctggtccaatgttattccccgctaggccgggnggttgngggccggggga

SEQ ID NO: 497981 - DNA, 707 bp, Homo sapiens
tctctctcgtggtgttccgctccgcagtgggccaagtttgaattgatgctgcccggggctcgtgccaaatccgtgaaaggcttccccttcctgtgccccaccggggttccgtgtgctgggcttcctgtgcccctttccgtgctttggcagccagggggttcaggagggtggctcgggttgtgggctggagaggcagaagccctttccgtgtgggtgtcccagcacatgtggagcccttgggctgagcaccaagacctttgaaccttttgggtttaaccttttttccaaattaacagtggggagaaattttcaggtgaaattcggggggtgggggtggggttgaaagggtgggggtgggagatttggaggagtatgaatcagggctgggagttgggtaaaaactttccggtgatatccttcttaaccacgttggctgatggtggggataggtatgaggggaaggaagtggagttagcctatgtgaaagggggtccatagtggagctcggtagataaatgcctgttaacagaggtgggtgggagaccgtgggtgtcgataaagaaattcaatcggatagaaggagtgcaaaagggtcctatagttgggaaagctagtgagaattcaatttatcattgaaaagttatgtcttaaataagattggtgtggaaaagggaatgaagtgtggaaaaaggagtcggagagttgga

SEQ ID NO: 497982 - DNA, 102 bp, Homo sapiens
  misc_feature (1)..(1): n is a, c, g, or t
  misc_feature (53)..(53): n is a, c, g, or t
ncggggactgcgcggcggtgcagagccgggcgtgggcgagaacgaacgggctncctgcggctgagagcgtcgagtgtcaccatgggtatcacgcttggagct

SEQ ID NO: 497983 - DNA, 284 bp, Homo sapiens
atactgaggagtgactttctgaactgaaaactgagctactagcatgatctggatcgcgcaaatcctgaggagagctgtagtatgcctcaagagtgaagggtttcttcctattatatgtgggacctttaggagaaaggagcagcatgatcttggggaaagacttcacagtcccttggacccttcttcagctgagaattccatcgtcagagattttggatacgtactacatcagttatagaaaatctctgacttttaaagctggctataagatggctcacgcaatt

SEQ ID NO: 497984 - DNA, 337 bp, Homo sapiens
  misc_feature (47)..(48): n is a, c, g, or t
agcccctccagccttagcggccccctttggttgggaaaagaagattnngaaaaacccaaagttttggcctgggaagtcccccctcggggcctggggtggcccgttcaaaaaagttttaacaggggggagggttaaggggaaaagggcccccccctgttctttagtttaggcgtgaccccctcccattcttggggttttgacccttttttccaaggggggccccccccaatggggggcccccgggttttttttcccccccccccccccctccccctggggtttaattttgttaaggtggggggggaaaaaaaaaaaaaagggattttttgccccggga

SEQ ID NO: 497985 - DNA, 212 bp, Homo sapiens
acctaatcgcactactgactggtcaagaggaaatgacgccattcttccataacttactatctactacaataaaatggcaggaatatcacagtaatacaactaatggtagagatcctttgaggaccagaataactcatctgaggtaaattaactgataagtcactgaacccatgatagaacccaggttcatttgttatataacctgtttgttc

SEQ ID NO: 497986 - DNA, 891 bp, Homo sapiens
tggaaatagtgtttggctctgttgcccgggctggagtgcaggggcatgatctgggctcgctggggcctccacctctcccgggctcaggcaattccctcctgtgccccagccctcccgggatagcgtgggatttacaggcgttgcacaacgtgcatgtgcacaacctaatttttgtgtattttatagataaagacagggttttcgccatgtgttgtggccaagcgtggctcttcaaactctcctgtgggccctcaaggtgactccgcccaccttacagcctctcccaaacagtgttggggatttttaggcattaaggccaccagagtgcccagagcccagagatattcaccaatattcttttgtgggctcgtgcaagtgtgtaagaaggcacttcaacagaatatgaaatatatggtagccctcactctcaaacacgtgcgagacaaaacaccacacatatttattctcccaggtgttccccacaaatctccagtgtgggaagaaagattaacgacacaagtgattatttacacactcgtgaatgtggtcgggtgtgcaaaaacaaacctttcaaaagttatattacaccttaaatgctggcccgaggggcaaacactctgtgtgtcacacaaactccaccacaagtgggttgaaaaaccattacacgaggtgggcgccaagggtattttgacgaagaaaaaaaccaagcgcacgcagacgaacttttaacttaggggaataatatacagaaccaagcaggttataaacaggcgaacaaataaaattccgtggggtcaacgaaccttaacaggatacaacatacatgttagaaaacacaagaactgtggatgtggaaatacttccttggagaaaatctatcaaaagaggttt

SEQ ID NO: 497987 - DNA, 148 bp, Homo sapiens
tggccctcgctgctccagatcaagtgatcctcccacttcagcctctcgtgtagccaggactacaggagcatgccacagtgcccggctcattttttttttttcttgggtgaaaatggggttcacaccatgtgggaccagccataagatc

SEQ ID NO: 497988 - DNA, 121 bp, Homo sapiens
attcgggccgagatgtcttgctccgtggccttagctgtgctcgcgctactctctctttctgggcttgaggctattcaggcgtacttccaaggtttaaggttaattaacgtactcacagaca

SEQ ID NO: 497989 - DNA, 692 bp, Homo sapiens
agcggaggacgctcagaggattctgacaatatcttaccggagaagaggcaaagtacgctcaaagccgaagccacagctcctcctgccgcatttctttcctgcttgcgaattccaagctgttaaatacagatgtgcaaagggcttgcaggtctgccggcttcttgcttgaggacgtgcaaaacgatatgaaacatcggctaggtttcctgctgcaaaaatctgattcctgtgaacacaattcttcccacaacaagaaggacaaagctggttactctgccagagagtgagccaacgagcgaagtcaagaaatgggctgaactcactggcaaaacctcgattacgtcatgcaatgtgcggctggccagcctttcaaagccttctcttgcaaggtctgacatactaggtgcaggcagcaatcactcgacttctggcatcagctgtgcaagagtacaagacaatcaaatcaccatctaaactaagtcccaaggccaaacaacgatctatacatgaacttcatctcagtccaggcaaccacaagaggtgacacctggattcttgcaccagggcaacgtgacaagccggcacatgctacgagcctacaataacctggctttgatgaggcccatgaagacgattttcaacctgatggacaagggattcctaccgccgcttcctcaagtctcgattctatc

SEQ ID NO: 497990 - DNA, 158 bp, Homo sapiens
cccttaactgaataaattttttttttaaattggctgggccccatgtttgacgcctgaaatctgtaatcccagccctttgggaggctgaggtgggaggattgcttgagccctggagttcaagaccagcccaggcgacatagtgagcccccctttttgta

SEQ ID NO: 497991 - DNA, 101 bp, Homo sapiens
ccgaggtgaagttggggtagtagaaggctttggctgagagaaggaacgtgggttgaactcctttgcattgggattcaatgttgatttcctaacttgctcag

SEQ ID NO: 497992 - DNA, 357 bp, Homo sapiens
  misc_feature (317)..(317): n is a, c, g, or t
  misc_feature (329)..(329): n is a, c, g, or t
  misc_feature (342)..(342): n is a, c, g, or t
acgttgacacttcagtacaagtttaaaaattttagcagaatgatcatagggaaaaacagaccaggcaggatgtttcacccctgtaattccagtactctaggaggccgaggcagatgaatcatttgaggcaagaaacttgagaccagcctggcccacatggcaaaaccctgtctctactgcaaatacaaaaattaactgggcatggtagcacatgcctgtggtcccagctactcaggaggttgagacagaagaatcgcttcaacccgggtggtggaggttgcagtgagccgagattgccccactgcatttcagcctgngcgacagagcangacaccatctcanaaaaaaaaataagta

SEQ ID NO: 497993 - DNA, 151 bp, Homo sapiens
ttgaagggcagagctacaaaacattgtatatttcaaaagacaaaagaagcagcagcagtatcttgttctctaattcatagacaagttgactgtgtttgtggtactttgggtttttaaacactttggggtactaatccctagacattgcctt

SEQ ID NO: 497994 - DNA, 462 bp, Homo sapiens
  misc_feature (47)..(47): n is a, c, g, or t
agcgggaggggccccccgatcatcgagacggcggggtggtgggctanaccagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataaggtaggaactgtggcgaaacagggacaagccgccatcttggtaaaggagaagaggctacgcttgacctccccccccacccccagcctctatatggccaactgccgtgggaggagcacggcgcttg

SEQ ID NO: 497995 - DNA, 754 bp, Homo sapiens
gtgcctcaccttcagaaccaagcctcgtgaagatgacctcttccacgccacgaaatggctccagccgtcccactctccgtgtgacgcaagaaaaacacggtgaaacgcgctaggatcgcgccctccctggtagtcagaaggagcgagtgagagagacacaaccacctggccgggccaaaactgggccaaatgaacaacgggagcacttagtgatgccagaaggacgtggagccaactgagcggagaccggcctctccctaggaacagcgagccggggacctgacgccccaacacgaaccactaatgactttgaggacccaagggcagccaccgtacacctccattcctcgtgctttacctccccatgacaaagaccatgaaagagtcatctcctgatgcggcgttctccggtgcggcccatcatcctcttcatacatcctcatcatcaatgctgctgttcctggccatcttcattacgccttctcgaactatgctggaccatgaagctggtgaagcccttcagctgaggactctcctgacctgtagaagggaccgtggggtcccctcccagcatgggactggcctgcactcctaccgcccagctcgcgagctcctccagacctcctaggcctgattgtccttgccagggtagtccagacagacagcctcggaccggccacactcccagaattgctaacatggagctctgagatcaccccacttccatcaattactgctgcccccaaccctacgt

SEQ ID NO: 497996 - DNA, 1412 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 497997 - DNA, 288 bp, Homo sapiens
aacttcgaggattcgaaccatgacctcctaccacaaaagccctacgactggaaggcgttgttcctcgtggcgctggccgaagtgccagtgatcgcccacgcctgcaaagcggcgggcgtgaaccgcgtgaccgcctggcgcgcccgcgaggccgacccggagttcgccaaggcctgggacgacgcgatggaggagggcgtcgaccgcgccgagcaggaggccttccgccgggccgtggtgggctatgagaagcccgtttggtacaagggcgtgccggtgggcacggag

SEQ ID NO: 497998 - DNA, 1627 bp, Homo sapiens
  misc_feature (47)..(47): n is a, c, g, or t
agcgggaggggccccccgatcatcgagacggcggggtggtgggctanaccagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 497999 - DNA, 1727 bp, Homo sapiens
  misc_feature (47)..(47): n is a, c, g, or t
agcgggaggggccccccgatcatcgagacggcggggtggtgggctanaccagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagcatacagaaactgctgtaaaagaagaagttgtgggtatttttttttttttttggtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498000 - DNA, 158 bp, Homo sapiens
aaataaaatgactcgtatgaaattataaaaattgaaataatagattatttttaaaaaaatttagttgataacatgaaattttcatacctacaaactaaacagttctttttttagcaattcaaatgtccattttataattaaatgaaattaataatgtg

SEQ ID NO: 498001 - DNA, 156 bp, Homo sapiens
gggttagctcggagtgtgcatgttggtcctcggcgtgtgcagcaacaacttcgttcatagagacttgacttcaagaagtgtgggcactcgagcgtgtgcaacacgccgatataaccaaaccacatgagctaaagatcggagtgaacgaagttgttg

SEQ ID NO: 498002 - DNA, 1625 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggaggactggccagcccccaaacctccaagcccatcggctggatgccgtggataagcgaggggagagcgactaggccctgtctgcgggtaccttcggcgaggagaggcgacgaagcatacagaaactgctgtaaaagaagaagttgtgggtatttttttttttttttggtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498003 - DNA, 1670 bp, Homo sapiens
  misc_feature (47)..(47): n is a, c, g, or t
agcgggaggggccccccgatcatcgagacggcggggtggtgggctanaccagtttcgcgcggccgctcgccgtcccccgcccagtcgtactcggcgccccagctcggtgctgccgccatcttcttggaggacaggaggagaggcgaaggctccccctccccgtgatcgctccgcactccttctaacaaacggccttccccccactccagttacccaccgcaaggcgaagattctcattacctgttccactcttataagcataagaaaaccgagctcataagcatacagaaactgctgtaaaagaagaagttgtgggtatttttttttttttttggtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498004 - DNA, 133 bp, Homo sapiens
attcagcaaaactgagccattggagaggggtcctcgcctcggttttttagtttaacccctatgaagaattctgacgactccacagagagacacacagacacacatactttcctggttaatgactccggacgtc

SEQ ID NO: 498005 - DNA, 4276 bp, Homo sapiens
ggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaacccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccatgttggccaggctggtcttgaactcctgacctcaagtggtctgcctacctcggcctcccaaagtgctggaattacaggcgtgagcatcacgtctggcctaatttttttaatcgaatttatttttgtaatgatagatgcttgtcttattcctagggaaatatttgaagtaattgagatgctgtcacctaaaataatcaaaaggctcctgattcagttaaaagaattcatttaagtacagagtgtaagcgagctacaccaaagaatggtgattagcgctcccagggtggggaaaaatgaggattgtttatataggcaaaatggaggtgccaaacagaattataacattttcggaactaaggctcatttaaagatacaaatttgattggctactattgattacacttgaagggatttgtttaacttccttttgtaaagaagtaacagtcataaggatctctcatctcccagtcatttagtctagttttgaataaagaatagggggtctggttaatatatacatctaaacacaaaagtcagaaagaataaaagtagtgatgttacacgagccagctgtcagtgcttaacttttccctttggcctaatgcatttggaaggtcctgaaattgtattttctttttacattgcctatgtatgtgtaagtcttcttcaggtcagttcacgctgttaaatatacgtgcgtatacatacatactatgtatgtgcgtttatgtgtgtctgtgtgttttttttttaacagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498006 - DNA, 245 bp, Homo sapiens
  misc_feature (62)..(62): n is a, c, g, or t
gacagtgagggtaataatgactgtgtgggttgattgtagatattggggctgttaattgtcantgtacagtgttttaattctggacgcagagcttatgccggaggcagaattgttttcatggttacttaatatctaacattatgttctatctatagggtagatagattgggctccaattgggttgtgagcgagttcacgttatatgttgtgggattttttacggtagtagggtgttgacgcttgaa

SEQ ID NO: 498007 - DNA, 3210 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggaggactggccagcccccaaacctccaagcccatcggctggatgccgtggataagcgaggggagagcgactaggccctgtctgcgggtaccttcggcgaggagaggcgacgaagcatacagaaactgctgtaaaagaagaagttgtgggtatttttttttttttttggtctggaggaatggggacaccaaaactcatttggcagcagaggtgagacgaagcttcacaaaagatgtctaagacgggagtcttgttctgtcaccaggctggagtgcagtggcatgatctcagctcactgcaacttctgcctcccacgttcaagcgattcccctggctcagcctccggagtagctgggactgcagacacgtgccaccacgctggctaattttttggattttagtaaattcggggtttcaccgtgttggccaggatggccttgatctgttgacctcgtgatccacccgctttggccccccgaagtgttgggattacaggtgtgagccaccgtgcctggcctaattgtcatcttaaaagcttggagctttctcttttttcaggcttctactttcttttctctacacacatcagtaacagtccttttggcccccttagttcattcccagcagaccagataatttagaattctgataatttattatgatgaaattgatggggctcttagacttgataaattggtttaaatcagcctttgcaagttagttcagagataaattagtgctaaagaacatattctgagaaaagcagaacttgtggttaacattgcaagattattatttctgttttttttttatctttgaatcctgtgggtgttcattactgtccaatgcaaaatcatcataccagtttttgcattttataccagtgttagcatggaacacagataagcaaaaaaaaaaagtcattatttcaccactcaggaataaccactgttaatatgttacatatattctttttcacctgtgtgtgcatttgactatacatttacaaaatgtaatcctaaaggaaatactattttgtatcttgcctttttcaattaataaattgatttttaaaatttcttctcattttcagtatgccactgtctagattctggttacttctgctattcttgccttctcatatctctgtcctctctctcatcagatacccttctgtcaaggaatattgatgcttcagtgtagtcatctatgatcttctcattctgtcttttctttcttggtctttgacactagatactcaacatcccacccctaatttgcctgcctcacccttgatgaaactctgttctatagagctagaagcacagcaagagagatgcttttttcctcgatacttttcagaaatgcattgcacctaatacctgggagaagctattctttagccaagtttgttgaatgaaaccattcattcaaagtactgtcagctgtagcagtactttgtaagcttgactgattttcctggaactccatagtctctcaagtcgaaatttgaaattgcattaagatgtattaagcatgtatcttctatgtattgttaaattcctaaacagaatactgattaacaaaatgttaattttcagtcgcatacaactaaggagttatactagataagtttttctttttttaatgctcctagttgaatactactggttttctgatagaagtatgactttctggaagtgtttatactttttaaaaaatttgtgaaaactgataacctatgtttgtttcatgtctaactgattatatcttaaaagcaactactaaggtgtttattagtttgtttgttttttaatcttatttagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498008 - DNA, 150 bp, Homo sapiens
tgatgatgaatagcccaactccaaaacaattctgatgaaacaaaatcacagcacccacctaccatacaggcaggcacaaggggggcaggcaaggcaattctgccccaaacccaggccaggctcctttccctttttccatcatctcttttt

SEQ ID NO: 498009 - DNA, 1982 bp, Homo sapiens
  misc_feature (47)..(47): n is a, c, g, or t
agcgggaggggccccccgatcatcgagacggcggggtggtgggctanaccagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagcatacagaaactgctgtaaaagaagaagttgtgggtatttttttttttttttggtctggaggaatggggacaccaaaactcatttggcagcagaggtgaggacgaagcttcacaaaagatgtctaagacgggagtcttgttctgtcaccaggctggagtgcagtggcatgatctcagctcactgcaacttctgcctcccacgttcaagcgattcccctggctcagcctccggagtagctgggactgcagacacgtgccaccacgctggctaattttttggattttagtaaattcggggtttcaccgtgttggccaggatggccttgatctgttgacctcgtgatccacccgctttggccccccgaagtgttgggattacagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498010 - DNA, 2235 bp, Homo sapiens
gttggcgtcgtgcgaggccacgcccggggactagtaacttttcactttgtaaagtactttgaaatgctggaaaatatttcaagaactagtggagagaactctagcacaatccatagttgatttctctggcctttccccctattttctcccagatttgttgtgctgttcacagatgacctgggccacatttcccagtggagctccatcatggctgggagtctcgcaggcatggtttccaccattgtaacatatcctacagacctcatcaaaaccatttgttgtgctgttcacagatgacctgggccacatttcccagtggagctccatcatggctgggagtctcgcaggcatggtttccaccattgtaacatatcctacagacctcatcaaaacccggttgatcatgcagaacatactggaaccatcgtacagggggctcctccatgctttttctactatttaccaacaggaagggttccttgccctttatcgaggggtttccctcactgttgtagggattttagcaaccccagagcccctcctgttttctttccccggaatccccccaggaatttatgttctcaagccagtgttttcccaagacagcagcagcttctccctggccttgttttgcaggtgctctcccgttctctgctggctcccttcttgtttacatgaacctggagaagtgctctcccgttctctgctggctcccttcttgtttacatgaacctggagaaaatctggaacggaccccgagatcagttctctctcccacagaactttgctaatgtctgtctggctgctgcagtgacccagaccctctcctttccctttgagaccgtgaagagaaagatgcaggccatcatcttggccaggaacccagcatccagaatgtagacttgagaccctggctccttccactaggacatttatttcctaatgtttcaatcacctcatcccagcttctgtttcctgtcaggctcagagcccctagctcagagcccctacctcccacacagtggaggagtagatgtccatttctcaggagcagtggactgcttccggcagatagtgaaggcccagggggtcctggggctctggaatggattgacagccaatttactgaagtgtattgccaccgccattatctcactttacaagataatttaccctgatccaagttgactgcagacacattgatgttttctttttaagaacttaacttgattttcatttttggttttaacagatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgaatagttccatattttggaattatgtttagcacctttgagttctgcaagagaatctgtctttatcaaaatggttacattctgtctccactgagctataaattgaccccaggagtcgatcagagtttgcagccccaggaattacgagaattaaagaagttcttcaaaacgagaaaaccgaagcctaaaaaaccaactctataaaatggaatggaactagaagtgcactgactgacagcatgttgcaatcacagataaatgtagcctcataactgtgcacctgaggagggatgagaagctactgctatctgctgctctgggaaatgagatggtttggccatgcaccacctcagatctccaaactgatgtccctgtgaacacctgcactatgagaaggtttcccaacaagagtgtatcatgatggcattccacgagattttataaccagagtctagcagtgataaaatgtacaatttacgctctgaatagaaacatgacaccaaagaaagggcattgccatgacatctcaaagcaacaggtaattgaagtggctga

SEQ ID NO: 498011 - DNA, 3461 bp, Homo sapiens
  misc_feature (47)..(47): n is a, c, g, or t
agcgggaggggccccccgatcatcgagacggcggggtggtgggctanaccagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagggcttggaatagttaaatgactttggtcttgtccaaggttagatggagttcaactctaacgtcaagtcttggtccttttcattgacgaagcttcacaaaagatgtctaaggtaagatcatacttcatgtatctacagcataaggagaaattgctttatgttttcagactgttgacagtcgggacttatatgattcattatttttaatacaactgatacatttgattcattaacacaaagagttctaatttagttgtctttttttttttttttgagacgggagtcttgttctgtcaccaggctggagtgcagtggcatgatctcagctcactgcaacttctgcctcccacgttcaagcgattcccctggctcagcctccggagtagctgggactgcagacacgtgccaccacgctggctaattttttggattttagtaaattcggggtttcaccgtgttggccaggatggccttgatctgttgacctcgtgatccacccgctttggccccccgaagtgttgggattacaggtgtgagccaccgtgcctggcctaattgtcatcttaaaagcttggagctttctcttttttcaggcttctactttcttttctctacacacatcagtaacagtccttttggcccccttagttcattcccagcagaccagataatttagaattctgataatttattatgatgaaattgatggggctcttagacttgataaattggtttaaatcagcctttgcaagttagttcagagataaattagtgctaaagaacatattctgagaaaagcagaacttgtggttaacattgcaagattattatttctgttttttttttatctttgaatcctgtgggtgttcattactgtccaatgcaaaatcatcataccagtttttgcattttataccagtgttagcatggaacacagataagcaaaaaaaaaaagtcattatttcaccactcaggaataaccactgttaatatgttacatatattctttttcacctgtgtgtgcatttgactatacatttacaaaatgtaatcctaaaggaaatactattttgtatcttgcctttttcaattaataaattgatttttaaaatttcttctcattttcagtatgccactgtctagattctggttacttctgctattcttgccttctcatatctctgtcctctctctcatcagatacccttctgtcaaggaatattgatgcttcagtgtagtcatctatgatcttctcattctgtcttttctttcttggtctttgacactagatactcaacatcccacccctaatttgcctgcctcacccttgatgaaactctgttctatagagctagaagcacagcaagagagatgcttttttcctcgatacttttcagaaatgcattgcacctaatacctgggagaagctattctttagccaagtttgttgaatgaaaccattcattcaaagtactgtcagctgtagcagtactttgtaagcttgactgattttcctggaactccatagtctctcaagtcgaaatttgaaattgcattaagatgtattaagcatgtatcttctatgtattgttaaattcctaaacagaatactgattaacaaaatgttaattttcagtcgcatacaactaaggagttatactagataagtttttctttttttaatgctcctagttgaatactactggttttctgatagaagtatgactttctggaagtgtttatactttttaaaaaatttgtgaaaactgataacctatgtttgtttcatgtctaactgattatatcttaaaagcaactactaaggtgtttattagtttgtttgttttttaatcttatttagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498012 - DNA, 1041 bp, Homo sapiens
atttaaccatctcacttctaggaatactagtatatcgctcacacctcatatcctccctactatgcctagaaggaataatactatcgctgttcattatagctactctcagttaacccgtcaacacccgactccctcttagccaatatgtgcctatgccatactagtctttgccgcctgcgaagcagcggtgggcctagccctactagtctcaatctccaacacatatggcctagactacgtacataacctaaacctacgtccaatgctaaaactaagtcgtcccaacaattatattactaccactgacatgactttccaaaaaacacataatttgaatcaacgacaaccaccacaggctaattattagcgatcatccctctactattttttaaccaaatcaacaacaacctatttagctgttccccaacttttcctccgatgcccgctaaaagaccccctccataagtactatatcataggcgtgactccctacctcctcacgaatcatggtaaggccaatcgccatttatccgagtgaaccactatcacgaagaaaaactctaacctcctctatacgtaatctccctacaaatctcctttaatttattaaccattcccaggcaacagaactaaattcatattgaatattttttttgaaacgacacttaattctcaaccgttggggtatcaatcaagccggatgaagacaacaaggcaggaaggcttgaaggccaggacaacatatcttcctatttgttacgccctgatagggatccgtttccgaataaatcgccgtggattagctcacaaaaaccctgggccccgaaaagcacgctagaccgacctcagtgcccgaagcattaaaccctgtcgcagcagaaaatgtatgcaggtcaccacaggtgttatgtagaggagaacctctccggcgcgtagtagaccaccagagagaacgcaccacgggtgagatacggcgccagcacaaacgccggtggctgcaccacacctcacccagcaagacaccgcgggcattgagacaga

SEQ ID NO: 498013 - DNA, 114 bp, Homo sapiens
  misc_feature (41)..(41): n is a, c, g, or t
  misc_feature (72)..(72): n is a, c, g, or t
  misc_feature (84)..(84): n is a, c, g, or t
cacctcacatcgaggaatacagatgtacgagtccaatggcntacaccatggtctactggcatgcactggacntctggagatgcntcccagtacaggctgtgtttgcccggggaa

SEQ ID NO: 498014 - DNA, 951 bp, Homo sapiens
tgcacgaggagcagcggcggcgagcgcctcggagcggcggcggaacagcgccccccgagcccgtgcccccgacgggtccgcctgaccagcacgcactacccgaggagcgtcggccgggcccagtgagggcgagcactccgcaacaatttggcatccggccgagcgaatctcggctgtagctctacgggtgctcgcgcagcgatcagtacacgccagaggcccggcagcatcagctgccagtcaccgcagacaccacgacgccaccaagggctcagctagacacccgtggaatacaaagcagggctcaggaactcaacgccctcccgcgcagtaaagacccaagaacatacaactagacctatagacaaaaaaatctcacgaagacaccagaacagacctagcgaaacgtggccaatagacaatagtcctccaagcaacaagtagactcagagacccacaacaccggcaacacagacaacacacagctagagccataggaccgtaaaaccacaacaagaaaaaaacaaacaacagacgacacaacaagaaaagccccacgaacgcccataacgggagacacagcgacacacaccctaaaaatgctggacaccaaagaacaaaaaaaacacccgctagcacagataaacagaacacaaaacaaaatgacacagctaaataaacacatacagaacgaagaaaacacacacaaatacaccttaattataccacacaaaagagaaacagcaccagcagacaaaggaaacaacacacaacacacacaacaccacagcaagaacccccccaatcacaacgagcaccacaacgcacaaaaacaccacaaccaacaagaacccaacacaaacaccaacgagtaccacagacacccagtgccgacccgaccgtacaaccacaataagataaaacagccacaacctcacaatcaagaaacaa

SEQ ID NO: 498015 - DNA, 682 bp, Homo sapiens
  misc_feature (105)..(105): n is a, c, g, or t
  misc_feature (190)..(190): n is a, c, g, or t
  misc_feature (260)..(260): n is a, c, g, or t
  misc_feature (273)..(273): n is a, c, g, or t
  misc_feature (323)..(323): n is a, c, g, or t
  misc_feature (682)..(682): n is a, c, g, or t
ggtctgttagtgggcagatccttgcttgccgtcccttcgcctccttcaccgccgcagaccccttcaagttctagtcatgcgtgagtgcatctccatccacgttgngccaggctggtgtccagattggcaatgcctgctgggagctctactgcctggaacacggcatccagcccgatggccagatgccaangtgacaagaccattgggggagcgagatgattccttcaacaccttcttcaggtgaaacgggtgctggcaangcactgtgccccnggagcacgtgctctgtacgaccttggaacccacagctcatttgatgaagnttcgcactggcaccttaccgccaggcgtcttccaccctggagacagctcatcgacaggcaaggaagtatgctgccaataactatgcccgagggcgactacaccattggccaaggagatcattgacctcgtgtaggaccgaattcagccaagctgtcctgaccaagtgcaccgagtctccagggacttcttggattgatccacacgctttgcgtggtgcggaactcggttctgcgttcacctcgctgtctcatggaacgtctctcagtcagaggtatggcaagaaagtcccaagctggagttctctatatacccggcgccccgggtttccacagctgtagttgaggcctacaactccctn

SEQ ID NO: 498016 - DNA, 248 bp, Homo sapiens
cgcggccgggccaccgacagtttctcgggcaggtttgaagacgtctaccagactgcaggaagatagtgctgggggagggcgctcatgccccgagtgcagaccttgcatcaaacctgatcaccagccaggagtacgccgtcaagatcattgagaagcagccaggccacattcgtaagcagggttttcagggaaggtggaagatagctgtaccaggtgcccaggggacacagggaaacgtcctagcagct

SEQ ID NO: 498017 - DNA, 251 bp, Homo sapiens
tcacacgaatgtaggctcttcttctcctagctctacacaatcgactggtgctggactcttttctatactcacacggactggtgttgtcgcttgtcctcagtcctagcttcatacaacactgggtcctggaatcctgtctgctgctgtctacctagattcactgaatccacttctgtgtagcaccctgggtcagctgtcaattaatgctagtcctcaggatttaaaaaataatcttggtacccgaccgtcgg

SEQ ID NO: 498018 - DNA, 294 bp, Homo sapiens
  misc_feature (148)..(148): n is a, c, g, or t
  misc_feature (277)..(277): n is a, c, g, or t
cggtaaaggctgcagtgcaattcccagagtcaaatggagaacaacctagagttttgatgctcaagggcagcagaagggtgtgctactccaaaagagagaaagatataattgacccttctacccttttttgtttaataatgagcccttnagccaatatggatggtagtttgcccgatgttgacgggtggacatttcccacactgtagttgacatggctcacgataccagtttcttctccaagaaacacccgttacagtacacaattccagaaacaatngttttatatagtcatct

SEQ ID NO: 498019 - DNA, 232 bp, Homo sapiens
cagcagcctcccccgttgaccctcgttcgagtcgttcccctgcgctttccgcacgcgcgcgctcgagcgcacgagaaaggaatcgtatgtatttcgtatcaaactccatcacgacgcttgtgatgagtagtgatgactgttctgctgctgagtatatccatataattcaagacggcgaagacttactactgtcaggatctgatgatacataagactagtggaagcgttaaaa

SEQ ID NO: 498020 - DNA, 350 bp, Homo sapiens
agatccacaagaactgacagactcaaacagatacttgtatgccagtaccattattcaaaatagacaaaaggcagaaataacccaaatgtccagcaacagaggacttgataaataaagtgaggtggctatataatacagtggaatatcattggtgcctaaaaaggaagttctgaggcatgatacaacatatggataatccttaaaaacactatactatgtgaagtaagccagacacaaaaggacagatatattattccacttaaatctagaataggcaaattcatagagacagtaaattagtgattaccaggggatgaggggagatgagaatgaggagtaatagcttaagc

SEQ ID NO: 498021 - DNA, 197 bp, Homo sapiens
ccttcatgagcgagtgcacggaggaagccgatgatgggccagacaagggcaaggacgcggaggccgctgaggccacggcctatggggcgctcaaggcagagaataatgagggcgggagcggcagggccaccactgccaagagctcgggcacccgacaggacagcgactccagcgctacctgcagtgcaaaccaggtg

SEQ ID NO: 498022 - DNA, 869 bp, Homo sapiens
cgcagtggctcacgcctgtaatcccaacactttgggaggccgaggtgggtggatcacctgaggtcaggagctcgagaccagcctggccaacatggtgaagccccatctctatcaaaaatacaaaaatttagctgggcgtggtggtgggcacctgtaatcccaggtatttgggaggctgaggcaggagaatcccttgaacccaggaggcaaaggttgcagttagctgagatcgcaccactgcactccagcctgggcaacaagagcgaaactccgtctcaaaaaaaaaaaaaccctattgtaaaccatggccttgggggggtaaagatgtctgaatgtaggtccatcaagttttaacaaattgtaccactttacggggcgggatataatatatctggactaataatatacctggagaaatccttcattctcggatagtcgtagcaaatcacaactcgtgaacttaatgtttactacaagaggctaaggtgcatcgaagatcctctttaaagagaactatctaacggcccaaacgtggattcacagtacccggggaccttccgacatcctaaaggggtcaagttccacaaatttggattcccctagagaaacgggtataaaagcagcttaacctggcgacacatttcctacgaccagacaccaaaaggctaacgggacaatgcgccaacttttaaggataaccaaaactggaacccagcggcagacgcaaatatactataggacttttaacccttggaacacggctaaaggggatacttcatgccgggggtagggggctcaaaacacctttggccatagaaagcctggataggtttattgacattacacatcatagattcaacgtgagaacc

SEQ ID NO: 498023 - DNA, 404 bp, Homo sapiens
  misc_feature (404)..(404): n is a, c, g, or t
agcaccggcccgaccttagctctcaccatcgctcttctactatgagcccccctccccagacccaaccccctgggcaagctcagcctaggcctactatatattctagccacctctagcctagccgttcactcaatcctctgagcagggtgagcatcacactcacactacgccctgatcggcgcactgcgagcagtagcccacacaataccatatgaagtcacgctagccatcattctactatcaacagtactaataagtggctccttgagcctgtgcacccttatcacaacacagagaacacctctgattactcctgtcatcatgaccgttgcacataccatgagttatctacgcactagcggagaccaaccgaacccactgcgaccttgccgaagggggctcgn

SEQ ID NO: 498024 - DNA, 598 bp, Homo sapiens
gccaccctctgagttttcccgcgcccaccacaatttttcatatgctgcgccgcggactatatcctccctacatgtgtgcgctcggccaaatccccatgttgcgagcacctctcaactggctcctcataaactcttcttgttccaaggacactcacaaatcgttggtccccccaccaaaaagaccgtctttttgtgaaacttttttacgcaagctgctccgctatacttgcgcccttccccccccccgttttcatactccttgggaactactttctctggctaataaaactactctttttctctcgtcccacaatacagcctcttctcccctattaaccaagaggctgtccatcaacaattctgttgtccacgctctcataatattccttcttatacacaattttaccacccaaaacacccaattggcggcgtcacacttcaccaccacccccctcacgcttgcacatcatatgcaaacccccctcctttcccaccgcgagaaaccaccctcactgggtttcactaaatcctctttccccccttttctccttttcccccacccccgaaacctttcccgggtttttcccgaaaaaaaaaa

SEQ ID NO: 498025 - DNA, 727 bp, Homo sapiens
gtctcacacgagtttatttgtgataaacatctcagcaatcagcaagcccacgagctatagtgttcttccgagtctatgtgggcaaaacaaaagcatattagagcaggccacacccaaaagatatattcccatagattaaaaaaacacacacactataatattacaaaaatatatttaattaaaaatatcttataacacgagtatctattagagcatatactttctcacacatatagcacatctctatatacacatggtatgaaatgtcactcatttatctacacaatatgtcacattcttgcagagaaaagagagttctctgccccgttatcatcatctattttacactatatatgtaaaaaaaatatatctacaatgctctggtagattagtagagcttcaacacaaaaattgagctctttggtcacagagtaggcttctagagtcggatctactcgagatcttctatttatcagtcgtgtcacacttgagcttaagagtttatctgcacctccaaaacacacagatatgtactattcacagcagttataaatgaagagacaaaagagaatgcgtatgtaggatgtttatgaacgtgcaaagaaagaatgaaagttgtattcttctttcctctctctctcttggaatgacgaatgacgacgtttgtaggttggccgatgttttttcctttcctccggtggctttttttctctaacttctgctcttc

SEQ ID NO: 498026 - DNA, 390 bp, Homo sapiens
cttggccttcaaagtaccagtgtctctcatattgggttttaatgattcctcgggattataagtaagttgaatggcttttaccacctgtttgacttctaatgtttggtttccaccttaatgtaagatttcttccaaagcctgtagacccttgtacacttgtggtttgataagtagccaggaattctgcaatgccccaggtagtgtggccaatacctcggatctctttcatataagatccaccagttgtctgtgtgtaccacacatatgctacacatgttgaagagagaatataagagagcatagatgtagagattttatattccgggtgcgcgaggcacctctcatgatgtctgagtgcgcagagctgcgcgcgtgccgttttcctacagc

SEQ ID NO: 498027 - DNA, 212 bp, Homo sapiens
  misc_feature (65)..(65): n is a, c, g, or t
tgaaatcaagacatcacacatttgggggcttctgaaccctgctgcatgtgcattcaaaaagcagncggggtacttctcccaggccccaagagaggcttcgaatcctactctgaccactgtaatagaccactctgtgcacagacatgtggaacattactgacttcctacagtttaacatatactgataacatggggggtgaatattggtaaaa

SEQ ID NO: 498028 - DNA, 853 bp, Homo sapiens
ggggagggggggggtggaggggaggagggagggggacgcggggggggaaagagaggggaagcgggggggacgcaagcagggaggcgaggctgaggcagcggggcaggggggttgaagcgccgagtgaggagtggtcgcagcgacggggcgaagtgcgggcgtgtcgggagggcgtcgaggagagggagcacagtggtgtcggggcgagcgcgaagtgtgcaggcacgtggagtggccgaggaggagacagaggattggcggcgtcagggcggggacgagaaggcgaggcggcagggggagggcgcatgaggcgggagcaggggggtgggcaggcggcaggaggggaggcgggcgagcgggggcgcgggcagagtagggggaggggcggggggtgtgaagggggggggtcggggagggggcgccaggggcgggggggcgtggcgccgggggagtgacggggggccgcgggcacgcgggggggcagcaagaggcgtgaagggccgcgaatgggggcgacagccaggtgtacacaaggggcagaggggggtgggtgccgagcagagcgcgggggacggggggggggacagggggggagggaggaagcagaggtggcgcggaggggggagccgccggactgtgggggcggcagtgggcggaaggggcaaccaggagggaggagcccagggggaaagcagcaggtgcgccaggggggggaatgtctggggagggggaggcggcgcacgtggcgggcgagcaggcaaggcgggaggcagggagcggaagaggcgactctctggtgcgacgccgcccggaagtgtcccaagggcccaaagggggacaatccgccaaaatg

SEQ ID NO: 498029 - DNA, 881 bp, Homo sapiens
  misc_feature (17)..(17): n is a, c, g, or t
  misc_feature (123)..(124): n is a, c, g, or t
  misc_feature (132)..(132): n is a, c, g, or t
  misc_feature (140)..(140): n is a, c, g, or t
  misc_feature (214)..(214): n is a, c, g, or t
  misc_feature (282)..(282): n is a, c, g, or t
  misc_feature (312)..(312): n is a, c, g, or t
  misc_feature (333)..(333): n is a, c, g, or t
  misc_feature (337)..(337): n is a, c, g, or t
  misc_feature (378)..(378): n is a, c, g, or t
  misc_feature (402)..(402): n is a, c, g, or t
  misc_feature (441)..(442): n is a, c, g, or t
  misc_feature (481)..(481): n is a, c, g, or t
  misc_feature (551)..(551): n is a, c, g, or t
  misc_feature (576)..(576): n is a, c, g, or t
  misc_feature (579)..(579): n is a, c, g, or t
  misc_feature (752)..(752): n is a, c, g, or t
  misc_feature (754)..(754): n is a, c, g, or t
  misc_feature (757)..(757): n is a, c, g, or t
  misc_feature (802)..(803): n is a, c, g, or t
  misc_feature (805)..(805): n is a, c, g, or t
  misc_feature (808)..(808): n is a, c, g, or t
  misc_feature (818)..(818): n is a, c, g, or t
  misc_feature (820)..(820): n is a, c, g, or t
  misc_feature (847)..(847): n is a, c, g, or t
ggaaggaagtgcctgcnaacagataaaacaccagaagcagcctcactttataacaaccactgtatggtaactaatccagtcccactagaatgggaactcactcactccctggagactgcactnntccctganggcggatncctcatgacccaaatgcctcttaaaagtccataacctctcaataatgttacactggcaatttaatttcaacatnagtttttgttgggacaaaccacatcctaaccatagcacacctggtccccatcccagcattgggttggntccacagggcccctgaagtttatccatagntaccattttatattgcttatntganctcacctttgatggcataacattttctgttctttgttcccncctctctcttagtggtttttattnttccttttctgtttttgcgtttttttccacaatttttannattttccacccctttctgatctttgtgttcttcttattnaattgttcccaaagttgtggtccccagaccagcagcatcaacattagcatcacctgggagctcattaganatgcatattcttgagccctacttgnganctactgcatcagacactcttggggtgggaccagcaacctgtgttttaacaagctctacagatgattttgattcaccttgaagtttgagaaccacttttaagtaataagtaagtagaattcacttctaagcttttaaagtcgttagcccatggtattttccaaaggggcttggnancantgcttggagtttgggtgtgtcgtatgagcgaggaaactgttgatnnanaantgcaaaaaananttggcatttcatagagttattcatttnttctcttccgccttaattaaggccagtgctcccc

SEQ ID NO: 498030 - DNA, 248 bp, Homo sapiens
gctatactgtgtctgggtcaatgattctcctgcctcagccccccgagtagctgggattacaggagcctgccaccacacctggctaatttttgaatttccagtaaagatggggcttcgccatgttggccaggctggtcccgaactcctgacctcaggtgatccacccgcctcggcctcctctaccctctttctaaatttctagagagaacactgcagcctctcaagctgtgggtcctgtagcctcatcc

SEQ ID NO: 498031 - DNA, 549 bp, Homo sapiens
  misc_feature (70)..(70): n is a, c, g, or t
cctgaactcattgagctaaggaaaaaaaagtttagagggcgatggcggaagtgagaccctcagctcttcnctgtgttgccagagaagagaacagccactgttggaggggccatgatgggatccaccacatttatgacatgtccccggttattaaccggaagggcccggctccttaactgcaaggtgtggaagtggcgctggcgccttaaaagttggagctggatcctatggccatgaccccaaagtattaggagcatgtgcgggagcagcaggctcaagtaaaaaaggagggcttcagtgacatggtgggtgagcccgctgcccaacagaagcaaaaaaaacggaaaggtcagcccccgggcaaccgtgggggcagcaaaaaatataaggagttcaagttttaggtcccccccccctagccctttttttggccctacgtttggaagcctggggttcacccaaaaaccccctctcccccagttcccaagggcttgtcctttcatgtttttattttagacctgttttgtaaataaagctgtttccccagga

SEQ ID NO: 498032 - DNA, 561 bp, Homo sapiens
  misc_feature (56)..(56): n is a, c, g, or t
  misc_feature (183)..(183): n is a, c, g, or t
ctcccctaggggtggggggggaaaacccaggttttgggcccccaaggcaggttgtngtttttttttccaactcttagttcccggttgatgggaggttcctattaaaaacctcaaccctttttggcgcttttccaaagggccaattcttcttttttttctggccttaaccctgggtcctgaggntcgggccaccaaagccccggccagggttttgttttttccccccctggtttattctcaaatgtggggggggggaggccccgcctcagtttttttccaaaccccttttcctttggcctggggccccagattttttccttttacccaagggccgggttttttccctcccccctttttcgggggccctttggttactttcctccccccctgccggggccccggtttggaattttggtggggggaaggggaaaggggtgggccttcccgtttcccgcaatttaaggggcacccctttttggggccccccctttaaagggggggggggttggggggtgccccaggtttttttttttttgggtatttaaggttttttggcccgga

SEQ ID NO: 498033 - DNA, 84 bp, Homo sapiens
catggatttgctggtgcagtacaactaggctcgaattgagctcgaattcgagctcgaattcgaggctcgaattccttctaacgt

SEQ ID NO: 498034 - DNA, 1626 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggaggactggccagcccccaaacctccaagcccatcggctggatgccgtggataagcgaggggagagcgactaggccctgtctgcgggtaccttcggcgaggagaggcgacgaagcatacagaaactgctgtaaaagaagaagttgtgggtatttttttttttttttggtctggaggaatggggacaccaaaactcatttggcagcagaggtgaggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498035 - DNA, 162 bp, Homo sapiens
ctcaactgtcggtccgtgtcttgagtgtttcttcttagaacttgcaggcccagcctcagaggattcaacttcatgttcagcttccaaggctaactcccatccctttcctgggcgtgtcggaggaatggttcaatcactgatctacaattgccagtgagctct

SEQ ID NO: 498036 - DNA, 609 bp, Homo sapiens
cgtggtggctcatgcctggaatcccagcactttgggaggctgaggtgggctgatcatgaggtcaggagtttgaaaccagcctggccaacatggtgaaatgccatctctactaaaaatacaacaattagccaggcatggtgatgtgcgcctgcagtctcagctactagggaggctgaggcagaagaatcacttgaacccgggaggcagaggttgcagcgagccgagatcgtgccactgcactccaacctgggtgacaggcgagactccctttcaagaagaaaaaagtataataaatgaggccaggccggtggctcacgcctataatcccagcactctgggaggctgaggcggatggctcgcttgagctcaggagttcgagaccagcctaggcaacatggcaaaaccctgtctctactaaaaatacaaaaattagttggatgtggcgtcatgcgcctgcggttccacctgcctctgggaggctgaggtgttaggattgcttgagcccaggaggcacaggttacagtcagccgagattgtgccactgcactccagcctgggtgaccgagtgagactccatctccaagccactttccccgcccaacatgtcgc

SEQ ID NO: 498037 - DNA, 1497 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggaggcttggaatagttaaatgactttggtcttgtccaaggttagatggagttcaactctaacgtcaagtcttggtccttttcattgacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498038 - DNA, 1501 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggaggactggccagcccccaaacctccaagcccatcggctggatgccgtggataagcgaggggagagcgactaggccctgtctgcgggtaccttcggcgaggagaggcgacgaagagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498039 - DNA, 1341 bp, Homo sapiens
  misc_feature (7)..(7): n is a, c, g, or t
  misc_feature (9)..(9): n is a, c, g, or t
  misc_feature (11)..(11): n is a, c, g, or t
  misc_feature (33)..(33): n is a, c, g, or t
ccaattngncnttggccggggggtcggcgcctnttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498040 - DNA, 265 bp, Homo sapiens
atggtctactcactaccagagatatggaatggggtgtgggaagtgatcatgccatcttcacatctcaggagtacagaagagttctattctactacccgatctgtggcatgatcagttggatctgaaagagacatgacatgaaatactaaaccactctcctcagtttgtgtagagtgaaatgaagcatggaatggcaacctgtttctgaaaaggaaagcaatgagtcgtagcggaggcaatacccaaccccagaaatgcagccaag

SEQ ID NO: 498041 - DNA, 1502 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattggtatgctcccccatgcccagggatctgcatttgtttacttaatatacttcataaatttatagatagtgttaatgagtgattattaagtttgggattgctgtatataataaaacacctagacaatttaaagcgtgttaaatgttgactttttaaataaggaattttatagagagtaatttttttctggtactctactgtaatttgagatcgcaaagccagtcatccatagactgctagtataaatgaaacacctggatttgagccgtggttggtgaccgagatactgtagtacatcctttctatgtggaaggaagtgaaacctgttagagagtgggttgagtcgtagtgtctgtaaatgactgctcattggcatcattttcacaaataaggaaatgaagaagtagaagatagagcagtctgtcacctgtactgtgcaaagaatgccacttttgttgtacaaactccctcctggttctattcctgtcaacataaagcatcaggtttccaccactagatgaaaaggggaaggttctgttatctttctcctacatttaggaatttctcccttcttacatgtgaaagtgctgtactgtttcccagctcagttaaatgctgtttcccagctcagataaacctgttcttgacccatgttctctaccaccctgttcctctgccccttttcacagtcacgttcctgaaaagaattggcagccctggctgggtgcgatggctcatgcctgtaatcccagcactttgggaggctgaggtgggctgatcacaaggtcaggagttcgagaccagcctggccaacatggtgaaaccctgtctctactaaaaatacaaaaattagccgggcgtggtggcgtgtgcctataatcccagctacttgggaggctgaggcaggagaatcgcttgaaccctggaagcagaggttgcagtgagccgagatcacgccactgcactccagcctgggcaacagtgcaagactcagtctcaaaaaaaagacgaattgcagccctgt

SEQ ID NO: 498042 - DNA, 167 bp, Homo sapiens
agaatccgctagcggcgccctttttttggggggcggggcggttggggacagggtctcactctattgcccaggctgaaatgcagtggtgcaatcatagttcactgcagcctcgaactcctgggctcaggtagatcctcccacctatacctcccaatgtatctgtggac

SEQ ID NO: 498043 - DNA, 652 bp, Homo sapiens
gaaaactgtaagcaagacaaataatcatctccaatgctatcagagactaggcataatactaaaccttaagttattctcaggaaagagtacccgacccgttattaatgtgtggcattgcctttctgtaagagtgtagacatgttttagatttataaagttttctattttaacaattttatcccccatttttcctgtcttagattaagttaccaaatattagtagctttccttggtgaagtaattactgataagtcctttctgtaaccaatattcacttcttattttgtaaatttttaaaagattcttatagtgatatttcttatgacacagtagtcatctaaaggtgccagtcacttttcctggaaaatataggaagtaatactaggagaaagtgtgcaactgttaaattctttcacatcaccaactttttcacaattaaagtatttgctttgtagagtgcttagcaatgtccattatgatttcttttttccattggcaattttgggcttccctcacatcatggaagttagaactggaagggacatgagatcatttggtttattctctgatgttatagtttgtgacactgatgcccataaaaataaatgatttgcctgaagtcgtatgtagctagtataacttagaaatcaaa

SEQ ID NO: 498044 - DNA, 6788 bp, Homo sapiens
ggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaacccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccatgttggccaggctggtcttgaactcctgacctcaagtggtctgcctacctcggcctcccaaagtgctggaattacaggcgtgagcatcacgtctggcctaatttttttaatcgaatttatttttgtaatgatagatgcttgtcttattcctagggaaatatttgaagtaattgagatgctgtcacctaaaataatcaaaaggctcctgattcagttaaaagaattcatttaagtacagagtgtaagcgagctacaccaaagaatggtgattagcgctcccagggtggggaaaaatgaggattgtttatataggcaaaatggaggtgccaaacagaattataacattttcggaactaaggctcatttaaagatacaaatttgattggctactattgattacacttgaagggatttgtttaacttccttttgtaaagaagtaacagtcataaggatctctcatctcccagtcatttagtctagttttgaataaagaatagggggtctggttaatatatacatctaaacacaaaagtcagaaagaataaaagtagtgatgttacacgagccagctgtcagtgcttaacttttccctttggcctaatgcatttggaaggtcctgaaattgtattttctttttacattgcctatgtatgtgtaagtcttcttcaggtcagttcacgctgttaaatatacgtgcgtatacatacatactatgtatgtgcgtttatgtgtgtctgtgtgttttttttttaacagacgaagcttcacaaaagatgtctaaggtaagatcatacttcatgtatctacagcataaggagaaattgctttatgttttcagactgttgacagtcgggacttatatgattcattatttttaatacaactgatacatttgattcattaacacaaagagttctaatttagttgtctttttttttttttttgagacgggagtcttgttctgtcaccaggctggagtgcagtggcatgatctcagctcactgcaacttctgcctcccacgttcaagcgattcccctggctcagcctccggagtagctgggactgcagacacgtgccaccacgctggctaattttttggattttagtaaattcggggtttcaccgtgttggccaggatggccttgatctgttgacctcgtgatccacccgctttggccccccgaagtgttgggattacaggtgtgagccaccgtgcctggcctaattgtcatcttaaaagcttggagctttctcttttttcaggcttctactttcttttctctacacacatcagtaacagtccttttggcccccttagttcattcccagcagaccagataatttagaattctgataatttattatgatgaaattgatggggctcttagacttgataaattggtttaaatcagcctttgcaagttagttcagagataaattagtgctaaagaacatattctgagaaaagcagaacttgtggttaacattgcaagattattatttctgttttttttttatctttgaatcctgtgggtgttcattactgtccaatgcaaaatcatcataccagtttttgcattttataccagtgttagcatggaacacagataagcaaaaaaaaaaagtcattatttcaccactcaggaataaccactgttaatatgttacatatattctttttcacctgtgtgtgcatttgactatacatttacaaaatgtaatcctaaaggaaatactattttgtatcttgcctttttcaattaataaattgatttttaaaatttcttctcattttcagtatgccactgtctagattctggttacttctgctattcttgccttctcatatctctgtcctctctctcatcagatacccttctgtcaaggaatattgatgcttcagtgtagtcatctatgatcttctcattctgtcttttctttcttggtctttgacactagatactcaacatcccacccctaatttgcctgcctcacccttgatgaaactctgttctatagagctagaagcacagcaagagagatgcttttttcctcgatacttttcagaaatgcattgcacctaatacctgggagaagctattctttagccaagtttgttgaatgaaaccattcattcaaagtactgtcagctgtagcagtactttgtaagcttgactgattttcctggaactccatagtctctcaagtcgaaatttgaaattgcattaagatgtattaagcatgtatcttctatgtattgttaaattcctaaacagaatactgattaacaaaatgttaattttcagtcgcatacaactaaggagttatactagataagtttttctttttttaatgctcctagttgaatactactggttttctgatagaagtatgactttctggaagtgtttatactttttaaaaaatttgtgaaaactgataacctatgtttgtttcatgtctaactgattatatcttaaaagcaactactaaggtgtttattagtttgtttgttttttaatcttatttagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcaggtaaaaacattcttatgttactgtaagtgtaattctacatgaaagatgctgaagactgcctaattaatattttatgtcttagctgtgtgttttgtttgttcttgttcagctttgaacacaaggaaaacacttttatggggtaggtgtgctgcaccgaggtccttggatttgggttgtagactttctttgacacgtatccatggatccatcctctcttgagtttgtctgtaaaatgtaataagtagtttctgcctatattaaatatttgatggaaggattaagtgagaatgttttacatcaaaaatgctgtgtaactagaagattactaggatagatgttcgaattcatctactgtcagaaagttccagcacaggacaccagcatccacaaatgactgttgaatgaaataggcacacatagtgagagcctaagacttgggctgctgcaagaatatgtagccctttcagaatatttttgaattcagtttttaaatgaattcgtaaattgctttctttttcccaggaacagaaattataatttttaacatttgtgtttttaaccttccccagtagcacaataatcttagctttaaccttcccctttctgacttctctgggatctttttttcttaatccccatggtatctttggagaacctacctctgtagagaggcagtagactctgaagtcacctgtcgtaagaacgtgagctttcctcttcacatgctgcttatattccctattaagtttgtttcttttctagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498045 - DNA, 283 bp, Homo sapiens
  misc_feature (4)..(4): n is a, c, g, or t
  misc_feature (48)..(48): n is a, c, g, or t
  misc_feature (58)..(58): n is a, c, g, or t
  misc_feature (78)..(78): n is a, c, g, or t
  misc_feature (104)..(104): n is a, c, g, or t
  misc_feature (120)..(120): n is a, c, g, or t
  misc_feature (132)..(132): n is a, c, g, or t
  misc_feature (139)..(139): n is a, c, g, or t
  misc_feature (147)..(147): n is a, c, g, or t
  misc_feature (163)..(163): n is a, c, g, or t
  misc_feature (166)..(166): n is a, c, g, or t
  misc_feature (175)..(175): n is a, c, g, or t
  misc_feature (248)..(248): n is a, c, g, or t
  misc_feature (264)..(265): n is a, c, g, or t
tggncacatgagtttacgaatccttagaagtgtctcccacagggtggnaggactgggngaatctctgaggcgtgtctnccaggccctcccacagcttgtgcccnccacagtgtagacttnaacacttggccncatgtgngccttccnccttggccccccaaancantgggattanaggcgagagccactggttggctaaaatatttatatttacctgacatgatttgttgatttgggggctagggagntcttaaaacaacaatnnaaaatcttctgtggctgc

SEQ ID NO: 498046 - DNA, 293 bp, Homo sapiens
atgggctctttgctcaagagtatttttttcaggctgtttcataacagtttgagttatgagcctggcacccttcatataccaccattttggcatacatcctagagtcatagcgtttgctacatttcttgaggtacttagctagattatgaacccagtgacgggaggaactgaatgacatctgtatatctctacgcagagatggcaagcgctcgccacactagatactatctcttgggtacccatggcaggcattgctggctgttcatgaccttctgttcctttgagcctagact

SEQ ID NO: 498047 - DNA, 520 bp, Homo sapiens
  misc_feature (23)..(23): n is a, c, g, or t
  misc_feature (171)..(171): n is a, c, g, or t
  misc_feature (252)..(253): n is a, c, g, or t
  misc_feature (328)..(328): n is a, c, g, or t
  misc_feature (369)..(369): n is a, c, g, or t
  misc_feature (411)..(411): n is a, c, g, or t
  misc_feature (441)..(441): n is a, c, g, or t
  misc_feature (517)..(517): n is a, c, g, or t
aaatcggccgagctcgaattcgncgagggagttttttggaaaggaatggggaacactatatctgcccaaactgcaccattctgcaagtgcaggatgagactcattcataaacggcagatcagtttgaagatccctcctgacctgttgatgctgccggcaccgattgtacangtataggaacactacagcagaagtctagcgaagaccaagggataaagggtagaattgagaaagctgcaaatccaagtggcnngaagaaactcaagatcttccagcctgtgatagaggcgcctggtgcctcaaaatgtattggccccgggtgctgtcncgtggcgcagcccgactcggtgtactgcagtaatgactgtntcctcaaacacgccgcagcgaccatgaagtttctaagctcanggtaagaacagaagccaaagcctaaagaanagatgaagatgaagccagagaagcccagtcttccgaaatgcggtgctcaggcaggtattaaaatctcttctgtgcncaa

SEQ ID NO: 498048 - DNA, 253 bp, Homo sapiens
cagtaatttttgtatttttggtagagacagggttttcccgggctgcctaagggtagtttcaaatttttggggtcaagggatcctgcccccttgggtttcccaagggttggggattacaggcatgagcccccccgccccgccaaaatattttttaaatttatataataaaataaatctctttcctctaagatctgttgaagtaaaatccctatactaaataccctcatatggcccatttttttatccctgaata

SEQ ID NO: 498049 - DNA, 2174 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcaggtaaaaacattcttatgttactgtaagtgtaattctacatgaaagatgctgaagactgcctaattaatattttatgtcttagctgtgtgttttgtttgttcttgttcagctttgaacacaaggaaaacacttttatggggtaggtgtgctgcaccgaggtccttggatttgggttgtagactttctttgacacgtatccatggatccatcctctcttgagtttgtctgtaaaatgtaataagtagtttctgcctatattaaatatttgatggaaggattaagtgagaatgttttacatcaaaaatgctgtgtaactagaagattactaggatagatgttcgaattcatctactgtcagaaagttccagcacaggacaccagcatccacaaatgactgttgaatgaaataggcacacatagtgagagcctaagacttgggctgctgcaagaatatgtagccctttcagaatatttttgaattcagtttttaaatgaattcgtaaattgctttctttttcccaggaacagaaattataatttttaacatttgtgtttttaaccttccccagtagcacaataatcttagctttaaccttcccctttctgacttctctgggatctttttttcttaatccccatggtatctttggagaacctacctctgtagagaggcagtagactctgaagtcacctgtcgtaagaacgtgagctttcctcttcacatgctgcttatattccctattaagtttgtttcttttctagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498050 - DNA, 1289 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggagacgaagcttcacaaaagatgtctagaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498051 - DNA, 977 bp, Homo sapiens
catctatcacgccattcatgctgcttcccgtctccacataccaggtccagagtacttcatggatgccctccttaatagccatatgcaataaaataaagtacatattatgaaaaaaaaaaaaaaaaaaaaaaaaaaaaaaaaaaaaaaaaaaaaaaaaaaaaaaaaaaaaaaaaaaaaggggggggccctaaaaaattccccgagggcccccaccatgaccgcaccaccgtttgttgacaacagagcggccccatgcaggagcctaaattacaacgacgacgggggcgcgcttaacaacacgccggacgcggacacaacatccgtcacggcgacacccgtggacaacacaagacaccaccgcgcggggggcccacacaatcgcggcacacaccctcagagcaagaaaattatgaaccccccgaggggggaaacaataaaaacttccacgagcgcggtataaggggggtggacaccaccaccggcagcacaattgagtccgccgcgagcccggacaaacaactgtgccgcgcacccggcgcgcatttgtcgtgctcgtgacaaaacactatactaccccgaggcgggacccatgtataaaaagcgcacacgacaacacacacaacacaccacacacaagacacgaacagacacaagacacacccgacaccacggcagacgggtacgagaacagggaaagaccgcagaaaggagcagcacgagaccgagagcgccagcggtaacgaccggcgaacagcgacaggaagaacaacaacaaactgggagaccagggcagcaccgaagagacgccaaggtgggaggacgcaaagcaccgcccgaagagcgagacctctgccgggcgggatggggcccggtagacaccacgcgacacagcggaccgaggcgcgacagccggcgagcggcacgcccacgcacgcgccagagagcaagaggaacacaggagcagagacagaagcaac

SEQ ID NO: 498052 - DNA, 1423 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggaggactggccagcccccaaacctccaagcccatcggctggatgccgtggataagcgaggggagagcgactaggccctgtctgcgggtaccttcggcgaggagaggcgacgaagacgaagcttcacaaaagatgtctacgaagcttcacaaaagatgtctagaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaacaaggattctggatgacattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggtcatcacactgtgcccctttctctgtattgtgtcaccctgagccacaatgttcctcctcctctatgtgttcagctcagccttcttgaccattaagcaacatggtttggtttcctactcaaaagttattataaaagagttgttaatttaatcaaattatgctcttttagcctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaatttaa

SEQ ID NO: 498053 - DNA, 3608 bp, Homo sapiens
ggaggcggaggggagcggagcccggagcgtcgtggaaagcattggacacatttccaccatgctaatggcattttaaatatatttggcaattttcccaattttttactgaagaaaactgtaagtttatacttgaggactgaagtgtgactctgccgattatcaggctttcaagatgaatctggaaaaactcagcaagcctgaactcctgacactatttagtattcttgaaggagagcttgaagcaagggaccttgttatagaagccttaaaggcccaacacagagatactttcattgaagaacgctatggaaaatataacatcagtgatcctttaatggctctacagagagattttgaaacactgaaggagaaaaatgatggcgaaaagcagccagtctgcacaaacccactctctattcttaaggttgtgatgaagcagtgcaagaacatgcaggagcgcatgctgtcccagctggctgctgctgagagcaggcaccgaaaggtgatcctagaccttgaggaagaaaggcagcggcatgcacaggatacggctgaaggagatgatgtcacctacatgctagagaaggaaagagagaggctgactcaacagttggaatttgaaaaatcccaagtgaaaaagtttgaaaaagaacagaagaagctctctagtcagctggaagaggagcgctcccgccacaagcagctctcatccatgctagtgcttgagtgcaagaaagccaccaacaaggcagccgaggaaggacagaaggcaggagagctgagcctgaaattggagaaggagaagagccgggtgagtaaactggaagaagagttggcagctgagagaaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaagtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccatgttggccaggctggtcttgaactcctgacctcaagtggtctgcctacctcggcctcccaaagtgctggaattacaggcgtgagcatcacgtctggcctaatttttttaatcgaatttatttttgtaatgatagatgcttgtcttattcctagggaaatatttgaagtaattgagatgctgtcacctaaaataatcaaaaggctcctgattcagttaaaagaattcatttaagtacagagtgtaagcgagctacaccaaagaatggtgattagcgctcccagggtggggaaaaatgaggattgtttatataggcaaaatggaggtgccaaacagaattataacattttcggaactaaggctcatttaaagatacaaatttgattggctactattgattacacttgaagggatttgtttaacttccttttgtaaagaagtaacagtcataaggatctctcatctcccagtcatttagtctagttttgaataaagaatagggggtctggttaatatatacatctaaacacaaaagtcagaaagaataaaagtagtgatgttacacgagccagctgtcagtgcttaacttttccctttggcctaatgcatttggaaggtcctgaaattgtattttctttttacattgcctatgtatgtgtaagtcttcttcaggtcagttcacgctgttaaatatacgtgcgtatacatacatactatgtatgtgcgtttatgtgtgtctgtgtgttttttttttaacagacgaagcttcacaaaagatgtctaagatcatgccactgcactcaagcctcaagcctgggtgaatgaaaccttgtctcaaaaaaaaaaaaaaaaaaaaaaaaatccaggcatttacagtgtaacattcacaatgtctaatgtctaatagaaaattgtgtggcatcaaagaaacaaaaactgtacataatcaggagaaaaagcaggcaatagaaacagatccagaaatgatagaaatggatctcgatggcaaagaagaactctattacttaaaggaaagcatgaatataataagataaaggaaagatacaacagaaaaccaagtggaacttctaaagattaagatacaaccgaaataagaaattttcatgataagcctgacagcacattatacactgcaggagaaaaagcacagtagaagcacagtaagggaaaagctggaaaaaaaaaagaaattgaatgtgccctcagtgtcctttggtacattgtgaacagtctaatatatggattatattcacagagaagacaggaaagcaaaaaaaaaaacttgaaaaaataatgcctgggaatggtccaattttccagcaaagtttataattgccaggtaacggggtaccgagcctg

SEQ ID NO: 498054 - DNA, 993 bp, Homo sapiens
  misc_feature (192)..(192): n is a, c, g, or t
  misc_feature (336)..(336): n is a, c, g, or t
ggacgagtctaccgcctgtccatgtacctgataggatcacgcattggtcaataaatctgcagcttacgagcttcgcttgacctgtagcgacccatggcactgtgcgagcgcgatgtgcccaacccatgtgcagcagggagcctttcactatggtgtcgccatcacaccgaccaagttggacgtgtacaagcntgcgacgcacgctactgagtcgcgtgtcgctgtgagcgtagggccgcgaacccataacccgttgcgtggttgtctcaattgcttgagaagcctctcatacatgttcgattcatatcgtatgctggggagatcgcaaaaacttgngctcagactcatgcgtgatatccaggtcaacctgggttacttgtgccatggcatgtactcttcttctcctgcacagtcgaaagatgctgcagcattacttacaggaacaaaatatggggactggccatccccttcagcttgttgcccagcgatgtccatgatggccaccgtcatgcatgcttctgctggcccctctctccgtccaagcagcaccgctgctgacacatgaggcatcagagcagcgaggcgcgttgcatcatcagatccagtatggccttctcaagatcctcagcaagacgctggcagccctgacgccacttcaccccagatgtctgccagattctgctggatcagtccctggaccttgctgaatacaacttcctgtttgccctgagctttaccgactcccacctttgactccgaagtggacccctccttcgggacccttctggcacagtgaatgtggccctcaacatgcttggagagctggacaagaaaaaagggagcccctcacccagtgcagtggggctcagcacaccaggcagaagggaccaggacgttcaaagtcctccctgatgttaccattggaaaaactgcttctacctggttcatctctcaaggcgaatgcggtaacttaggggaaccggtgttgagccc

SEQ ID NO: 498055 - DNA, 188 bp, Homo sapiens
  misc_feature (2)..(2): n is a, c, g, or t
  misc_feature (5)..(5): n is a, c, g, or t
  misc_feature (142)..(142): n is a, c, g, or t
  misc_feature (168)..(168): n is a, c, g, or t
ancanctacatctggtacgctgtatgttcacaggacatgtctgttattcgactcagaatatatttgtcaaccaattatcgtactaaaatgtcttgtgctgtgttataataatttacgcaatgagtttcatttcatgtaattnacctattccagtgtgatgtttctcancccaactttggcagcacaag

SEQ ID NO: 498056 - DNA, 390 bp, Homo sapiens
  misc_feature (47)..(47): n is a, c, g, or t
  misc_feature (55)..(55): n is a, c, g, or t
  misc_feature (81)..(81): n is a, c, g, or t
  misc_feature (91)..(91): n is a, c, g, or t
  misc_feature (93)..(93): n is a, c, g, or t
  misc_feature (96)..(96): n is a, c, g, or t
  misc_feature (104)..(104): n is a, c, g, or t
tttgccctgaagtcctaaaacccactttttaaaaaccctgaaaatanaagggaanccttctgtggccccaaagtctcccanattggccccnanaanactggccnggcggaggaatttgcgttggcttgcctttccaggggttagcctacaagattccagctttatatcctctgttgcttcttggcccagtgtagtcaataagggtcttctttaacatcctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctca

SEQ ID NO: 498057 - DNA, 191 bp, Homo sapiens
gaggactatgccgtcattaacccgaccctggactactccgtgatctgacaccacagactcacgtacgactatcatctgtatgaacaaacgaaactttaatagcagtgctgcacaatcgggatgtcctgatccaacatcgatgtgtcgtaaaccctattgtatgatatggactctagaataggataatgcgc

SEQ ID NO: 498058 - DNA, 352 bp, Homo sapiens
  misc_feature (68)..(68): n is a, c, g, or t
  misc_feature (70)..(70): n is a, c, g, or t
  misc_feature (152)..(152): n is a, c, g, or t
  misc_feature (173)..(173): n is a, c, g, or t
  misc_feature (195)..(195): n is a, c, g, or t
  misc_feature (236)..(236): n is a, c, g, or t
tttaagaacaagatagagacaaaactggaatgagagtgagtcggatgaagccaaatgaatcccatccnangtgactatgccatccagtggaggagcctaatggcattggtggggcttgaaggtacagcagtagggctgacagcagcaggaangagacaaccactttcacaaanaaattcttcttggtgtactganagtggtttagtgttgagtctactcttttttggaaactctanaattaaaagcctgctgattttaaaaattcaggctggtggtttacccctccccccagctgatgtgtgggtctgtattgttctttcagggtaaatgtcaaaaatactggcaaaaaaaa

SEQ ID NO: 498059 - DNA, 356 bp, Homo sapiens
agttgacgagatgtcagacataagcgctgctccgacaggcccccacctttacaagctgctcctccagcccaccaccaaccctcatacctcggacaggcacgaggccttgcgtccatggggatgtaggcaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttg

SEQ ID NO: 498060 - DNA, 281 bp, Homo sapiens
tgtctcaatgtcacagtggaggaccttcatattcacgcctggatcttgcaagggtggagttactgtagagggatgtcccaagcttgttttccaatcagtgttaagctgttagaaactctcctgtgtcagtgtgtatgtccgtagagtgtgtgtgagagcacaatcagtgtgtgcaggctgtgtatccccatttctctcctccctggagacccatcattgaagaacaaatgtaagaaatcccttcccaccagcctcgctgccttccaaggccctctgcgggg

SEQ ID NO: 498061 - DNA, 395 bp, Homo sapiens
  misc_feature (7)..(7): n is a, c, g, or t
  misc_feature (79)..(79): n is a, c, g, or t
  misc_feature (325)..(325): n is a, c, g, or t
  misc_feature (339)..(340): n is a, c, g, or t
  misc_feature (346)..(346): n is a, c, g, or t
  misc_feature (351)..(351): n is a, c, g, or t
  misc_feature (370)..(370): n is a, c, g, or t
gcttttntccaggtggaaaagggcggtgtgtagtgcgcttgagattgcgtcatctggggatctgttggagcggtatgcntattggagtgggtctagggtttccgggatgataatgttgatgtgagtcatcaccagcctttcaaagcacttcatggttaccgacgtgagtcctacagggcggtagtcatttaggcaggttacctttgctttcttgggcacagggactatggtggtttgcttgaaacatgtaggttttacagactcggtcagggagaggttgaacatttcagtgaatacacttgccagttgattcccgcatgctctngagtacacatcctnntttatntggtnttgggccgcatgccctttntgaattgttgaccctgttttaaagg

SEQ ID NO: 498062 - DNA, 196 bp, Homo sapiens
  misc_feature (67)..(67): n is a, c, g, or t
  misc_feature (122)..(122): n is a, c, g, or t
  misc_feature (136)..(136): n is a, c, g, or t
  misc_feature (141)..(141): n is a, c, g, or t
gactgaggacgacctgggtagctagctgaggaacaggagtgtggtgatcacaggaagagcaagccgngcagaagccactctgcaaaaacaccgggcttcagtgtccagagtatcagtgactntgagaaatttaccnagggnatggatgaccttgggagcagtgcggacggacggaccgaccgaaagaacgtggcct

SEQ ID NO: 498063 - DNA, 756 bp, Homo sapiens
  misc_feature (154)..(154): n is a, c, g, or t
  misc_feature (206)..(206): n is a, c, g, or t
  misc_feature (216)..(216): n is a, c, g, or t
  misc_feature (223)..(223): n is a, c, g, or t
gagaaagggggggtcttggcggccggaggaaggagtaggtgcgggtgaagatggcggcagcgaggccggaactgcatcatggaggtgtcctgtggccaggcggaaagcagtgagaagccaacgctgaggacatgacatccaaagatactacttngactcctacgcacactttggcatccacgaggagatgctgaaggacgaggtgngcaccctcanttaccgnaatccatgttcataaccggcactcttcaatgggacaagggttgtgtgcttggacgtcggctcggggcaccggcatcctctgcattgttttgctgccaaggcccggggccccgcaaaggtcaatcgggatcgagtgttccagtaatctctagattaatgcgggttgaacgatcgctcaaaggcccaaacaaagttagaccacgtggttgaccatcatcaaggcggacacgggttggcagggacggtgggaggcatcccagttggcagaagtgtgtggaccatcatcatcagcgagtggatgggctacttgcctcttctacgagtccatgctcaacaccgtgctctatgcccgggacaagtggctggcgcccgatggcctcatcttcccagagcgggccacgctgtatgtgacggccatcgaggaccggcagtacaaagactacaagatccactggtgggagaacgtgtatggcttcgacatgtcttgcatcaagattgtggccattaaggagccctagtggatgtcgtggaccc

SEQ ID NO: 498064 - DNA, 819 bp, Homo sapiens
tgtgctagtgtctgaggcccgtgtggttaatcagtgcacgatgccaaaagagcaacagaattgctgaatgccactagaaccccctgaatgtcatgccaatgccatgtgccatgtgagtgaatgactgtgacccctagaaggtgcaaatgtgtcaatggtgtgccatccacatgcctgaactgtgcaatatgtggaaatgatgaatgaatgtgctgcctgcctcttgcttggatgtgtgtgtgccccacttgctgacttgaatgcccctgtgatgcataccacgatgtttgtcttgtgtgatgcatgcatgctctactaacaatgtgatgatcacctgagtgcctgctgtgtgtgctccatgctgatgtgccaatgatgtgtgctgtgaatgcccttgcataatgcatttgccactgtgaaccctgtgacttgtaatcatgattgctgccactggttctagtacctttatctacgtgagtggtgtgtcctgtgttgaactgtggttcagcaacaaccttggccctactcatctaacctagattgctgtatgtgttgaaatgctgcttgattggcacaacccctactgctctaatctatgaaaaatacgtaccatagagcttgatatccatgcttgtgactgacctgctatacgtgagcagacagttttgtgccttgcgaccagattgtggacaatcactggtgcactccgagactttgcttgccctgcctggtggcccagatcttgcaagcattttagcacaaccactaacaacatccagtcccggatcaccaagaccttcaacaagagctgggtgggag

SEQ ID NO: 498065 - DNA, 107 bp, Homo sapiens
ctgccctacaccaatcagaagctcagtgcccaatgggccactgttttgactcggaatcgttgtgtgcacctttgtcaaatttactgtaaagtgatgagggatgtgca

SEQ ID NO: 498066 - DNA, 1309 bp, Homo sapiens
tatcagctgtatacatagtatcttgtccacagcgaagacgtgtttttttctcgggtgactattatagttcatcattttctacacagtcttatagtcgtccctctgtatgtctaaccgagatgggctgtgtgctgttctacgcgctgaacctaatcatctagtatctttcaactctttctgttggcgtgtattgttaggaaactactccccttgggaaataaatcataatgttgtatgacacgtgatggtttggtacaacggccttatccttggtagctcctcgggaaatagggcttcgggggtccctttctggaaatctagcgtggaccttctgtcagggtcacgctccatggcctgccttgccatagcgtttgtgtgagtccactggtattaagtccagctttgggcgtgccaagtacaagggggtgacagtactttccgtgcataagtaccagtgaaataactggcttggtcctggctgattgatttagacgctgaaatgccatggcattttccatccatccgtctagcgctaggcacggtgtttccaaagcagacagcagctcaagctgattctgaaggccatctaccagttacttcgtgtcttacgtatgtcctcttccagtcaatacggtgtatcttcgtgctttgggacagcgagagctataggcatctatgtgcaggcaatgccctaagctggacgtcctaactaggctgagcaactgacagaaccatctgcaccatgtaccccatccttgcagctttataaagatgtaacaacagagtcccctttcactcctatctgggaggtgggacccctttcatttgtcagattttgctcatctagggaaaataaggctttggtttccagtttaaattgcttttgtgaccttctaaaatgttctttatgcctagcactgactagtattggcattactgttgttaagcactgtgttccagaccgtgtctgacttagtgtaacctaggagattttatagttttatgtggcaatgaaatcccttgagtagacgctacagcagtggggagcacagcgtctctttacctgtcaccgaagccaggaagccccgtttgtaagcgtgtgttatggtgcgtattattggctacactcgctccacgtggctgttctttttacatcataatgttctgtctttggtttccaccctctcagaacaatcatgaatttgctacagacctaattgtatctggattaacttctttgtcttagttcgattggatttgagaaatgaaagatgtaataaggcgaagcataatcctggggcttaatata

SEQ ID NO: 498067 - DNA, 293 bp, Homo sapiens
cagcaaagctcattgaaaatttcaggatattagtatttttctgagtttaattagcataacctaaagttaacttgtaggctttgggtttctaatgctttttactgagtggtaaagatgagcaaccttttttttgtttaatagccagatactttttatactccgaatacaaatattgaaaaaaatgaaaggaaaaccccctagatcaaacttggtcaatccatggcctctgggctgcatgtggcccaggatgactttgaatgcagcccaacacaaattcataaactttcttaaaa

SEQ ID NO: 498068 - DNA, 211 bp, Homo sapiens
ttcagttacggcattgtggctggatgacacagcttgacggaggtgcctgtgcacccctcagcatctgcccaccctacaggcgctgaccctgctctcacagttcagatcctgactttcatttaccaacctttcaacgcttggtagtcttcatctccataacacatgtcacaagactcttaataggccatatcacttactttctttcgtcact

SEQ ID NO: 498069 - DNA, 254 bp, Homo sapiens
  misc_feature (30)..(30): n is a, c, g, or t
  misc_feature (38)..(38): n is a, c, g, or t
  misc_feature (87)..(87): n is a, c, g, or t
  misc_feature (99)..(99): n is a, c, g, or t
  misc_feature (242)..(242): n is a, c, g, or t
  misc_feature (251)..(251): n is a, c, g, or t
gcttaattgaacttcaagggaaagcggatnccgggganggtcgggaatttggggttgcccgggggcgaaacttttttcccaccacgnacgaacatttanttggaggttccggggcaaatgtgtgtgtgattgttggggggttgtctccaccggctttagaacccatttgaattgaataagaaaatactgaattggctttttgtcttgatgtgtttttatagtctaaacattaaaaaagtaantaagtcatnagc

SEQ ID NO: 498070 - DNA, 859 bp, Homo sapiens
tatacccaggttctatttttaatagggaaggaaaaagttacggctcagggccccatgaatttgaaacagaaagggaaaaacttcagccccccctcttgggaacgggaaataatgtatgggaaagggagcccgggctcagggggggaaagaagggctcaggggggacagtggggggtgggggtgctcctccccacctccttcacattagtgccgtacacgaacacagacacagtgcaggtgcctggcagaaacaaagctcgagggttcctaccgaaggtcacaaggggaagggcgaggacacaactcgggcctctaagtcccacacagggcagcgtgtctcacacttatacacgcggggagagacacactcgaaagccgctgggcacgtggtcacgggctgtgcagaccgggaggtgtaacccccgtcgctttcaagtcggagctctctcctccctaccaactttcagggacgcgcgagcacatggtgtccagggatcacaggctccagggagaaccaggccagcaagtgactgcccacgaagggggatggcggggcggggaagacgagcctcccatctacaggggtggtggggcatggggcacaacccctaactgcgtgaccagtggcaaggtgtatctcaggacccctcatccagaaaggggaccaacaaagaccgccacactttgtgggaagggttgccaatcccccatgaagggacgaggtctccacgaaaacccccgggaccgggtctaggacaccccaacaccagtagcaaggtctaatggaaactcccagggtaaaagcccgggcccacacctaggggtccagagcagaaaggggggggcacaaaaatctggg

SEQ ID NO: 498071 - DNA, 100 bp, Homo sapiens
attctgtatccagcttagagctgatgaggagaatcacttgacgggagaggaggttgactgagccaagattgtgccactgcacttcacctgggtgacagag

SEQ ID NO: 498072 - DNA, 302 bp, Homo sapiens
aaggaaaaaaaaaaaaaaaatcccccccctttggggcaaaggccgggaaattgttttaaaaccctaacccttttttccgggggggggggggggggggggggaaaaaccaaaaaaaaaaaaacccccccctttcggttttttcctggggggggtggggggcctcccgggttttttttggaccatttaaaaggggggcttccccccctgaccccccccaaaaaaataaaaatgggggggcggttgcccctccccggggggggggcccggttggggggaaaaaaaaagggaacctgttttcccca

SEQ ID NO: 498073 - DNA, 163 bp, Homo sapiens
tgctcgtcccattaggcgcgtctgcgtgcacaaagaccttcaggttcagaggcttgccttgtggcctggatttccggtggcattcggtcagagcttcatctcagcaaactggattgagtgttcgtggcccttccagtggacccagttaacgccctgactgtgg

SEQ ID NO: 498074 - DNA, 142 bp, Homo sapiens
tgtgaccaagccgctccctcgcaccttaccccgagtgtcagtgaccacctgccttcaaagcctccatcctgggcaaaggcagaaagaatgggtatcttagttttttttttctttatattttgggtactacgctttggcaggt

SEQ ID NO: 498075 - DNA, 447 bp, Homo sapiens
gctgctgtttactttttatacgtaatcccgtttccaacgaaatcctccaagctatccaaatatccacttgcagattccacagaaagactgtttcaaaactgctctgtcaatagaaaggttcaactctgttagctgcgtgcatatatcccaaagaagattctgagattgcttctgtctagtttttatgggaagatatttcccttttcaccgtaggcgtcaaggcgctccaaatgtccacttccagatactacaaaaagagtgtttcaaacctactctgtgaaagggaatattcaactctgtgacttgaatgcacatatcacaaggaagtttctgagaatgcttctgtcaagattttatatgaagatattcccgtttccaacgaaatcctgaaatctatccaaatatccccttgcagattctacaaaaagagtgtttcaaaactgctct

SEQ ID NO: 498076 - DNA, 660 bp, Homo sapiens
gtattctaacattatctataaatttatgaagtatattaagtaacaaattaggccagacgtgatgctcacgcctgtaattccagcacttttgttgtacaaactccctcctggttctattcctgtcaacataaagcatcaggtttccaccactagatgaaaaggggaaggttctgttatctttctcctacatttaggaatttctcccttcttacatgtgaaagtgctgtactgtttcccagctcagttaaatgctgtttcccagctcagataaacctgttcttgacccatgttctctaccaccctgttcctctgccccttttcacagtcacgttcctgaaaagaattggcagccctggctgggtgcgatggctcatgcctgtaatcccagcactttgggaggctgaggtgggctgatcacaaggtcaggagttcgagaccagcctggccaacatggtgaaaccctgtctctactaaaaatacaaaaattagccgggcgtggtggcgtgtgcctataatcccagctacttgggaggctgaggcaggagaatcgcttgaaccctggaagcagaggttgcagtgagccgagatcacgccactgcactccagcctgggcaacagtgcaagactcagtctcaaaaaaaagacgaattgcagccctgt

SEQ ID NO: 498077 - DNA, 159 bp, Homo sapiens
atgacaaaccctgagaacaagaacgaaaatctggttcgcttcatacattgcccccacaagtcctaggcctacccgccgcagtactgatcattctatttcgcccgctctatagatccgccacgctccagagatatctcatcaagcaaccgcactaatcac

SEQ ID NO: 498078 - DNA, 1067 bp, Homo sapiens
agcggacatccgcctgcgcgctgggcggggcggggcgggctggggcgggctgtgagcggaccgcgagcgctgggcgggtccgcggcgcggtcggtcggcgcctgttctcgggctgtttggcggagtgagtgtctcgccggtgtaccccgcacaagttgtgggccggccctcccgaggagctgcgggggacgcgccgctcgtcccatactctcgggcggtggtcggctggctctggggtgccggcggggcggtgtgggggaggggcggccgagcccaggctcttcggcacttatcgtgggctcccccgtcccgggcggtcctagtgccggcgacagtggctccgacacgggcaggcccgggcgcgggagtggggattccggtgaccccttgttgacctgcgggaattcctctgcactgtcgtcggtgctgggcctcggggcgtcgagtgcggtcgaggtcgggaggtttggtgcttggagggaggatacaggtttaggcccgacaaacacttagagcttgtgtggccatcttgtctttcccgacaaacacttagagcttgtgtggccatcttgtctttctaacggtgccatttcctccctgaggcgtggaggactggccagcccccaaacctccaagcccatcggctggatgccgtggataagcgaggggagagcgactaggccctgtctgcgggtaccttcggcgaggagaggcgacgaaggtctgcaccagcgaggcacggacaggcagcagggggtagggtatagggttggaggccgccgagttggcccggggatgaggagcaaacctgtggcttccgtggtctcagtggagtcccaactgtgacctggcctactggcccagacaaacctggcttgcttttttaccttttcggtctaattcttgtcagtgccaccagaccttgtcctctctccgcggaaacacacgaaccaactacactgaacttcttgtagttcaaacttctgcacctttggccattgcccaaactcttaaatctggctacttcccaccttaaatggcttctcttaactagtctgtgcttgtgg

SEQ ID NO: 498079 - DNA, 143 bp, Homo sapiens
ctgtgcaggatgtgctcacactgtatctcagtactcggaggtgggaggagatgctgaaccggagtgagtgagtgagcgagacacgcatgcactcagctggcgacagagcgagatcggttcaaaaaaagctcctcatgaaaaag

SEQ ID NO: 498080 - DNA, 114 bp, Homo sapiens
ccggctgaccctgccggccacaccgtgcctagccgctccgtccggcacctgccccgtgaagcactacacgaatcccagcccggatgcgactgtgccctgtcgggctactcgggg

SEQ ID NO: 498081 - DNA, 1340 bp, Homo sapiens
ggtccagtttaattcgtgcctgcctgcggcggctcgagtgcagcagatagtgacgtgacagctttgtagcagatatgctggcgggccctgtcagttatcgggtgtgagcgcagtcgcgcagaagtggtctgtgaggggaagtgggttctacgtccatgtgcagactatgaccggggggatagtcatactgtcaggtggacatcgtggtgttgagctatatgtgcaaatagtatgctggaggtggccatgtaggttggctcggtgcgagggttatctgtggtgagtcatcgtaatgacctcagtacttgcccaatagagttggtgactatcgccgacttttctgacgcggggacatatgtttgttacgaaggaatagatatcccagtgacccgtttaagcatacaatgtaccgaaagagtttcgtttcggaagaaagttgggttgcgtttgaggtacccttggcattgggttttacataatgtgtgtgtcccatttattagccacaagaagaggagacagttcgggaagtctacaaggggtccggggagggttcccgcagcttgacatagagatttcgttctgtaaggattgtaaatcagagaaaaagggttaaagatgagaggaacggaaagttcgttagaaaagtagggtcgtgtggtatttcagacagaagttttaccagacaaagagatcccaacatagggggggaaggaaataagcgatacccatagggcggtttcctagggcgcaaaccgagggcgaaacgcggtggaattaaccccccgttggatccggggaattcccccccacgggaaccccccgttggcacaggtagtctcacaggggccccgttgacaggaggacacacacttcgttttgtcacaagacaagaattcctttgcagatttcctaactcactctgttgttcagtagaacttcggcgcactggaaaaaggggtgaaaaaaaagccccaaacaaagcccttgggcagacgattgtaccccacggttaacagagtcccacttcccctttcccattctttttccttaattcaacgggggcgcaaggacgtgtacgccaaacccgtttgtaaaacgaacaacagtattggaccaagacgttccgggccctttatgggctatcgaaaaatccaaggggaaagaggaagtccagtgggagaaacgaagaaggttttaaagcagagtttgtgaagagtccgtccgtataaggcgacagaagtagaaggcctttttaggaaagacggaaattggcatccgtggaagatggcacaaagaggttgtgcgaaaggttggttcgaaccatccttgtggtaaggggc

SEQ ID NO: 498082 - DNA, 851 bp, Homo sapiens
  misc_feature (851)..(851): n is a, c, g, or t
caggcacgagacatcaaaccactaactatcacgaacactctatatcagagcactgaagacacgtagcaacagaacgaccgacttaccagtgtgaactcagatctctggctcactcacagtaccaactcaccagtgaattgacgctgcttactgcacagacacaggacgatctcttcacagccaacttgatctggcaatgtgcagacacaaactacacactctcaagtgagcactacacagaccgtgccgcccgacaattgactactacaccactcgcccccactacacagcacttcccgccttgattgcattgtaatctagagccatgtgaaaccacaccacctgtgtcagtgtgactgtgatcttgaccacatgtcttgccacagagcccctgcactatggccacttctctacctgactacccacaacttgggaacaataaatctcgatcgtacccttgcagcaacagcatgcaaatcaacggacgacctgtcgaatctggcacgcattgctgcactctctaatggattgcacacaacaatccaatcctatgcaacatacaccactgtgtggcccatccatactgagtgcacactctccattgtacctgcatcactgcattagaactatctcatcacacgacacattgacgctgcccttattgcccatcaactgagagcactcgccccaccaaccagatcacagccactttggagtttaagaacacacctgtctaataatataatgaagatggtcctcgtgtccgtctaccttcccatgctaaccaaagataacgcgtccaaacaattttccaatcaggcaactgacctacactagtctttgctctccgn

SEQ ID NO: 498083 - DNA, 319 bp, Homo sapiens
cacatcaatcctaggtatgtagtcaagagagagaattttctatgtccatgcaaagacttgcaccatgcaggttcacagcagcttattcctaacagcccaaagctgagaacaacccagatatccatgagcatcaacaaggtaaatggatgaatggcggcatattgatcgaatgaaaaaaaaaaaaatcagcaacaaaaaaaaagggacccacaaattaccacattaccacagattaactcctctcaaaattttgaccctgcattgaaagcagccagacacacaagaagcactaactcttaaccccatttattttgaattt

SEQ ID NO: 498084 - DNA, 106 bp, Homo sapiens
attgcatccgggccggggcaacagagcaagacctaccctcaaaactaacaaacaaacaaaaaaaacagaaaaccccacacagcacaatttgtaccagccagccgtt

SEQ ID NO: 498085 - DNA, 252 bp, Homo sapiens
aacatgtggtacccgtggtgggaggcagctactaggacaaccaacacaactaagccaacttcaaaggtccagactgctactgagtgccaccaactgcaccctacacaccacggtagttcttgggggtgccacttccccggtgtctcaagcaggggaacactgtgcttgtgcctgaactgggtgaagttccacacctggggaccaccctgggcccattggtgcccctgccctgcccctctgtcctcccaccac

SEQ ID NO: 498086 - DNA, 282 bp, Homo sapiens
tgtaccctgtacattcgtgtcattaatccccggtccacccgttatctattctaccatctttgcaggcacactcatcacagtcgctaagctcgctactgatttgttacctgagtaggcctataatataaacatgctagctgttattccagtgctaaccaaaaagattaaccctcgttccacagaagctgccatcaatgtatttcctcacgcaagctaccgcatccatgatccttctaatagctatcctcttcagacaatatactctccggacacgaattgtca

SEQ ID NO: 498087 - DNA, 159 bp, Homo sapiens
cacgaggaggatttgtgcttccaaactgggtcgaatttgttggaatactgtgctcgccgctcgtgcacatctcaagcggattccaaaagggttattctacagatcatccaatcggtcagaatggttgtggtgattcagacgggcttatcgatgccagtt

SEQ ID NO: 498088 - DNA, 155 bp, Homo sapiens
  misc_feature (73)..(73): n is a, c, g, or t
  misc_feature (106)..(106): n is a, c, g, or t
  misc_feature (125)..(125): n is a, c, g, or t
ggcacagggtcacgagagacaatggaaaatcttggacttgctcaaaattgtactatctctattcaggattatnaagtttttcgatgcgaagattcactggtggaangaaagataaaaggggtcantgagctcaggaagagcttactgtctgcctt

SEQ ID NO: 498089 - DNA, 382 bp, Homo sapiens
  misc_feature (49)..(49): n is a, c, g, or t
agagactgtgcgagatggtgtgagaaaggaaaagaccacggattctgangcctgcatgaactgtgaggtgtggaataggcaatgaaaaagtgcactcaaaaagcagagttggtccaggcttggaacaagaggtttgagctggagagtctgtgcagtggcagccataggaacctgaggcagtgggactctctgtggatagactgattcttgtttagaaacaacagcgaaaagaagaaggcaggaaagaaactccccggctcggaggaatgtctctgtgatccccattcttgatggagggagtgaaaaggggcctgggcttcgccccgttggtctcctgacagaaacagtaagtgacaccaggacagaaggcaggagcccttag

SEQ ID NO: 498090 - DNA, 188 bp, Homo sapiens
  misc_feature (32)..(32): n is a, c, g, or t
  misc_feature (40)..(41): n is a, c, g, or t
  misc_feature (43)..(43): n is a, c, g, or t
tgagactgtctcaaaaaaaaaaaaaaaaattnagttcctnntnttactgctcgttgataatgtgtctggtcacccaagagttctgatggagatgtacaaagagattaatgtttttatgtctgctaaacaacatccattctgcaggatccattactccatgggtcaaggagtaattttgactttcaagt

SEQ ID NO: 498091 - DNA, 814 bp, Homo sapiens
  misc_feature (313)..(313): n is a, c, g, or t
ggaggaaatgcggtagtgaccctcgggcctcgccatgaagagccgctgtagtaaccattgacctgccgcgccgtactcgcggagctgaatgcgtagcgtgcgtagagaatgcagaagatagacaaatgtttatgtagtggtggaatacatagagtacagtaccttattctgtcgttcaaaagaccgggactgttaaggcgtacagctttaatcttggaatggtggcaataaggaatgtcatacaacagtagatgttgagtggccagtaagtaatatgcatgcgcgtcctagttttgctgatgaacagatgccngaaaaaacaattttgtaagagtgcggagattacgtcacgtgcaaagaacagcttggtggtggactacgaattggtcagatcttccaacttgggagaacgtggattgaaggtctgacttacgcagtgtataatgcattgaagctctatgatagggggaacatggttccttgacagattgatgagtacgtagattttcaagagtattcctaaaggttagcgagactggattggagggcggatgatgttaagattggctggtcgtgaaggctatccacttgatcatgctaagaggtgtgaaggcttgtgcttacttttggacaggttgactgaaactagtagccagggtacctgaagggttgaagtactgaagagggtgttaaagcattatttccctatgggagcagtctcattggaacactgtgttttggaaagggatcgcggggtcatggtcggagtggggtgacaaaattggacgaagcgtctggaagagtgactgggcag

SEQ ID NO: 498092 - DNA, 182 bp, Homo sapiens
  misc_feature (24)..(24): n is a, c, g, or t
  misc_feature (30)..(30): n is a, c, g, or t
cctgaatatcaattaacacagtantataanatcctctgcatctgcactttgaaaaagcatcacagggctgggagcagtggctcacgcctgtaatcccagcactttggaaggccaagacgagtgaattacctgaggtcaggagtttgagaccggcctggtcaacatgaagacaccccgtgtct

SEQ ID NO: 498093 - DNA, 230 bp, Homo sapiens
  misc_feature (53)..(53): n is a, c, g, or t
  misc_feature (101)..(101): n is a, c, g, or t
  misc_feature (222)..(222): n is a, c, g, or t
tgaagtgtgctggggccagcgaggagaggacggcatgtgtatggggcccctgngggacctgccctcacttttgatgactgctgctgccgccaaggccgcgnctggggtaccagtgcagaccgtgcccgccacgtggcacccgggtcccagtgcccgacttcacagagtgagagcaattcattctgggacacaagcccccctgctactggggaagtctccgcnagacgaag

SEQ ID NO: 498094 - DNA, 339 bp, Homo sapiens
  misc_feature (339)..(339): n is a, c, g, or t
tctacattctgtctctatggatttgcctgttttggacattttaaatggcatcatacaatatgtggcctttggtatttggcttctttcatttagcgtaatgttttcaaggttcatccatattgggacatgtatcagtacttcatttctttttgttgctgagtaacattccatagcatggctataccacatattatttattcatttaaacacggggtgtttgccaatttttttttctttggggcccagactttattaaattttagtcagtcaaaggaaacaaatcaatgctttcttagggggcaaggtattctcatctatgagcagtgcccagacagcggn

SEQ ID NO: 498095 - DNA, 171 bp, Homo sapiens
aaaaacccggaaaaaaattttgtaatttggggccgcggtggtttttttttttaaaaaaccccccccccaggtttttttatttggcccccccagaaggtttttttttccccttttttttttttaaaggggttccccttttttggggtttaaataaggggtgggggtgcccga

SEQ ID NO: 498096 - DNA, 242 bp, Homo sapiens
cttgagacagagtctcattgtctgtcgcccaggctgaattgcattggcgcgatctcaactaactgcagcttccacttccaaggttcaagtgatctcaatgcctcagcctcctgagtagctgggattactgccatcatggggttatgccatgggatagctgccatcatgcctggccaatttttgtgttttttagtagagatggggtttccccatgttgaccaggctggtctcgacctcctaac

SEQ ID NO: 498097 - DNA, 1119 bp, Homo sapiens
gcccgctcccacgtgcttcccggcgcccccgcgggcctcccgctctattctccccctggggagggctccctgcgcccgggccggcacggccgcggtagtggcacctcgggggcagagcgctacaagggccggcgcgtgcgagacacgggacgacggcacggccgagaagcagagagagcacgagagagcaagcggcgaagagcgacaggcacacagcggaaggagccaagacaagaacgagaagacaggagaagaggcgaagacaacaacgaagagagcgcaacacagagcgcaagagcgcgccacaaacaacagtgagcgcaaaggcgcagagcgggaacaaccaacacaacaggaggaaaacacgaaaaagcgcggcggcgaaccagcaacgaacgcagcggacacgcagagaagaacaagaacgagacaacgaggagaagccacagaaaagagacacagacgacaaaagaagacgacagcacgagcgccagcacacacgcaggtgagggcggccacacgcacagcgggagacacagcaagagcaaccgacgacacgcacagggaggaagagaaggagacgacacccatagagagcggggaagggagagataacacggaagagtgggagcaaaaccaccagcgagaacaccgagcggaacacacaaagacccgagacagacaacagcaggaggacgcgaggccgcacaaacagaaagagaaacacaggagaggaatacaacggaggagagggagccagcaggcaaaacaaggccgcatcacacacgagacaaaacggcgcaaaaacagcagacaacagcgagcagccgacgaagggcgaagacgaaagccaggagacacacagcggacaccgcacgagggagataaacaacacatcacacaccagagaggaaaaaaagccgagaggagacaggaaaagagacaaggcaacaacgagctcacgaagcacaacacagaaggaaacacacacagcgacagcgaggagaaagacccaaagcggcagcaccagagagcaacccgaagacggagacaacacagaagaagcagagacaagccacccgaacaacaagacagaaccacccccagcacggggagaca

SEQ ID NO: 498098 - DNA, 150 bp, Homo sapiens
gatctagaggatctcatccccggctctgggtactagcaattcccctgctcagcttcccgagtagctggaataacaggcacctgcaccatgccggctaatttttgtatttttagtagagacaagattttgccatgttgtccaagctgatct

SEQ ID NO: 498099 - DNA, 263 bp, Homo sapiens
ccgtgcgtgagtggcaaggggatcaaatgagctgctgtggggcggggtgccccaatattccagcagcctgtgaggcccgcccagagccgatgaaagcagggtgataggcagccctactccgttaaccaccgtgctgcatggggacctgctcaggggggagtccctataggagctgccatcatcagcaacaggagagccgacccctcccgggacccctcccggatgggcggccccacagacccgttggaaccctgcagcggccg

SEQ ID NO: 498100 - DNA, 261 bp, Homo sapiens
  misc_feature (4)..(4): n is a, c, g, or t
  misc_feature (156)..(156): n is a, c, g, or t
  misc_feature (175)..(175): n is a, c, g, or t
  misc_feature (192)..(192): n is a, c, g, or t
  misc_feature (199)..(199): n is a, c, g, or t
  misc_feature (231)..(231): n is a, c, g, or t
  misc_feature (240)..(240): n is a, c, g, or t
  misc_feature (255)..(255): n is a, c, g, or t
  misc_feature (257)..(258): n is a, c, g, or t
  misc_feature (260)..(260): n is a, c, g, or t
cgtntttttactggagacagagtttcaccatgttggccaggctggtctcgatctcctgacctcaggtgatccacctgccttggccttcccaaagtgctgggattacagacgtgagccaccgcgcccagcctagaagtgatttttgtcaggagacanaagacctttagtgattggngtcaagcaggtggagtntgaagancagctctgccctttagctgtggaaccttgagnaagcacctnacctttccagggctntnntnt

SEQ ID NO: 498101 - DNA, 133 bp, Homo sapiens
gaaagagagacatcttgtcgtttgataaaatcaaagaacaagagggagagagagcgccagaggcagcgggaacgggcagatccgcgaaacggagaggcggcgggagcgcgagcagcgggagcgggagcaacgc

SEQ ID NO: 498102 - DNA, 154 bp, Homo sapiens
gtctagatgtatcccttcgattgtggactcagaggataagatggcatcaatggacttcagtggagatgaggagcagcagggagaatggagtatcttggattcagtggaaggagtcgttgacatgtacttatgacgcggcaactgtgatccaatg

SEQ ID NO: 498103 - DNA, 473 bp, Homo sapiens
cgcagtggctcatgcctgtaatcccagcactttgggaagctggaccatttgtgagtcaggaggttcaagaccatgcctgcaccaacatgtggtgacatcgccaatcttcacgtatctctaccctgaaaaccttagccgtggctactggctggtgtactgccgtggtacagtcttgagcatacctcaaggaggctttgcatgtacggcagaagcgggacagttcaagcttgggaaaagccccccatggggcacgggtgcccaacaccgcaacttcggctttggttttaggaacagggtctggatgcaaaccttcaatggttgcatccccgataggcacagcatcgcttacatcagcgatcgattccgcacatacgacacttcgacaacatcaaatgtgtgtgcagcagcgcgtcactcctgtgcggagtctacccaacacgaatagcagccgctcgctcccgaccccgtcacct

SEQ ID NO: 498104 - DNA, 477 bp, Homo sapiens
  misc_feature (21)..(21): n is a, c, g, or t
  misc_feature (69)..(69): n is a, c, g, or t
  misc_feature (362)..(362): n is a, c, g, or t
tttgaaacagttgaaggtctnctgttagggaccgtgcctaatcctagggaattgtactgaactcgtggnagcatgttagtatcagatgtgtgcccttgtcccgtcttgcttgtaggaagaacaagagacgagacacagcaaggtgatgatgggtatgtgaagcaggataaagaaaaaaacaggacaggcattacaggcttaagtctgtaatcccagcactttggaaggccaatgcgggtggatcacctgatgataggagttcaagaccagcctcaccaacatggtgaaaccctatccctattaaaaatacaaaaattaacaggcatggtggcgggcatctgttgttccaggtactcgggagnctgaggcagcagaattgcctgaactcgggaggtggaggtagcagtgagctgagatggcaccactgcactccagcctgggcaatggagcaagactctatctaccccccacccccaa

SEQ ID NO: 498105 - DNA, 246 bp, Homo sapiens
  misc_feature (237)..(237): n is a, c, g, or t
  misc_feature (241)..(241): n is a, c, g, or t
ctcagtaccagaagagacggatgtgaagacccaagagagcacgcttttcatagttggatatatttttgtgtggtgtgtggtaatttttgcttcttttgtgatacaatttgtcctctttttataatagttggggatttttcactgacatgtgagtaagataaatgtatacaattggggatttaattgggaaatgtgctttcacttgtgagtttcagtcattttctggtacgtcgggtntcantgtac

SEQ ID NO: 498106 - DNA, 366 bp, Homo sapiens
  misc_feature (1)..(1): n is a, c, g, or t
  misc_feature (345)..(345): n is a, c, g, or t
naggcccatcatctcaaggtaacggcacattcttattaccacatgcattaatccatttctgcactgctataaagaatacatggaactgggtaatttataaagaaaagaggtttaattggctgacagttctgcaggctgtacgggaagcataacagcttctgcttctggggagacctcaggaaacttacaatcgtggcggaaagcaaaggggaggtaggcacatcttacatggctgaggcgggagaatctcttgaacccggaaggcagaggttgcagtgagctgagatcgcaccactgcactccagcctgggcaacagagcgagactctgtcacacaaacacacanacacacacaaagaaattacca

SEQ ID NO: 498107 - DNA, 1909 bp, Homo sapiens
  misc_feature (1661)..(1661): n is a, c, g, or t
  misc_feature (1759)..(1759): n is a, c, g, or t
  misc_feature (1909)..(1909): n is a, c, g, or t
gtaggcgagcacgaggcttagtcgagacagccagtagtagctcgacagagtgatgacgtcagtcaaggggccagtagcagatgttgcagcatcttgtgagagatctgacggagtagtgaaatgagcagcccagggcagacggatgcagaccagagttataagcctacgcactcagtactaactcaacgcgcgactctattcctcgctcactgaacgtgtcctgccatcaattccaaatgttgagagataacagctgacacagtgtagggccaggtcagaaagcacagaggacgtctgaaagcagccccgctgtgagactagctacggacaggagacataacgcataatgtgatactgagtcccttatagaggagtgagtcggacaaccacggataggttcattggtggggccacaaagactcaattgttcgggggaatatgcgatatatgaataagcagaggttagggcaaggggacaggaaactacatagcttcgtcaaactcctgggaggaactcgtaagcgactatgcaggttaacgtcacggtcagtgttgtgcgctccttctattagggccatgagaggcacctttcccatctccaaggctctggcaaatagccctatatggagaaatttaaatgtctaggccaacttccagaccaaaccgaagaggaggcgcccccttccggtggagaattaggtggacaccgcttctagttcttcggattggcaaaagaactcctcatgcaacaggcggtccgtgtggtaaaccggttggcgtccgcaggagatacgggggaaagagccaacagcgaatgtgccaatatcctatggttgtggggaaaggctaaaacctaaatgcggaaaccccaccgaggacgaataacccgttattgttcgtggaacggcaaagggcagtgcactggctacacacgtcgccgacagaactggctcttcatcaacttaacgcggccccaaagtataaagggtgctaaaaagcaggtgtgccgcctggttcacgagagcaaacaggggcgcacacgagggcctaaatctgctggggatgctattttttcaaattcgtgataggaagcacagcccaggatgcttaacactaccagggagacggggtccggattatcgtcaggggcaacccaatatgattaagcaacgatttgaaggaccaaaaccaataccttccattacagaagataccttccgtttaaatacgaacgtaatgccatagggaagatgcccccctctagacgcaagcggcccccaacaagttatatggcgccaaatttgcaacactgttcggttaaattccgagggcccgccattaattgtgacaggcacaaatttatacatggacctcaagaggatagggatatataggcgcccataacaatgtgcgatcgcgaatgagaatgcccccgtggttgggaacagggattttcatcgcctcgttggtgttcgcaccgctaatcaccggaacagaccttaaatatgtgccccttgtgggacgccgggaacaacggagcacacctctcttatcgtgggacaaatcgaaccgcagtggcggatcatttgcgacagtctggccattctggcacgctctcgaaagcttactcgcatacagtcgcgcgccctctttgagggagnatttacgaaagtcttctcaaaaacagcgagagagtgttcaccaccaagttgtccctcacaatcgttggacacaacaaccgagctctttcggcaggttnttaataatctaggaagaatcgcaccagcggttgtacgctattaggcggatggcagtaccgaagatcgaaccagccgcagctgattgggagacagcacatcggatttcgtggcaccgattatgtggctcattcctgctcatcgtcaacagn

SEQ ID NO: 498108 - DNA, 216 bp, Homo sapiens
catctccaacaaataacatcaacataattcaacatcaacacaacagcagttcagcaggtcataacagttcaacatggtgtttgcaggcacattcgtgcaatcagtccaggtcatggcgtcagcagggtcagccatgtctaccagtgtggcatttgaggcaacacagcatcacactcgcaaccatgttgcagcaagcccgccatccactcatcaggc

SEQ ID NO: 498109 - DNA, 186 bp, Homo sapiens
ccacgaagattacaggcgtcaccgtttattcatcatggactggcttattagatactggcctggcgtcaatacatccgtccttcatgatagaagctccctgcgctgaatgactgcatccctctctagctgaagtgagacaagatggatactggtgaaccaagccaccacatactgtaaatacactac

SEQ ID NO: 498110 - DNA, 1306 bp, Homo sapiens
tggtctagaattttatgtttacgggttcttcgattgtgtggtagggtggggggcatccatggtagtcactccaggtttatgggaggggttcttctacttattaggacttttcgcttcgaagcgaaggtttctcaaatcatggaaatatttattaattataactggctggtaagaaaaatggatatggagcctacgcgtgaaaatgtggcatctccgtggtgaagctccttcaccttcatgtgaaaacattcgtggagggggattcccaccccattttccgtgggggcaggccttcgaaaaccattcacatgtgaccacattagcgattgaggccactgtgcgtgctttcttccatgggccaccctttttccgcgagtgttattgcagcttattcgtggttcaaccctcctgtggaccattttttcacagctcattttaaaacgcatttgggtgagattcgcagtgtgggaacagagggctcgtggggggaacttattgaatttgcccccagcgtgggccgcggtgacagaacttcctgtggaggacaagcgtggtccctctttcggtgcaccttgggggggacattcctccttgagaatttttccgggtggttttcggcgtggaacccaggccccaaagatgtgttttcacggctccggggggcacgaaccttgggaccagaatcaaaggcctgggggacgaacacgcgggcggccaactttttttcgcaaaaaataaaatttcccgggggcggtagaaaggggccccggggataaattcacctcaagggggggataacccgcgctggttcacccacgggaaaattacacacaggtgcggattagaacatattttcccccaaaagaggggcgcgttttcacacccgtgggcggaaacaacgcactcctcttataagaaaggcaaatacaaagaggtggcggcccattatttctttcaaactctcctatacgtctcttcgtcgcaacaaggggtcgtgggcgtcgcccgccgttgtaaaaacacccatctgcttgctggagaaaaaaccgggtcgaactcagcgagcacgctcctcaaaagagagcacaccaacagcaggggggcaaataaaaaacataagtggcggcggacaaaaagtgagtatagaccgtggtgatacacgctccacacaacgggcgtgtaaaacgcatcatgagtctcgctaaactaactgagcctgggagcaaacaaagatagatctaagaactaacactacgtcatggagcgtcgttagacaacgatgatgctagggcgcatacagttcatc

SEQ ID NO: 498111 - DNA, 1184 bp, Homo sapiens
aacgtcctcagatcccacctacgtatgatgggcggggttgctactacgcgtctcccgtcatcaacctcgatcgcctgcctcctatgcttggctctgtcgtagcccctgtagtgcgtgtcgctctccggtgaactccccgatgggacgagactgtaggccctggtttgcatagccgcgtaccgcgtgtcggtcgagaaatacgtctaagcgtctccggagatgtgactcatggatcgcatgaccatggagaactcgtcctccgctgagtacaagctggcccacaggagtgacaatcagtacgcctaagtcgagtagagtatcacctcgcaccatcgaaccactccgtcgagcacctccctctacagatcccgaagaaccgcggatctcccttgtgcaccgacctacaattccgcgaaccgtgccgtattgcaagccagctcggactagatccggattggaaccgcagtccgggtgactgcgaactcatctcctccatcctggctggttcgaaggctccgagttcccggcgttcgtagccacaaggcctacacctcggtctcggtgcctctgccttccaacggacctacgctgcattcggcactcagacggaacgcgtcgacttcgagcaaagacagtagctttccgaccttccacaccatggtgggccttgacaacccgacacggccccccgaacatgttgggacaagtgcaagggcccggcggccgaaattgcaagcctggccgtgccatcgtcggagcaagatgctgccgcgcaggggactttcgaaacctcaccggtttggcaaaaaccgacaaggttcgggtcacccaaaaacccattgaacgggcaagcttgccacgaacccttttcggacgccgcggttcacccatttgattgcccccagaaagaagtttcattggggccccagttcaatgcccaggattgactggggcctaacgcaagggggcccagaattgatgcaccactgggtcacaaccaccggggctcccgagctgtgggtgcggcaatggaacggttccgtcgttcccaagccccgtgggccttaattcgggcttccgaaccgaagttccctcaaccccagaacccgcgggacaagggcactctgaacccaaatcttttagaaacttccaaacctgtgggtagggagaaattgcgcacccgt

SEQ ID NO: 498112 - DNA, 166 bp, Homo sapiens
gaggagataaaaccattgtttttgtggaacaaaagaagatgtgatgagcttaccagaaaaatgaggagagattgggtggcctccatggggtatccatggtgacaagagtcaacaagagcgtgacttgggttctaaatgaattcaaacatggaaaagctcctattct

SEQ ID NO: 498113 - DNA, 700 bp, Homo sapiens
  misc_feature (278)..(278): n is a, c, g, or t
ggacgctccggcccatccgctgtccagagcgcgcgaggttcgggtagctcggacaggctgctggtacgcggcgtccagccggcggacaggctgctttggtttgtgaccagtccaggcaggacggcctactcctctccagatatgaaggatctttctgtgccacgtgctgcgatggcctgtccattcgtggcgttgtggagccgagctcaagcatcgcttgaatgtgcttatctccctgctatgtaaccagatagagcgaatctggtactgcgctgaangccgagcgatctgtgtccgatccaggaacaaattacatgcagtcgatcctgtcgtcgtgacgtagatgaccggctactctgggaactctctgtgagcagtttggcgcacacgtcatgtagccataggacgcgtggttccaccgggcgcgtgttctccatcaccagtagaggcagtcgaattgtttggttcgtggcgcttccagtgggacacttctagctgcgtgacctagaggtctttcctgtgccagattttcatgttgcgcgcacgtgatggccgcggcgtgctggtgcaacgcagtcagcccctgtcttggcgtggccggcgtcctgcgtagtctgtagaccttgcttgcctggctcgcctgcttgcagggtttgtggtcaccatgacctgtgcaagagcgcttgtcccctcagaatcc

SEQ ID NO: 498114 - DNA, 384 bp, Homo sapiens
ggcaagcatgtggtgtttggcagagtgaaacaaggcatgaatatagtggaggccatgggagcgctttgcgtccagtgaatggccctaccagcgaagatacgatcaccattgctgtctgtggagcgactcgagataagttagacttagtgtattatcttcaaccaccagtatcattccttctgtacgtctcagtgagagcacccctccaccccatttgcttcgagagatatccttagtaatctttgtgcgcatcgcttgaagcttccccttgggctgtccatagattttcctttgttccctcccatgcactagctgggattgtggagattaagtgtatgatgtatgaaatagaaactatgataacaagagaaaaaaacaaaaagg

SEQ ID NO: 498115 - DNA, 115 bp, Homo sapiens
catctcaagctctcacaaaaatggctgattactatgcagaaaagcctgcacccatcaaaggtatgtgctggcaaacagtgaaactaagggctgccggtgtcacttatttattcta

SEQ ID NO: 498116 - DNA, 219 bp, Homo sapiens
tcatgggggcatatttttcatgaatggtttagcactattctccttggtacagttctaacactagggagtgtgttctcatgagatctggtcatttaaaagtatgtagcaccccaccccttgctctcttgctcctgctttcaccatgtgatgtgactgcttcccctttgccttccgccataattggaagcatcctgaagtctccccagaaacagatactgc

SEQ ID NO: 498117 - DNA, 160 bp, Homo sapiens
tattagagatctattgctcctttagcattctgcgtaaaggcgtgacttgggccccaagccaggacagagatgagagcagtgtcaagcccagagcaaccgggctcaaacacacgaagaagtcagggtccgactggagttcttaggcagtggtccctgactg

SEQ ID NO: 498118 - DNA, 476 bp, Homo sapiens
gtgtttgtatgccatgccccctcaccccaccattgtttccacttatttctcattcttcaccttaccagttgaagaactggatgccatggcaaaggcccgcatagctttgctgccatggtagagccaggattcacactgagctccatctgattcccaaagtgaggccagtgccacagtgctgcctcccgtgacgcaagactaaggggatttatagcagattcagatacagctattctagtgaagcagttccgcaaactagagttcataaaaatagtctttggaagagaaataggtcattttaatctttttactttctcacaaaaataggcttttctaaagtgaatttgtaaaggaaagaattattgagtgcagtgcatgatgagaggttttttttttatttttagtctatgacaagatagtctcatgattttttattgaaataaaatgtacattttggataatgcacaatcataaat

SEQ ID NO: 498119 - DNA, 351 bp, Homo sapiens
  misc_feature (40)..(41): n is a, c, g, or t
  misc_feature (76)..(76): n is a, c, g, or t
  misc_feature (93)..(93): n is a, c, g, or t
  misc_feature (111)..(111): n is a, c, g, or t
  misc_feature (156)..(156): n is a, c, g, or t
  misc_feature (169)..(169): n is a, c, g, or t
gcgggtggtggggggtccgtggggggggttgtgtgtgttnnttagttggtggagctttgttgggatggtttggtcngtggggtggccctcctntatatgttcttgggagcntttgggggtgagaacacaggttctcggttgagaattagttggtangtgtggggggccncatggtgggttgggccgaatttgcccttcacaagttttcggaacgtaaggggggggtctcccccgccccattaacaaaataaaaccctcattcacagggggaaacaccctcagggtaaaacacctatcccccattttcctcctatccctcaaccccgacatcattacgggtttttcctttta

SEQ ID NO: 498120 - DNA, 586 bp, Homo sapiens
ccacgcgtccgggcaaatacttgaaatggaactcactccttccactttccccctatttcctgggacagaagaaagggggaaagtggaaggagtgagttccatttacgtatttgttcggtcgcagtgaaataatcatctttgaaagataagaactaaaggagaaaaactaaaaccataaaaatacaactgtagatagtcactctcacagacgaacacgacccccacgcaccagccccaacatcggagcacacaggtacctcgaggagaacacacatcacccggcgcgacgcacgcacgggatgcgaatcacacgactgacgcgcagatcaacaaccatacaacgcagaggagtctctgatcaaggacgaattgaatctgccaaggttgcaaaacatcagcaggattttacacagcatgatggcaacacgaccaaagacgcactacacgtagcagaccgcgcagaattcgcagaacagaaagcacacaactaccacaaacgaagcacagagtagataaaaacaacagtaatgcgtactagaagaaaaagagactctcagcggatggaggactatccacatcagcgcct

SEQ ID NO: 498121 - DNA, 302 bp, Homo sapiens
ttgtcccctataacatttatgtgactcttctctcttacctgaacgttgcccaaaaagagattgtgacatatatttgggcccagcaccaaggtgatgtaactctcctcttcagccgggccttgccaacaagaagagagaatgacttattcctgagtttagcatacaggtgatttgattcttctgctgactcccagaagtcactgtaacatatatctgggtccatcgctgagactgtgtgactctcttctccctgggacctgtccacagtggggattgtgacgtattgcttggccaagcagtcg

SEQ ID NO: 498122 - DNA, 1358 bp, Homo sapiens
tacccattctattcgcattggcatatcctaatggcttaccgacagcgaacataattctaggctatatacaactacgcaaaggccccaatcgattgtattgcgccctgacgggactactacagtcttgcgttgacgccataaaaactcttcatcctaacagaagtccccataaaacccgccacgagtgtagccagtcaccctcgtacactcaccgacgccgggaccttagtctctcagccactcggcgtcttctagcgtatagaacgcgcgcccctccccacataggcacgaccccccttggtcgaacggcaacgcgtgagggcctcctaataaatgctagccgaccggcggaagccttagccaagttttacgtgcgaatccgtgcgtgatcgagagagcttgaagctatcaagacgtgtctgtaagcctatagcctcgtggactcaggcgtgacccttagcgaagccatgtaaaccccaaacatcaaggcgtcatttattgaaaagtcatccccatacgtccgaatccaatttcgtgagttaatccataacattagcttaattgacaggtggcgacgtccctgtcaaaaggctcttcgtggcgcaacaccgtgtaattctattggagcatcagaggagagcgagccattcgtggaactccaggtgccctgcccgagttgtcaattgaaccttgtgagccaataaagtcgtggaatattgaatcctcacgagcagtaggccagaagaaccaaaaccggaaacccgccccttgcgaaacacttgtccgaaagaggggaaaggtgccggaaaacgtaaatcctccagggcttccaagcaatcgagaatacggcccgacagggccccccagagagaccccctaattgcctgcaataagcccgcgaaactacacacaaaagcacttgatttactaaaatagagagacaacgcgttgagccaaggtaggaacaacattccgcaaaaggaaacagacccaaatggaacgggagactcatagccgcggagaaacgcgagaacaaccaaggcatagatggaaggtgacgaaccccaggaagacgcctaagcgtgctaaaagagcctacaacaggggacgggcgagaaaggcaccgtcgcgagaaggaggcaagagaagcccgcgggaatagacgggggatggagaaacgaagagatgaatgagacagccgagcccgtaagagtaacgaaagagagctcgcgaaaggcgacagcgaacacaggagcgacgagtcgagcgacgagagggagaaggaggagcgccggaagacacgcatagaaggagggaccgaggaagcgcgccgagacgaagagcgtcagaaagagaaa

SEQ ID NO: 498123 - DNA, 1209 bp, Homo sapiens
  misc_feature (444)..(444): n is a, c, g, or t
tactttgttttgtttttgtgtttggtgatgaggaggggggaggggggggggaggagaggggcgaggagggactcattaagatgagtgagttgagagactcttttgtggtgttccgtgatgtatatgtttgttatgacgagtggttggccttgtgtgtgttcgtctccgcgcctcccggctcggtgcgcgtgcgtgtgttgcgttggtccgccgcgctggtcccagtgaacgaggagggcggccaggaaagccctgtccgattgttgtctcttgtgttcccgccgcacgtggcccgccaggcggcaggcggggaagaagagggtgtccaccagggggacctgcgggaacccgcgcgggggccgccagaggccagagccccatgacctttcgccgtgtcggagtcgtccctccagggcaaaaaagtggagaggtgcccctttaggnccctccctcaataggtgttcttccggcatgacacgagacgccgaagccgcgatatgtggctcgtggggggccccgaaagaaactcgagactattgtggttgggaccccaaggaatggttcgcggcccacaactggatactcggggacccaccacgcgtgcgggttataaaataatgaaggggcccatagaaggagggatgccacttttccaaaaggcttgagattgtaatggtgttttcacgaagctataatttatagaaggatgttgtttcacggatgccacaaagactggggtgacccccctttgtttgtgtccgaagtggttctcatatgcggccaacttcacttgcgcgcttccccacgcgattttcctagaactcggggtaatataagggtgcactaattgtgaatatgttctccacctacccacaatgaactctgaggtgccacgtgggaattctccatttaagggttttagaaatatttcacgggatcctctaatgttttgatattttgtttttctggaattggattttattttattttattcttataatttcacggttcattttaattgtgtgtttctggaacacagtggaaggttgactgtgaccctttgagatcgttatggagagttcagccgtgtatgtctctctttaccccgtggggcacctaacttgtgggatttttatactctaaaaagtagaatataagactattttgaagaatttgaataaagtgatgaaggttgccattaccccctcc

SEQ ID NO: 498124 - DNA, 112 bp, Homo sapiens
agctcggtaccccttcactttttacaccaatttgggacccggttttcacattctcagcacaacagtgcacttctgttgtcatatgttttcccatctgtgccagtaacagctt

SEQ ID NO: 498125 - DNA, 126 bp, Homo sapiens
gcttgatgagctgccactgcaacatattttcacaattctctaataaatctgcccttctttacctacaactatcttggtaaatggctttaccacctgcaaaactgaccctaggtgttgctacccaca

SEQ ID NO: 498126 - DNA, 509 bp, Homo sapiens
taaacagactttgcaggtgctcaaaaggtacatgtggtctagatggatacggatactacgacagtagagctactagcaacattgccattacaagtaggaagttcgattcggcagttagacctgaggagtcttccagtgagggtattctgcaagtctttaaatcacaccacagttaggaacgtacacttaggactgtaacatgtcctgaatatacacactagtatgtgctaggatcatcggcaaggtaagcggatgcaacaagacgaatcctgggcattaccatttggctggtgaaataaaagcttctcaaaacaatacctacacttaataaagtgcaacaccctgatttttctatcttatccactttctttcttccatttaaagaaatttaaatgttgggcttgcccactaactcatgtactcagaaggatgaagctgcaatagctgaaagtaacaaatgtctgggtgtctggagactttgacaaatcttgctctggcggtaaaagctt

SEQ ID NO: 498127 - DNA, 358 bp, Homo sapiens
cctattgtctagttgctctcagcccacaatgccacacctctgtctatctcctgtgtcgggacagcgcgagactcaaagtcagagctctacgaaacctgcaggacagaaacgaagcttagcaggcctctcaaagacgaggcccagagcgggcacggtgactcacgcctataatcccagcactctcagaggccgaggcaggtggatcacttgaggtcaggagttccagaccagcctggtcaacatggtgcaaccccgtctctactaaaaatacaaaaaattagccgggcgtggtggcgggcacctgtagtcccagctactcgtgaggctgaggcaggagaatgacgtgaacccaggaggt

SEQ ID NO: 498128 - DNA, 580 bp, Homo sapiens
gactctagtagctgtacagtaactcttaacatcatatagggcaattctttccactttattgattgatatcctcagaatggctttagcttttcttgccccttgcctttccataaaaattcaaaatatgcttgtaagtgtctacacacaaacctgccataattttgataacaatcaaagcagaggtgtccaatcttttggcttgcctgggccacagtggaagaagaagtgtctagggccacacataaaatacacacacacccacacacacacacattgactctcacacacacacacacaaatggtctgagtatagtttttattatatatctaccaccacagattagcaaaaatgtccttgcgtaataatcctaatgatgcactgccccattcagagggtctttcaaaatcattgaacaggttccaagtttgcaatctctgatacagaaaatgttcatatgtagctaaacgttactacttttttgatattttctattataaaagaaaatagaacctcttttaactagtggggtacttgacattgtttttgaaaaactaatccatcaatttttggctaggtgga

SEQ ID NO: 498129 - DNA, 352 bp, Homo sapiens
caggaccgaagcactggggacacaggagccagttcttgttgacacaaggcctctaagctaacactggagcatattaccatttgctgtgtggcacccagcttgggactcaggatccagttcttgttgacactaggcttctaagctaacactgcagcatattaggcattctgctgtgctggctgaggggcttgaggtcctactacggatgtacaccgtttccttagtatgattcacccttctttcccagtgcttcagccccgtgcctcacagtcctcgagtcccgagctctactccttactctatgctcgtgctttctcctgtgtgactaccctgccattcttgggggtcccgc

SEQ ID NO: 498130 - DNA, 562 bp, Homo sapiens
  misc_feature (312)..(312): n is a, c, g, or t
  misc_feature (444)..(444): n is a, c, g, or t
gcttacctcgaactcttaccttgtcggggacggtaacgcgggacccggtgtctgctcctgtcggctgcgcctcctaatccctaggccatgatgcgtgagtgcatctccatccacgtggggcaggctggtgtccagattggcgatgcctgctgggagctctactggcctggaacacggcatccagcgccgatgggcagatgccaagtgagcaagaccatagggggaggagatgactccttcaactagtcttcttcagtgagtacgggcgctggcaagcacgtgccccgtggctgtgtctgtggagctgggaanccgcacagtgcagttgatgaagattcggcactggacaccgtagccgacagactacttaccagccctggagacagtgtcaatcagcaggacaagggaagaatggctggccaagtaacgtgatgcccgtagggncgacgtagcactcagttggacgaaggggaggactcagtgtgatccctctgatgctttggaacgcgtaattcgcgacacgactggccatgaaccgagttgtcaaccggatccttcaggg

SEQ ID NO: 498131 - DNA, 1002 bp, Homo sapiens
  misc_feature (1002)..(1002): n is a, c, g, or t
aataatcttcttcatagtcatacccatcataatcggaggctttggcagactgactagttcccctaataatcggtgcccccgatattggcgtttccccgctaataaacaacataagcttctgactctatacctcccgtctctcctactcctgcctcgcatctgctatagtggaggccggagcaggatcaggttgaacgatggtctaccctcccttagcagggaacgtactcccaccctggagcctccgtagacctaaccatcttctccttacacctagcaggtgtctcctctatcttaggggccatcaatttcatcacaacaaattatcaagatataaagacccctgccgataacccaagtaccaaactgcccctctgtcgtgctgatccgtcctaatcacagctagtgcctacttctcctatctctcccagtcctaggctgctggctatcactatactactaacagaccggctaactcaagcatcaccttcttcgagcccgccggagaggagaccccattctataccaacacctatgctgatttttcggtcaccccgaagttatagttcttatcctaccaggcttcggaataatctcccatattgtaaacttatactccggaaaaaagaaacatttgcattcataggtatggtctgagctatgatcttcattggttcctagggttatcgggtgagcaccccatatattaccagtacggaatacacgtagacacacgagctttttacctccgtacataatcatccctatccccacgcgtaaagttaaactggatcgccaactcacggacacaatgaatgactgctcagtcttgagcctagattactactccacggaagaccctcaggaatgttacaacctactactagccacgccgtgactgaaccccagcccaagacaatacacagagacgacatacaacacacacccactatacgatatacatcacacctaccccaatccacagcgaccaacacgagacgn

SEQ ID NO: 498132 - DNA, 215 bp, Homo sapiens
tttttttaaaaaaaattcccccttccccacttggtcctcccccttcccagggggccaatttttaaccgcaaaagggactttggggttgtttgtttagttttgggaaaaaatggaatgttggggaaatgccccccccctgggcgggggggttcctttcccttttccccgggtcagggctattaatggaagcaggcccagtaagggccctttgttta

SEQ ID NO: 498133 - DNA, 465 bp, Homo sapiens
  misc_feature (32)..(32): n is a, c, g, or t
  misc_feature (84)..(85): n is a, c, g, or t
  misc_feature (97)..(97): n is a, c, g, or t
  misc_feature (113)..(116): n is a, c, g, or t
  misc_feature (143)..(143): n is a, c, g, or t
  misc_feature (178)..(178): n is a, c, g, or t
  misc_feature (199)..(200): n is a, c, g, or t
  misc_feature (210)..(211): n is a, c, g, or t
  misc_feature (247)..(247): n is a, c, g, or t
  misc_feature (284)..(284): n is a, c, g, or t
  misc_feature (308)..(308): n is a, c, g, or t
  misc_feature (341)..(341): n is a, c, g, or t
  misc_feature (416)..(417): n is a, c, g, or t
  misc_feature (431)..(431): n is a, c, g, or t
  misc_feature (440)..(440): n is a, c, g, or t
  misc_feature (453)..(453): n is a, c, g, or t
  misc_feature (457)..(457): n is a, c, g, or t
  misc_feature (462)..(462): n is a, c, g, or t
agcacagtgttaataaccatcttcagaaattntacagtattaaacatgtcttcagccaagctccaacactcagaagacaaaagnnttggggtcaaangctattaatccctttnnnntttttttttttaagtgtcctcgttttntgggggtgggcgaccggggcttgtgggcgttttgntgggggtggttttttcggggnngttccggggnngggtgttcaatccccggtgcatcgggggggggcccnatagtcgatgtgtattcgggggtactttttttggtcnccttttttttttgggtcagggaangcctgccataggctgggcaaatacttgattgtncccatgtttccctggggtgggcagcggccctgggtcacacaatgggggccacacttccttttccaccttcctggnnacctgtttgttagntaaggccangggtgggtggctnccgnatggnggt

SEQ ID NO: 498134 - DNA, 173 bp, Homo sapiens
cagttttttgattttttatttgggtaggttttggggtccaggcccttttttttaccccttggaggaaataagatgagggagaaaggaaaagggggggaaacttctcccctccccccttcccctttagctttttgaaaatgggcccctgcagaataaatctgccagtttttata

SEQ ID NO: 498135 - DNA, 620 bp, Homo sapiens
gggggccaaacggttttctttccctttggatttccccccctttccccgccatttggggaggtttttaaaaaaaccagaccttccctccaaattcccattttgggttttttttggaaacccagggggcttttaaaaaggcggtttttaaaaaaaccaggggtggttttggtcggggatcaaaatttgggtggttacaaaaaaaaggaccccccctggggaaacaaaaccgattttaacctttaaaatttggttcccaatttcccggccctatttttggaaaaaaaaaaaaaaaaacctttttttaaaaccaaggtttcatttaaaatttttcccaacaaaaaacaaccgggggttaattaaatacccgggttttccctaaaaaggcgggtcggggaatttaaaaagtgtttaataaggggcctggagttaacaaaaggcatgggggggttttatttggggtaaaacccccggaaaaggtcaccaggaaaaacactggtgggggcggtggcccggaccccccaggaggaacccggcctccggggagcaccttctggaccccctaaggggtttcttaaaaatttccaccctggggccaaatcctgggacgcggggggaaccca

SEQ ID NO: 498136 - DNA, 258 bp, Homo sapiens
cgtactctaacattatgtctggggctagattcacacccacgtatgaaaaagtcagttttacaagcctaattgtgtagttttttttttatatcaattaacgtaaaaatggcatcaactatttaattcatgaggatctttcatattaaaatttaaccttaagattcaacggccaggtgcttttataaaggaaacattttttagagacgtctgagctcacttttacatgggggtgcctacggccgttaaggttagagatag

SEQ ID NO: 498137 - DNA, 712 bp, Homo sapiens
tcttcagttgagatccaggctgctctgagcaagatgcaggatgacaatcaggtcatgggtgtctgagggcatctactacttacctacatctgaggaggcctcgatctctgaacttgggttgtgccgagagagttcgttctgtgtttcccaccctctcgcctgacccaagtcttatgcctctactcccttaacagtgtaagaatatcaactggaaggcgaggaatgttggtgatgaagctgactacaggactcggcggatccttgggaatgggctcatgaatagctgccgatggggtgaggaatagaggagacacgtgggagaggacaatgactattgcatctttcatggcaaaggctactgggcgtcatccgaccgtatctatccaccatcaccaaagcagagaacccaatggtgaaaataacatagtgacttgctgagatacgttgtagggggacacgaactgtgatcaggtcggtagcaggtgggtagtttctttgtctccagagcactttggtctagagtaggcttgggtggtaccgagtggtggacagaagctctgcacggcacggtcactgcgggtcaaagaaagctgtcttgggaggctacgcaccagtaaaggcgcagtatgttattgggctcccaagatgcagacccaaatatccacggtgaaatatcgcgcatggttgcagtaaactttggccaatttcggtg

SEQ ID NO: 498138 - DNA, 1351 bp, Homo sapiens
gttgtgtttttttgccgttcgtgttcctgccgggcggtggtctttttattcttgtgactcgttgtccccgcttgtcttggtctccttttttctgttgtgtctctcctgtcggttgttcttttttttttgttcttgtattcctgtgggccttcttcgtgttttgtttttcttttttgtttcgtgttttgtttttcggtttcgctgcgtcttatccctggcgttagtctttttttcgtgttcttgctgctttctgtcctttgttgttgcgtgttgtctttctatggcttcgtgcgtttctctctttctggtgctgttgtgctttctcattgtcgtgggctgtattttttgcgtgttgtcttagtgtttttttgttcattggatttttcggttctttcttttcattcctccttgtctgggtttacccgtttttttccttctacctgtcctggccttgcttccatgtatctgggggggcagcccgtcccttgcctctttgtgtctcttcattttgtttttcgggctcgtctgggttcctcttttgcgggggctgtttgggggtagtctgtttttttatccttggtgtccctcgttttttatgtggtatccctggttttggttgtgggctgtctcttcgtgggtgttttttcatgtcttggttctcctgttcttgttgtttatgccatggttgtcatgcgtttgtccccttgtctccgtttgttaggttgggctgggggtcgattgaagtcttcatgcatatgatcgatgaatgatctcctgattgtgatgtcttttatattctttatgttatggtcatatatccatgtaacctcgtgatctatattcccatcatgggtgcctgtttatctgacccattaatcctgggcaagttagttttatatgttttcgtgtttgggtgctgagccttcggagtcatgtatctcctattccgtctcgaggcatgtattcattgctaatgatctttcatccagtgctaatgctgaactgatctatgatctgtcatatttgatttccatatatatcttgatcctattcggttacatagttaccctatgggataatcagcgcaatcctattctagagtccatatctactatagggtttatcgacctcgatgttggatcaggatcatccacgatggtgcagccgctattaataggttcgtttgttcaatcgtatttaaagtcctacgtgatctgagttcatgatctcggagtaatttcaggtcggtttctatctatcttcatattccttcctgtatcgatataggatcatagtgtaatataatggcactactgtcatcatagtcgtaaactcctccggggtaatggat

SEQ ID NO: 498139 - DNA, 437 bp, Homo sapiens
  misc_feature (10)..(10): n is a, c, g, or t
  misc_feature (35)..(35): n is a, c, g, or t
  misc_feature (74)..(74): n is a, c, g, or t
ccacacccgnccactgtgaaaccccctaccccaangggccatagaagagggaaaagggacacagtcctggcccnttccacaagttccacagtgtccaggagcccaaaccccatttccattgcctaggtcccgcagtatgataacacttgaccctttcaaatgaatttatatcagatttaaaaaaatacctatttgagaagtgaatttccttgaccctgacaggcattaactacttcttccttagtagttatgcaataaatgcagacttggttcaagttaaaacatctagaaaagtttgctgctccttttctggggtcttaaaatagtgtgacagcatgaccaaaagttaagcttattcattgttccattgtgctttgtgtatatctctctgtgatcattgtgttttatattttagttattaaatatttgtttctctc

SEQ ID NO: 498140 - DNA, 227 bp, Homo sapiens
taatccgatttttccaggtacctgtggagctttaccacggtttccggagtgctgatgggttactctggctcaagggccatcggaagttatccatagtaactgctagagagttcattgaactcggcgtcaatggtctcatcctctaggtcaatgagatccatcttcttgcggatggcttgcagagcagtctctgagcacagggctgctaagtcagcatccacatagcc

SEQ ID NO: 498141 - DNA, 195 bp, Homo sapiens
caattagtttctgtgacactgtatgaaatttggaatctttaataaaactttgtttatttattccgtgatgaatacataccacaacaatacaataaaatacaatactgcagcagctagttccggtgtaaggctgcggatattgtgtctctctccccctcggcatttattattattatttgtgtggtgtaacctgat

SEQ ID NO: 498142 - DNA, 92 bp, Homo sapiens
  misc_feature (7)..(7): n is a, c, g, or t
  misc_feature (27)..(27): n is a, c, g, or t
gcatgangcggcggcggcggcggcggncgaagctgaatgaagatggcggacggcgtggaccaataagacatttacgcggatgtcggcgaaga

SEQ ID NO: 498143 - DNA, 261 bp, Homo sapiens
tcgggcctaactgagcgatacatagagatcttcacctcgtctggattagctgtatcctaggtatttattcttttttgtggctactgtgaatgggattgcattatttatttggctctcagcattgatattgttggtgtatagaaatgctaccgaatttcatacattgattttgtatcctgaaaatttgctgaagttgtttattagatcaaggagcttttgggcagaggcaatagggttttctaggtactaggtataaaatca

SEQ ID NO: 498144 - DNA, 124 bp, Homo sapiens
cattctcttaagcacccggtgccctccgaggctggcggaatggtggtgccacggggttgggcaagggctcaacaggacctcaacgggcaaaattgtgcacactaaaatatcaaatcaaggtgct

SEQ ID NO: 498145 - DNA, 459 bp, Homo sapiens
  misc_feature (84)..(84): n is a, c, g, or t
  misc_feature (218)..(218): n is a, c, g, or t
  misc_feature (455)..(455): n is a, c, g, or t
  misc_feature (458)..(458): n is a, c, g, or t
gaaatacccttccaaaaatatccacactgaacaatgtttaaggttacaaaatagttgaaaccgggaatggcctaatttcccctntttcctgaccataatccaaattataatgaccagcctattccattattaaagatcccctaacctaaaaagatattgaatttattataaaaagtggttaccctgtgcccttttcagtacttgtagggtggaggtgntcggtcaaagaccttctttatgatatcaagaaatagacatgtaacaaccatgaggattatggcaaaccaagcagaaccacttgacaggagctgaataaacacaaaatacatattctgggagcccaaaaatggcctgcaaaaaaagaaaatgtgcttaataaaagtggaaactgaaagacttaaatcaggacatcatataaagacactacagttgaaagtaacaagtactccaagaanttnt

SEQ ID NO: 498146 - DNA, 123 bp, Homo sapiens
ttcggcacgagggtgaccagcggcgggtcacgtgacgcggtgcctggcgcgagctcccaagatggcggtgtgcatcgcggtgattgccaaggagaattaccccctctacattcgcagcacccc

SEQ ID NO: 498147 - DNA, 455 bp, Homo sapiens
actagctcacggttggctggcaggctttgagatcagtgtgggagtgatggcccatgtctgtggccgggaagacctttgagatcagtgtggagtgatggtccacatcggtggccgggaagacctttgagatcagtgtgtggagtgatggtccacgtcggtggccggcaagacctttgagattagtgtgggagtaatggtccatgtctgtggccgggaagacctttgagatcagtgtgtgagtctgatggtccacgtcggtggctcggaggacctttgagatcagtgtgggagtgatggtccatgttggtggccgggaagacctttgagatcagtgtgggaagcggtgccagcctgggtaatggctgagttcagggcacctgggaagaggatgggcataggagagagggagtggcggatgccccgtagccaaccgtggactagtgggtaccgagctc

SEQ ID NO: 498148 - DNA, 291 bp, Homo sapiens
tgactgctatgctgtccagaggatcccatcaaccctaaatttattatgcttcaataaactaagacgatatggaagacaaaagaaaacataaatgggacttccacaaaatgaaaaactttggtgcagcaaaggacgttattaagaaagtaggcccagcgcagtggctcatgcctgtaatcccagctactcaggaggttgagtcaggagagtcacttgaacctggaggcagaggttgcaggcagattgtgccactgcactcctgcctgggaaacagagcaagactctgtctcc

SEQ ID NO: 498149 - DNA, 150 bp, Homo sapiens
ctcagctcggtaccccgcggttatgtcttacggattcctttccactgtgcatgatgggaactcagcaaatgagttatagttctatcactgctccgtttcccaaatgaagggcttcgtaagacataaccgcggcgtaagacataaccgcgg

SEQ ID NO: 498150 - DNA, 397 bp, Homo sapiens
ccgaatttacgcaatgccttgtgcatctagcggggacctcagggggttggatgaaagcgacaggccactatcttaaaacgccacgcgaaccttgagccagagatttattgaccagacagactggcggccatggtctacctttaatcgtcacatcaccttcatattaaggtcagaacacctacacggaagttgtatatgaacctactcaaggtattgctgaccggggcctgcggtcgtatcggcaagacgtttttccaggcgacgcaacaccaatacgactttgttctcgccgaccgccaccatccggactttgccatcggcgagcaccgctttgtccgcctggacatggctgagaaggaagagtcgacgcgcccgcgaatttagtagtagtaggcgg

SEQ ID NO: 498151 - DNA, 315 bp, Homo sapiens
gtgagcatgcaatgtgtaccagatgctcagctgtacactttcagatgcatttcctgcatcagctaaatattaccaataagtaggtatcagtatccctaatccatagtcagcaaatgatgtagtagaaaggttcattatggttggaatatctcagtagtcaagatctctatgtgaaatagtagccacatcatatgttccaacagcattaggaatctagtagtgtaattggcaaagcttccatattgaatgacaaagtgattcgtgacagataaaacaagaagtcctatattcagagtgcatggtaattattgtatg

SEQ ID NO: 498152 - DNA, 289 bp, Homo sapiens
  misc_feature (7)..(7): n is a, c, g, or t
  misc_feature (15)..(15): n is a, c, g, or t
  misc_feature (34)..(34): n is a, c, g, or t
  misc_feature (54)..(54): n is a, c, g, or t
  misc_feature (92)..(92): n is a, c, g, or t
  misc_feature (95)..(95): n is a, c, g, or t
  misc_feature (102)..(102): n is a, c, g, or t
  misc_feature (114)..(114): n is a, c, g, or t
  misc_feature (133)..(133): n is a, c, g, or t
  misc_feature (136)..(136): n is a, c, g, or t
  misc_feature (140)..(140): n is a, c, g, or t
  misc_feature (147)..(147): n is a, c, g, or t
  misc_feature (176)..(176): n is a, c, g, or t
  misc_feature (186)..(186): n is a, c, g, or t
  misc_feature (221)..(221): n is a, c, g, or t
  misc_feature (237)..(237): n is a, c, g, or t
  misc_feature (254)..(254): n is a, c, g, or t
tattaanaaatggtntgaagtgaagtggatgtanacagggagaatgagaaagtnaatgcgagggaagggagtgaattgggagtaaagctctnagnttagggnagaatgagactncactccacactgtacaganctnaacncgctaangcactgtgcgcacgagacgtggcacatgncacgacgctntgctgctgctacacggcacacgcacacgggtgganactggggacacggggnccctttttctgccaccngacgtgttactacgtgcttctgggaccgctgacac

SEQ ID NO: 498153 - DNA, 127 bp, Homo sapiens
atacatcgagctcggtacctgtggagacggggtctcaccatcatcatcactgcatacttgatagactcattgatttccttcattgaagtcatctttcaaaccattctcgtagcctgcagctatgact

SEQ ID NO: 498154 - DNA, 379 bp, Homo sapiens
  misc_feature (287)..(287): n is a, c, g, or t
  misc_feature (292)..(292): n is a, c, g, or t
  misc_feature (346)..(346): n is a, c, g, or t
gcactttgggaggccgaggcgggcggatcacaaagtcaggacgagaccatcctggctaacacggtgaaaccctgtctctactaaaaatacaaaaaaaaattagctaggcgtagtggttggcacctatagtcccagctactcggaaggctgaagcaggagaatggtatgaatccaggaggtggagcttgcagtgagccgagaccgtgccactgcactccagcctgggcaacacagcgagactccgtctcgaggaaaaaaaaagaaaagacgcgtgcctgcggtgaggnagctnggcgctgttttcgagttcaggtgaattagcctcaatcccccgtgttcacttggntcccatagccctcttgatggatcacgtaaaact

SEQ ID NO: 498155 - DNA, 120 bp, Homo sapiens
gtactgttcctgtttgccgagtgtgagactggtgttctcaaacccggtatggtggtcacaccttgctccagtcaacggtacaacgcgaagtaaaatctttcggaatgcaccactgaagct

SEQ ID NO: 498156 - DNA, 155 bp, Homo sapiens
cccgtcagtttattcatctacggccggctttttctatgtcatggcggagagatagggattcgaaccttaggtaccggtgaagagtacaacggatttcgaatccgtcccattcggccgactctgtgcatctcatccaacgcgcgcgccatcattac

SEQ ID NO: 498157 - DNA, 785 bp, Homo sapiens
gaccatccgtcttagcaaggagctgagcagcacagaagcccagtctgcacgatgcccagtgagctgctgcagtgagtgagaccagggctgaaattggccttggggtccctggtgtgcgaagccatggacggtgcatgagtgcaggcggtgcttgctgtgatgcatgctgggaggaggaggctagcatgccagggtgaatcggtgctggggcctgtgagactgcttgactgcccagtgcaccagctttcctgagtgtgcgtgctgtgcgccaggaccgaggagtgcagggtggccacctgggacggtgcagtggcgacgtgacgggacaccggggggccaggagcgagccccggggcaggtcctgaagggcccgtgaactcccaggcgacccatgtgtccagaagtaacagtaaactcgaatggacgcgctgcgcaattcgggcttgcggaggcggggatggtcccgtcacgagccaggggcattgtagaccaaggggaaggcttggtgaagctgcaactggacaccaggactaggttggaagccccatagggaacgccaatggcattcgccgcgtgagcaagtcgctctaggtggaaggcccaactccccgttgggagggaaaacgatacggcaagcctgtccatcagggttaatatgagacccatagcgcttctccttggcgccacgaacggggacggacagaggccaccgcgataggtcatcttttccgaggcagccaagtcattgcgcacggggagacccgggttgacaggccgtggggaga

SEQ ID NO: 498158 - DNA, 598 bp, Homo sapiens
  misc_feature (63)..(63): n is a, c, g, or t
ggggcccaccactcaaggttggtggttgtcaataggtggagattcaagaaggcgccgctcctnttgctctacagacccaagatggacttgctgtgaatggtgccacacagcgcccccagattgggccctcgcacccttgggtgctcccggcccccgcgtttaaaaacattgcctttgggtgtcatgtggcccagacttttgaatagagaatatttataacttttgtatgagagggaattcccccccaccaagcccctcccagccccccgtttacaggggatgaaaacccttcccggtctcccagagccgatggtcctctcccccgcccccccccgggtttcacccttgcagggagagtgatgctccaggcaacccggttttgagtccccttttgacccgggcccccttggcttgctttccgggtcttgaaaatctgaatccccccccgtttggtttatgaattttgggtttcatgataaccccccatgggggtggggcttttattgaaccccccctaagttattgaaaaaatgtcttttcagggggaatgccaatatttatgtgccccttagcttcttgaagatttagaggttttata

SEQ ID NO: 498159 - DNA, 134 bp, Homo sapiens
ctggtaattaaggaacacctggccaccttgtcatgctgacaggtaggcggcccacagcagcaagtaatacaggttggcgcagtgagctcagcagcagggctcccaggccactagtgcacccagcaggctcagca

SEQ ID NO: 498160 - DNA, 355 bp, Homo sapiens
  misc_feature (104)..(104): n is a, c, g, or t
  misc_feature (110)..(110): n is a, c, g, or t
acaacgtgcaggtttgttacatatgtatacatgtgccatgttggtgtgctggacccgttaactcgtcatttgcattaggtatatctcctaatgctgtccatacnccactnacacagcccacccggctacttttttaaaaattgtttttgtatagacgcagcctgaccaatgtgatgaaaacccgtctctactaaaaatacaaaaattagccgggcatggtgacatgcgcctgtaatcccagctactcgggaggctgagacaggagaattgcttgaacccgggaggcagaagttgcaatgagccgagatcgcgccattacactctagcctgggcaacaaaagtgaaagtccgtctc

SEQ ID NO: 498161 - DNA, 344 bp, Homo sapiens
  misc_feature (151)..(151): n is a, c, g, or t
cgacctgtctccgcggaactgctccatccgagatagtgctagtgtctccgccgctgacggcgagactagagccgccgctggcgtaataacgaagactagcagcacagtaatccccgcgcgatgccaggacgcgctgtctctacacgtcagncgaaagctacacgaatgacagaggtaatggctgactgcagcggctggcgtgccgaacacgtgcgtccatgtcgccgtctcgccatgggccgtgccacccattcgccatcccgacgtctcagcgtcgggtcgcgacacatcccgcatctcatccctggctgcacatataacccagaataccgcatcgcagacgg

SEQ ID NO: 498162 - DNA, 157 bp, Homo sapiens
gtagataggctgtgtcctgtcgtatccagccgtggccctgatggtgtaatcctgtctctactcagtaactacagataattagccgggcgtggtgtccggcgcctgtagtcccagctacttgggaggctgaggcaggagaatggcgtgaacccgggag

SEQ ID NO: 498163 - DNA, 278 bp, Homo sapiens
  misc_feature (56)..(56): n is a, c, g, or t
cacggtggtttgaggatgttttccaagatgggattcccacccctccctgaggagtncacttcctccatctcctgcctcaaactcctgagtagctgggattaaaggtgcccactggcgggcacgatggctcacccctgtaatctcagcactttgggaggccgaggtgggtggatcatcaggtccgggagttcaagaccagcctggctaaggtggtggaaaccccgtctctgctaaaaatacaaaaattagccgggtgtggtgcacgcctgtaatcccag

SEQ ID NO: 498164 - DNA, 321 bp, Homo sapiens
ttagcggaacccatacccgctgtggattatgagcaggtttatcattaatttcatgaactatgcgatgatgacatacattcggatgtttcgctcgatgatcctaatactttaatcattgaatatgcgctaaacgtcaaatatgtttcagtcccctattccttaagggaatttgttgaggttcataaatctaaccgctcgtttgatgatctcgacgaaaatccggaagatttttcgtcagcggagagcctaactgctatgatgagggacgctcacggaatcgcacctaaatgatcattattggaaatcctcagtcggaaggtg

SEQ ID NO: 498165 - DNA, 263 bp, Homo sapiens
  misc_feature (152)..(152): n is a, c, g, or t
tgtgctgctcatgggaagaatccaacagatgacatcttcagagatctggccattaacttctcaccacacatggtgaggacacatggcgaaacgagggggcctggagcctcattcatcatggcatctagatactcatcagttggatacttccncaatgaagcaagcatatcatgcaactcttccttgtcgatgaaaccatctcgtgtctgatcaatcatgtggaaaggcctctttgaaaccccttgaattgagcccaaagggga

SEQ ID NO: 498166 - DNA, 287 bp, Homo sapiens
ctgactctagcggatcttcgtcgacggtaccaacaaattatcatccaacctatacttaaaaacatatggtggcaggcatggtggctcacgcctgtaagtgctagcactttgggaggcgaggtgggtgaagcacctgaggtcgagagttcgagatcagcctggccaacatggcgaaaccccgtctccactaaaaatgcaaaaaaaaaattaaccgggcgtggtggcaggcatctataatcccagctacttgggaggctgaggcaggagaattgctcaaacccgggagg

SEQ ID NO: 498167 - DNA, 313 bp, Homo sapiens
  misc_feature (80)..(80): n is a, c, g, or t
  misc_feature (200)..(200): n is a, c, g, or t
  misc_feature (216)..(216): n is a, c, g, or t
  misc_feature (266)..(266): n is a, c, g, or t
  misc_feature (277)..(277): n is a, c, g, or t
cgcctcccgggttcaagcgattctcctgcctcagcctcccaagtagctgggattacaggtacctccccaccatgcctggntaattttttgtacttttagtagagacggggtttcaccatgttggccaggctggtcttgaactcctgacctcaagtgatcctcctgcctcagcctcccaaagtgctgggattacaggtgtnagccgccacacctggnctttagtgtttttttgttaagagactgggtctcggctctgtcaaccaggntggagcaagtncagtggtacaatcctagctgactgtaggctcaaatt

SEQ ID NO: 498168 - DNA, 521 bp, Homo sapiens
  misc_feature (432)..(432): n is a, c, g, or t
  misc_feature (467)..(467): n is a, c, g, or t
  misc_feature (490)..(490): n is a, c, g, or t
  misc_feature (521)..(521): n is a, c, g, or t
gctttttacatgcagacaggctggaatatagtggcatgaccatatcacacctgcaacctcaaactcctgggctcaagtgatcctctcacctcagcctcccaaggaggtgggactacaggtgtatgccaccacactcagctattttttttttcatttttgtagagactgagtctcatcatcttgcccaggctggtctcaaactcttgggctcaagcgatcctactgcctcgccctcccaaagtgatgggattacaggcatgagccaccactcatgcccatctactttttaaaaactcagtgtatgattttaatatatcttatctgtatgctgctaaagtactaactggtctataagaattaagaatagccaatgatcaactgcaaaaagagtaacaaaacctatccatgcttttactttattccattctttgnttttttctttttctccctattttaaatggtactgnagtggataaatccttaattaagncgggcggaaagctttattcccctttaggttn

SEQ ID NO: 498169 - DNA, 968 bp, Homo sapiens
gcggcgctgggcggaacctaccatggcggccgatgagaaacgaccaaagttgtccaagagtctgctgcgcatgaagtttattgcacacacggggactggactcagtaacaccaagagaactaattacacagaagaagatgagaaacatcattagtgcaatgagcactggtacttggatttgccggagcttcaaggagaaagagagtcttcataataggaagacgcagtagtttcttactatgtgaggatcttctctatggaagaaatgtcacttcaggaggatcccaatcctgaggtttgatgcaacctgtgatgcttcagatgaatgctaagcagaaagcatgaagaatgttgaagatgaaaccagtagagcttgatgtgtcagatgagagagatgtgtagacagatatgagtaccttggtggggacaaatgggaaataagtttgccaggacagagagtaccatgccgagtcatgcaagaggatgacatatgcgctgacataagcagcaattcagaagcaatagacagagtgtgctctagaagccccaggacttcacgcatggcattgccttgaggcgatggcaccgaggggttgctttggaggcatcgtccatgccagggactttcttggaggctccaatcgccaaatggctgtctcctataggtacagttaatagctggtaagggtttaccttggtcaactgaagagtcactcatttccatgacaaccatggagctggtttatctgggaaacgcaaggatgggtcgctgaactagggcactcggtaggaaacagttcccctctatggggctgaccttagggggtaacttcaacatccccagagacgtggacggatatcccataggggcgcccttgagcagcttcacacagcttgcgtgaccaatctgcgtcgacagggagcgatagcatattccttcacaggattattttattaagcacccagtg

SEQ ID NO: 498170 - DNA, 190 bp, Homo sapiens
actaaatatcactcctgaactttatgaaatcttcctctcaagagcaaaagaacggttgaaaagtttcagtgaaacaagttcagagaattatacaagaggtgtatcttttgcttatcgagaagccagtcttggattaattaaggttggcatatcccgtacaatttcctctctctacaactcttcagaaggg

SEQ ID NO: 498171 - DNA, 1047 bp, Homo sapiens
acttgacgcttgtcctgttacgtatcctcgcgggtcgcggggtacacgagtgtggtttgccgcccgcagtggttaaccgctgcgactgcaagtggtcatccagtggggcccagcgcggcgggttcggtatgtacttcgtccacgcgtgtgtactgcaccttcgtgggccttgttgtcattggtggccgtcgggaggccgcggtgggggtacgggttgctgagacccgtggcgtcgcctcctccttgtgggtgcacaccgccaacacacaggtggctgtgaggcttctgtagcaggcgctcgcggtggggttgcctcgcaaactcattgctggggtgggggctggggcaccccccgcgtgttgaccaccggtggggggtggccaccaccggttacttccgcgatgttctacggggggggtagttgtcttcgtggtccctggaggggccgccgtcgagaggggcttcgcctcctttgtccggccgggcatcccgggtgcttggttcccccgcccccgctggagccccccacacgtgggttaatggttcgttccgcgggcgaggtttcgtggtgatacccccgggcgtggttagctgatagggcagtcgtggggttggttgagcgagggccgcttgtgccttagtggggtcgcctgtggtgcggcccggcctggagggtcctgccggccgcccgctgtcctctgggggaggctcccgttcgaggggctgctcgctcgacgcgcgggggggcccggtggtatttttgggtgggggtggaggagtgggcgcgccctccttcctttccctcgcgccttgggcggggcaacagcaggcactgctctcctctcctagggggattagtcgtgcggtgttgtgtgggtggctcccctttcggttgttccccgtcgggggtcgcctcttttttcccccctggggggccttggggaattggggaagtttggggggggggcccccccctcctgggcccccccccccaccggggggttttgtgtggacgctttttaaaaaaaaaaagggttggttgtttta

SEQ ID NO: 498172 - DNA, 147 bp, Homo sapiens
cttctttcctcccactccaacaagctcctaaactaaggcaaccaccgggacataaaaccccatcgccctccttcccttgcgcgcctgcttatctgcaagctaccatctcctgtttttcctttcaccatctaacatctcgagagtcat

SEQ ID NO: 498173 - DNA, 1200 bp, Homo sapiens
ttggtgcgtgtccttttttcgcggttctctctttgttgcctggggttggtggtgttgacgctttgttgtgggcgtatggtccccccgagggtggtgggggcgcctgtgcccgctgtggtgggggtgggcctgtggtgtattctgtgtgagtcctcgccctgcggggtgttgctcataagggggggcgactcttttatggtttttcggggtatacgggtgcagtatgcctcgtgggttcctcccggtcggtgtggggggatttgtcgcgcccgcggtgtgtgtgccgcgtgcttgggttttgcaatgtgcgcacttgtactaggtagttccgcgtgttatttgggagtacggggggaatgtgtattgtcacttaggtgagtgtgccccgcgcgcgttgggggccccagttggtttgtttaggcgccttttccctagggccagcggggtgcatttgtcgccccgccgtgtgcgcgggggcctcgcaggggatgtgtgtgtccccccaccgggtcgcacggcggagtttttctctccgttatgcccccctggtcttccgcccctcatgttgtaccctcgtgtctgtttgttgtgcgcagagcttttttgtggttcgccccctctggagactgggccgcagttgcctcggggcaccacttcttctgtccgcccgagtgtgcacaccgtataagagcgttaagtgtgccagaactttgtgaagaacacactggatatctcccccaagtatttgtgtcgcacataaagcgtgtgaaagtgccaccaccaagtaaaatggggatattgactcgttttgttcttgttaaaaggagtatggatatgttggtggtgttgttcttgtgattgttgttgtgtcctctaatgttcttgttgatacctctcaataagagaaccctcttgtgtgggtcttgggacctctttaaggaaatattgaaatacgcccggttgagagaaagaaccctaacacatgagaaaggaaaagggggccctcacatctcccagcacaacccggtcccttttgggtgaataatcaccctgtgcctgcttgttggctcacatggcacagagagcacattcacagtgcccccggttttggtgaaatccctgcataagtgactgtcctgagatcctacttagtatgatcctggctagaatgataatttaaagtatttaatttgaagcccc

SEQ ID NO: 498174 - DNA, 341 bp, Homo sapiens
tgggggggggggcccggttaaaattttttccccccccaaggccccaaaggcgggttgggaaattttccaaaaaaggttttcttggggccccgggatttccaccccgggggggaaggtgggttttcccccagggggggaaggggggttttgggttccttccaaaaggggttgctggttaaacctgggggggaccccttcccccggggccccccccaagggttggggccgggaatttttttttttttttttttttttggtttttttttttaaaaaacccccccttttttttgggccctaaaaattttcctttggctgggtggggtaggttttttaaaattcca

SEQ ID NO: 498175 - DNA, 1562 bp, Homo sapiens
  misc_feature (44)..(44): n is a, c, g, or t
gatgtgagtgcatggctgccgtcagatttaggtctactggatanattgatgagcgttcaatgaactccatcagcgaggttcatgtaactttgtcacttcggcgtttcagggcataacgtagggcacgtggattgacaccaatagagccggcatcgcagcattgcagatgcgtaataggcaccgccttatccatccatctcatagtgtggaacaggcacaatcatcttctgcgcacgtccagtgtggacgtcggaactcaaagaatatgcgcggctgcaaaagatgcgtgtcaacggacgacactgatcattaccccttgggaccggcgggaatgttgatgacttgtaggatcacctacacgagggaagcatgtggattcccaggtctcaaagacagtgctacaagacacaatgttgctaatgtggctacgcacgcattacgaagctatggtggaccacatatatgcgtggggcagatgcagcaccaaaaagaggtatgtcgataatcccatgggtgtccatggacatggtgcagtcgtatgcgggaccggttacattcgagtgacccgaaggaactcacccgtcgcgaatttgccagcctgtagacgccctaacagggatgaggacagcattcgaccgataacatattcctccacgtgtgagattcgacacgcaccataggctttgacaggggattccgtacagtacatctaacacaacatgtacactaacgcatatgtgcatacattcggtgcactcgcgtaaccaaccacagttggatatcacgtaggggcctttgcatacgtacctcgccgctacaaattaaacaattagacgtgacagtaaatatccaccaagagtttgacttcgcaccagctcgctgagggatgcaccagaacagagcctcttacggacagattggggacacatgtcaccaacaagaagtctacctaccctagatacagagtacaactggcacaaggcggtgtacagggtatacaaaaccaagggggaatacacagaccgcacatctaacaatcaagcacagcttacagagacgcggacacccgatagccggccgacacgtaactgcgcacacgcggggatacacacgagagggacctacagggcagcgagcccaaccaacgcgcctagagagacacagcacatcggcgaccaccacacgacaccaactcacgcgcggcccgcacagaccgacatacgcacaaaaccgaagacagcgacaaccaacaagagaagacaagagagggacaaccgagacaaagagaccaacacagcagacgacgaccacgaaacccacgagcacaggcgagagacgccccagacagaagcacaagcacgagacacgcgagcgcaaccacacacaaagccagccaagacagccagacgcgtcggagcagcacaccaagcgacgcagcaacgcagcggagacagccacccgaccagccgccggaagaagcaccacaggcgcgcggtcgcggaccgccaccgagcgccgccgccaccgagcgccacgcggccgacgcgcccgacagccgccac

SEQ ID NO: 498176 - DNA, 309 bp, Homo sapiens
tcacccccccggaatcgcacggaggtggtgaccccgctcatggcggcttacaccaggtggttgaggtccccgtaggtgggggcgagcagtttgagggtgcggaaacagatgtcgcagagtgcctcgttgtcgatgcagtaggtctcatccgtattctccaccagctggtgcacagacagcgtggcgttgtagggctccaccaccgtgtctgacactttgggcgagggcaccacgctgaaggtgttcatgatgcggtctgtgaactcctcgcggatcttactgatgagcagcgtgcccattccggacccc

SEQ ID NO: 498177 - DNA, 140 bp, Homo sapiens
tctagaggatctccactgttgttcatacctggtcgctgtatcggggggggcgggggaggtatgaacaacagatgcaagtatgaacaacagtgcaggtatgaacaacagtgcaggtataaacaacagtgcatgtgatacct

SEQ ID NO: 498178 - DNA, 337 bp, Homo sapiens
tctagagaatccccccgtgagacagactttgataaaggtcatgttactgtccagggtgaaaacaaacacatcaaaggtaatgtaactattagtgctgatggtaaatttggtgctgataacactaatggtgttaacaaattagaaggtaatgctaacactaatggtactgctactgttaaaggtcaaaacagtattgttaatggggaagttactttaaatgctaactctaacgtttctgctggaaaaggtaagaagactactgcaggtatagatgctgagggtaaaggtcatgttactgtacaaggtgaaaacaaacacatcaaaggtaatgtaacta

SEQ ID NO: 498179 - DNA, 1031 bp, Homo sapiens
tttgactcagagaggacccccagagggtgtaccatcttcgcctatttattgttcagcccttgagggcttattgcccaatcacaggatggcagcacgagcggcccgttcctactcttagttagattcactcactgttcgtaccacttggcacaagagaacctgtcatacggtcataaggtattcagcactcctggatggtatagagctaaaaggatgaccgctctttctgttatcaggcgtcctaacattgttccattctagcatcagtggctggtgctagatcgcccctcctctgtccggtactacttgatcgtgaacgaatgatccccaacgaaggaagtcccaaatgagccccgcatccagactcgcatgcccactccgctgccgcgcactgcgccatcgacgcaaccgcatcagagcacgcgccgcgccacacactcgcgcaccgccgcacacacacgcgtccacagcacatgccgccacacacggcgctcgctgcacccagcacattcgccaccaagccccgccgcgccccacacatcgcgcacacaggcccggaacaccaacgcacagcgaacacagctccaccccagcagcacgaggtcgctaccaaaaaaaagcaccaggcacggcccggtccaacccatcgcacacggcgccgacaactcaccagaccgagtccaggccattccgtgcagaaacttccagtgccaattctggaacccgccccgagatatccccaggtcgacactcttgcctgccgcgccagaccgtgactaaatggccccgcgcacgactcagcaccacgaacggtcctataagacactgaacgcactcacgggacacacgcgagggctgagcgatcgcacatccccgcgcgaactaacagcacccgctgctccactcgggcagaccctacccagcaccgaccctcagagagtcgaacatcacgaatgcacggaactcacttgacagcgcccagcaccagacggcgcaagcaccgaccctgcgcgacgcacctggcgacgcga

SEQ ID NO: 498180 - DNA, 709 bp, Homo sapiens
  misc_feature (24)..(24): n is a, c, g, or t
  misc_feature (28)..(28): n is a, c, g, or t
  misc_feature (30)..(30): n is a, c, g, or t
  misc_feature (33)..(33): n is a, c, g, or t
  misc_feature (35)..(35): n is a, c, g, or t
  misc_feature (40)..(40): n is a, c, g, or t
  misc_feature (49)..(49): n is a, c, g, or t
  misc_feature (64)..(64): n is a, c, g, or t
  misc_feature (77)..(77): n is a, c, g, or t
  misc_feature (79)..(79): n is a, c, g, or t
  misc_feature (83)..(83): n is a, c, g, or t
  misc_feature (86)..(87): n is a, c, g, or t
  misc_feature (89)..(89): n is a, c, g, or t
  misc_feature (91)..(91): n is a, c, g, or t
  misc_feature (112)..(112): n is a, c, g, or t
  misc_feature (119)..(119): n is a, c, g, or t
  misc_feature (132)..(133): n is a, c, g, or t
  misc_feature (135)..(135): n is a, c, g, or t
  misc_feature (138)..(139): n is a, c, g, or t
  misc_feature (145)..(145): n is a, c, g, or t
  misc_feature (159)..(159): n is a, c, g, or t
  misc_feature (162)..(162): n is a, c, g, or t
  misc_feature (175)..(178): n is a, c, g, or t
  misc_feature (182)..(182): n is a, c, g, or t
  misc_feature (197)..(197): n is a, c, g, or t
  misc_feature (199)..(199): n is a, c, g, or t
  misc_feature (217)..(217): n is a, c, g, or t
  misc_feature (223)..(224): n is a, c, g, or t
  misc_feature (235)..(235): n is a, c, g, or t
  misc_feature (237)..(238): n is a, c, g, or t
  misc_feature (241)..(241): n is a, c, g, or t
  misc_feature (244)..(246): n is a, c, g, or t
  misc_feature (265)..(265): n is a, c, g, or t
  misc_feature (381)..(381): n is a, c, g, or t
  misc_feature (383)..(383): n is a, c, g, or t
  misc_feature (391)..(391): n is a, c, g, or t
  misc_feature (395)..(395): n is a, c, g, or t
  misc_feature (411)..(411): n is a, c, g, or t
  misc_feature (426)..(426): n is a, c, g, or t
  misc_feature (464)..(464): n is a, c, g, or t
  misc_feature (470)..(470): n is a, c, g, or t
  misc_feature (550)..(550): n is a, c, g, or t
  misc_feature (699)..(699): n is a, c, g, or t
tattatatctttttgtttttttangttnanttngnatttntttcatagnaaaatttttgttttnttatttttttttntntttnttnncntnttatatttgcttttttgggtnaggtttntggctatgcaggnntnctnntttttnccccctatcttttngcnttgtttggggttnnnntttncttcttttctgattntnatcctggctcggcctgangcctanngctggcttgangnncanacnnngtccagattttttcacggngagttacaagtgccacggagaccagggtttctgacacaggatgtggaggatgcttctctgcaacctagtgcaaggcttcccctgcctttccgagaattctatggatctcacaggtngnggtggggngagnttctttctagtgtggnccagaggtgggggcnatgagttaacatcttcactgttatgtttttggtgtttncccctnagggcttgaggtctcggcatcgtgtctcagtcagtccttggcgatgtcccctcagacgcactcacagacttgcatacgtnatttagtaacatgcatcaactatcctagaacatctacagggtgcaaaggaaccaccactcagagaatcatggagccagtggagttagaagtggaagggacagaacaagacaatgctaaaacctgtggttcactaggaagggggaatganaacaccaggc

SEQ ID NO: 498181 - DNA, 372 bp, Homo sapiens
gctcgacgttcttctctacaaggcccagaaaccctccgaattcaggtcaaggagagtagtagtatcgtatactactacacccatctctctctctctactactagtctacacacagtctctctctacatctcactctctcctctcttctcccccctaacttttatttgtcgttcaagcaataacatttgcgacgattgtgaccatatgtgacacttgtgtacgtgcgtggttcatgtggtagactatattctctcacctggtctatatcctatctctgttctgataaaaacgtgtagtgttatcttcctgaagctgtctctccttccacccctcctccctcaagcagacttccgcgtccccggtacatgcaag

SEQ ID NO: 498182 - DNA, 110 bp, Homo sapiens
  misc_feature (45)..(45): n is a, c, g, or t
gacttacgaatgaggtctgacgcgacgaggctctcgctcccaggngtagccgcgctcggacatgtacagtcgtgccttcgcgactcagacgcatcctgggcgctggcaag

SEQ ID NO: 498183 - DNA, 338 bp, Homo sapiens
gctcgactaatcccagctactcaggaggctgaggcagaggaatcgcttgaacctgggaggcagaggttgcagtgagccgagatcatgccactgcactccagcctgggcgacagagcaagactccgtctcaaaaaaaaaaaaaaaaagaaaaagaaaaaagaaaaaaaaaataatcagattaagccagaatcggttgttggaaacagtggggtttcatttcagcaggtgtggtgactcacacctataatcccagcactttgggaggccgaggcaggtggatcacgaagtcaggagatcgagaccatcctggctaacacggtgaaacccccctctctact

SEQ ID NO: 498184 - DNA, 228 bp, Homo sapiens
  misc_feature (134)..(134): n is a, c, g, or t
aggactggcagcatcggtcaatttactctctctacaggttttctagtgtcaagagctgtcttttgactacagtaattacaagggttagagggtctgtgggcaattaaagttaactaagattctatcttgtgcancagctatcacaggctcggtaggtttgtctgctctaactataaatcttcccactattttgctacatagacgggtgtgctcttttagcctgttctt

SEQ ID NO: 498185 - DNA, 237 bp, Homo sapiens
ttgaatgttctgctatccttgccttatgcctgtacttgacctgagacttcaattccattgtgtttccttgctacttgatatctcgaaatatggtccgaaactatcgcatgatccgtgcacctttgcttgtgcatatatcatagctctcttatagagagtgtgcacaatctatttcatttgatgtaatcaacgattaatatattgtatagataaaaataaaatacaactttaaatgcg

SEQ ID NO: 498186 - DNA, 517 bp, Homo sapiens
agctactccaaaggctaaggcaggattgtttgtgttaaagttcatagttcactaaaatcttataaaactttgttaacttatttttaatgtaaattccagaattttagtgcttacataatatttagtgttatatatgtatgtgtgtgtgtgtgtgtgtatatatatatatatatatattttttttttaatgaatcagaacctctcatctagtgcttggaaaaaaatggaacagtcaacttttttaaaaaaataagttctaatgtgaaactatttcagtgtattattatagtgatttgcaatagaacctagagaacatatttgtaacactggtttcataggcaatatgattattagtaccaattatcagtctaattagtaccaatgatcagtctaatacataaacattagtaatataacctgtttgtattttggagggctttagaacttttcaagagtttagtaatgtgtttatatgcattaatttaaaaaaatcagtagatatataagaaaaagaggt

SEQ ID NO: 498187 - DNA, 533 bp, Homo sapiens
ggtttctcggtctggaggcgtagttttgaaagtcacatcacccagtgtgcagcgctgaggacgtgtgatctctggctcgtgcctgtgtgggggcactgcaggacggtggccgagtctcatgacctctgtcctactgctggctgtgtgtgtgcgcacatgagcgctcgacctggtgcctgacgttggctgtgcccacggaggtccgctgctcctctcaggtcaaagtgtaacacacgtccgatggacactgtcaatcgtggtaagcacttccactgctgtgccaacggcccaaggctatcgcgttctgaagaaccaaatgtccagtccgttgcgcaggtcgggacgttggtcgaccggttgctggcaagaatgctccacatgcctgtctgggccccgctggctcgggttcgccttcttgtttgagtcggctgacgactagtgttaccgcagcttttggggtggtcgctcgacggcgtcccagtgggtgccgaggagccgacttgggacgagggtgaggctccgcagacagctgc

SEQ ID NO: 498188 - DNA, 172 bp, Homo sapiens
gaacatattacattagccttggtggataggtcgaggaacagctattccaacggctgacaaactcctctatgcagctgtatcgaaagctgggtgtttcatgacagttgaagaccagattacagctgtcagaaaattcatagaaatgggtttcattgatgaaaaaagaatagcc

SEQ ID NO: 498189 - DNA, 229 bp, Homo sapiens
cgtctcgtgaactcgtgcaacgtcactacttagttttttaactgtatgttacaagtttttctgaatgcgtttagtttggttcgatactcttcgtcgttgcctccaaagtgtttgacaaacttctcatatcgtacttcgggtttttcctcctttaaaaaagcatcaatagcatcttgtgataaaaatatgtccgtaagatgttttgtgcggtcgtcggtgttttcagggt

SEQ ID NO: 498190 - DNA, 381 bp, Homo sapiens
gtgttctgaggattccgacggaggtcggttcatccgtatcatgatctgagatcctcatgtttttatataatagttaatctgtctataagctattattctccatgaaactgtagatagtaccatagaccataattttattactcctcacaacacatctgtgaggtagtatggggtgaggtcaatatgaaagcatcagccccattttagagatgaagacacagaagtgcagggagggcaagaagtttcactggggccacaggacaggcacacacaaagttgaatcccggtcttatcatcatctgccgacgatgagacgaaaagaggcggcttgcgtccctcctgctctgacattctctctaaagtgttatgactagcactatc

SEQ ID NO: 498191 - DNA, 152 bp, Homo sapiens
gaccataagctgggaaggtggcacgggcttctagatcccagccactcaagaggctgaaataggagggttacttgagtccaggagttccagtccagcctgggcaacatagtgagaccctgattctttaaaaagaaacacaaataaataaacat

SEQ ID NO: 498192 - DNA, 268 bp, Homo sapiens
aatggctgaatccaaagaaaggtttacctctgtgagatgagcgcacacatcagcatgtcagataggtttcttctatattgtatattgggatattcactttttcaccattggtttcaatgaactcttgaatgtccattcacagaatggacaaaaacagtgtttccaaactgatgaatccaaataaatatttgaccttgtgagatgaatgtccacatcacaaagcagtttcttagaaagcttctttctgttttttatctgaagtcgacgc

SEQ ID NO: 498193 - DNA, 343 bp, Homo sapiens
gaggctattgtgggttttaagtaattttacaatatataggtacttcaggtgccaattaaattatatatatacacacacacaggattttgttatatacatacatataacacagccatataatttccctatttaattaacagcattcataaaagaaaattacttacagtaaaaatggggtactaactctactgaaacaatttcaacagaaaaaggttattaattgccatatatcaatagttgtattaaatccaaaatccctactgccagcaattttatatttgtctctctcagagtttccagatggatgctgggtgagatgaacttgtgttttacagaggcaatt

SEQ ID NO: 498194 - DNA, 725 bp, Homo sapiens
gagcagcagcaggaggaggcagagcacgagtcaatcgtcgggaaccatgactcagtctcaggtccacgttgcagtcctttctctaggccagaacgccgaccaaggaaaaactcacttacctagtgagaattgcgagtgattttgcttttgctctccataggctagtcacctggtgtccataccagattgaagacaggctcgattcgtggaaggttcttgaggaacacacgcagactttacaacgagatacctcgatgatgactgtgggcaacatgggctacatatgccttgacccagtgcgttcagaagtcaggaatactctcatagtccgccaacatggaatgcttgtgttccatctgacctgaataccatgtgacttgtaagacagatgagatcgcttccaatgtacagtccaacagataagctcaggaaccacatggggattgactaatggtagtagcatgaacgatcgtatggagtgagtcaattgtagcgcaacagacccagtgacatgctcaattggaacgttccgaataaccggaacattcctcgcaatcgcattcgtaacgattagatctaccattggaatcgcaattgttcctcaagccacaaagttgcctggattggaaggtaccgttccaaacgcgaggtacctgggagtgggaagattgccttggacttgcacatcttggctcccactgtggactttttgcccccatccggga

SEQ ID NO: 498195 - DNA, 149 bp, Homo sapiens
ttcgagctcggcccccattttttgtattttttagtagagatggggtctcactgtgttgaccgggctgatctcgaactcccgacctcgtgatccacccgcttcggcctcccaaagtgcgcctggcctgatctctgggattttcgaaactt

SEQ ID NO: 498196 - DNA, 592 bp, Homo sapiens
  misc_feature (41)..(41): n is a, c, g, or t
  misc_feature (81)..(81): n is a, c, g, or t
  misc_feature (102)..(102): n is a, c, g, or t
  misc_feature (148)..(148): n is a, c, g, or t
  misc_feature (172)..(172): n is a, c, g, or t
  misc_feature (365)..(365): n is a, c, g, or t
  misc_feature (409)..(409): n is a, c, g, or t
  misc_feature (544)..(544): n is a, c, g, or t
  misc_feature (581)..(584): n is a, c, g, or t
acttttgaataaattcggtaattttagggattggcaatcangtgggatcattaaataattccttaggaaatttaaaatttngcatggcatttaaatatatangagagtatagtttcataatttcctattccattaactttcatcatanttgaaatcagatcactgaaaaacntatgcaaaacatattttaagtgctattttttggtgggtacagattcaccaatgtcactttgtttgcatatcatattttattattattagagcaatggctttatctgaaacatgaaagataaacttttttggctgggtgcagtggctcacgcctgtaatcccagcactttgggaggcgggtggattgcctgacntcaggagtttgagaccagcctgggcaacggggtgaaaccctgtntttactaaaatacaaagaattagccgggcatggtggtgtgtgcctgcagtcccagttacttgggagggtgaggtaggagaattgcttgagcccgggaggctgaggttgcagtgagccaagattgcatcactgcantccagcctgggtgacagagtgagactccaactccagnnnnaaagaaac

SEQ ID NO: 498197 - DNA, 145 bp, Homo sapiens
  misc_feature (10)..(10): n is a, c, g, or t
  misc_feature (72)..(73): n is a, c, g, or t
  misc_feature (88)..(88): n is a, c, g, or t
ctgccctggngaactacggttactgtgacttacggacgtacgggttacggactgacgtgggaccgaccgacnngacgacggaccgtanacgtttaccttactggccttttggaggttgacggtgactgactggacgagtggacga

SEQ ID NO: 498198 - DNA, 355 bp, Homo sapiens
  misc_feature (1)..(1): n is a, c, g, or t
  misc_feature (283)..(283): n is a, c, g, or t
ngaaaaatgcaacagttcagactcggaaggacacaggtagaagtggaaactacctgtcagataaacatgctggatgggattaatgacagattagaatccgtaagagaaaagtttaatgtcctcgagggcacagcaatagaaactatcaaaaacaaaacacagaggccaggcacggtggctcacgcctgtaatcccaggcactttgggaggccaaggcagctggattcgcttgaggccagggagtttcaaaaccagcctgggccaacatggcgttaaccccttnttttattaaaattaaaaaatttaggccgggcttcgtgggtacacccctgttagttccccaggttccttcagg

SEQ ID NO: 498199 - DNA, 150 bp, Homo sapiens
ctgtaacctctcttgtaatagcatcttctggggcatcatcggcatcttggtaccttggttcttccctaggggtcctacccggaaagttatcttacccttgttggtaacctgtacggtttgctgcattctcttttggctgttgcttctggc

SEQ ID NO: 498200 - DNA, 335 bp, Homo sapiens
aaaaatatctggtggcccgggtgggagtgcagtgacggtgatcatggctcacggcagccacaaccttccatctcaggtaatcctcccacctcagggctccccaccctgagtagctgggactacaagcatgtgccagcacaccaccaggcgtaggctaagggttggtattcgtgggagagatgcaggtttccctaagtggcttaggcttctttggaactcttagactcaaataatcggccggcatgggcctccccaagggcgggaattacaggccatctaaatcttttatctcagattggcctggtgacaaagggaggggtacttgttctgacatg

SEQ ID NO: 498201 - DNA, 628 bp, Homo sapiens
  misc_feature (1)..(1): n is a, c, g, or t
ncccaagcactcttgtaaaagtaggtttgcgatatgttcccaccactcgatgtgtccatactcttctgtcgttatctcacagcattcacttcatgagttcagtggtggaccgcatgattgtactgctcgtctacccattggtagctcaggtgacattcctgagtggtagcgctggacgcaattcggtccatctcttgtaattcctggttcgcaagagatttcgaatacctctcctgctctatactggtctctcccgcgatctcgatctaagtgtacatctatatgagtacgtgtgcattctcgttcataccctatgggtcactcagtccacccatcgtaccgtcacggtatggaatcattggtgcctccagtattgcgttcttacccatcgtggcattcatagtcctatgtgtcattcagctcagctcatgtggagtcattcttagttctagccctcataaactctcggatatcacaagctgtaatgcacgtgggttcagctgcccatccatcttttccgcatgtcattgatcctgatgtttcaccatctagagagagagagagagagagagagagagagagagagagagagagagagagagacagagagagagagagagagagagag

SEQ ID NO: 498202 - DNA, 432 bp, Homo sapiens
  misc_feature (42)..(42): n is a, c, g, or t
gagaatttcattttcatgggtgacttcaatgccggctgcagntaggtccccaagaaggcctggaagaacatccgcttgaggactgaccccaggtttgtttggctgatcggggaccaaaaggaccccccggtgaaaaagagcccccactgtgcatatgacaggattgtgcttaaagggcaagaaatcgtcagttttgttgttcccaagtcaaacagtgtttttgacttccagaaagcttacaagctgactgaaaaggaggccctggatgtcagcggcccctttccagttgaatttaaactacagttttcaagggccttcccccacagcaaaaaatttgtccctttaaggaagaaaacaaaaagccaacgctcctagacccaagggtttcattttattaacccttttttgcctttaaataaaatgtttttaaca

SEQ ID NO: 498203 - DNA, 297 bp, Homo sapiens
cacgaggagattccggatcgctgccatccgatggatattgcttcacataccagactcagcctgtgacccaatcaagaaacgccttctgcagatcaaggagcactttctaacacactctcggtacaatcccaggatcctcttccagctgctgttagatagtgcacagtttgagtttatactcagagagatgttcatgcaaatgctttcagaaaagcaagccagatgggagcattataagaaagagggttcggggcggatgactgagcttgctgatgtcttttcaggaggtgaaacccc

SEQ ID NO: 498204 - DNA, 348 bp, Homo sapiens
tgagaacaggtgtcgtctctgtaactcatatggtaaccgtagttacagttttcactgaagttagactccttgtggagccccacgtcctccatacggacactcaagtttgaacggttcgtccaacaataggaaacagtaccgtgcgagcggaagtatttggacttattcgtgtggtccgaccaacagtcttatccatcacttccagacacagacgaaccatccttaccaccataatgcgaactactcctgtcagtactgaggtggtcgtcaaagttatggttccctttctcctcactgtaggttctcgtcgtttagaacttgtaagagtctgaacagaggtctgttcta

SEQ ID NO: 498205 - DNA, 364 bp, Homo sapiens
aggcactatacaacacgttgcaggtgtgtagactcaatcctaactatatgaataatcacatcacatgtacatagtctgaatatcctaattcaaaaacagagattgggctgggcttagtggctcacgcctgtaatcccagcactttgggaggcagagatgatattttcattttttctttttttcagctctaactccaatggatgcatcttttgtaaagacccaaatcatacttctaaagcatgaaaaatcataatcactaaggtgaaaaaaccagtggatgcgatgaatggcacattagcaccattgcagcacgggccacagatcagtgacaccttgcagacagcgccctatattatccaaaata

SEQ ID NO: 498206 - DNA, 365 bp, Homo sapiens
cactgcagcaccatgggtacggcgaccagccacaggcgtttcagctcggccacggtcatgtctttagggttctttacgccattgatcgccaatacccatgcgtctggatcggcgacgatctgctcggacggaggagcgacgttattgcgcacgaacaagcggtccagcggtgtgatcagacccgaaccaaacgcgctgcgcttggtttctatggtgttggcactgtgcacgatcaagctgtcggcatgtttccaggatgcaaaggctggcaaggctttagcctgcgtttttgccttttcctgggccagtgcagctgacaagggtgtcaggcttgccgtccccgcgtaaaagcgcacgcgaattta

SEQ ID NO: 498207 - DNA, 140 bp, Homo sapiens
gattgtgaaagaaagctgggaagagctccgcggccaagttagcaggacactctaacaagtgactgcgcggcccgcgcccgtttttttgactgcgttaagccccctgggtccccgcgcggcgcatcccagcctgggcggga

SEQ ID NO: 498208 - DNA, 5146 bp, Homo sapiens
  misc_feature (5140)..(5140): n is a, c, g, or t
ctccagacctacccagaaagatgcccggatggatcctgcagctccgtggcttttctgggaagcagcggcccctgctctcaagagaccctggctcctgatggtggccccaaggttgccagctggtgctagggactcaggacagtttcccagaaaaggccaagcgggcagcccctccaggggccgggtgaggaagctggggggtgcggaggccacactgggtccctgaaccccctgcttggttacagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggtgaccgagaccagccgaggcctcaattttgagtacaagtgggaggcgggccgcggcgcggaggccttcccggccacgctgagccctggccgcaccgcacgcctgcaggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggctgccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggctgaggccacctcaggcatcttcaccgacacgtccagcgacggcctgcaggccaggaggccggatgtggtgccagccttccgctctctgcagaagcaggtggggacccccgactccctggactccctggacatcccgtcctcagccagtgatggtggctatgaggtcttcagcccgtcggccactggcccctctggagggcagccgcgagcgctggacagtggctatgacaccgagaactatgagtcccctgagtttgtgctcaaggaggcgcaggaagggtgtgagccccaggcctttgcggagctggcctcagagggtgagggccccgggcccgagacacggctctccacctccctcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctgcctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaagaaaaaanaaaaac

SEQ ID NO: 498209 - DNA, 144 bp, Homo sapiens
cagaggatccccatgcggtctcataccttccaaaatcattatctatactattaagattactttcctgtgagacccttaaatgtgtttgtatatttattttatttgagacagagtttcgcttttgtcacatccagccatggagag

SEQ ID NO: 498210 - DNA, 3719 bp, Homo sapiens
ctccagacctacccagaaagatgcccggatggatcctgcagctccgtggcttttctgggaagcagcggcccctgctctcaagagaccctggctcctgatggtggccccaaggttgccagctggtgctagggactcaggacagtttcccagaaaaggccaagcgggcagcccctccaggggccgggtgaggaagctggggggtgcggaggccacactgggtccctgaaccccctgcttggttacagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggtgaccgagaccagccgaggcctcaattttgagtacaagtgggaggcgggccgcggcgcggaggccttcccggccacgctgagccctggccgcaccgcacgcctgcaggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggctgccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggctgaggccacctcaggcatcttcaccgacacgtccagcgacggcctgcaggccaggaggccggatgtggtgccagccttccgctctctgcagaagcaggtggggacccccgactccctggactccctggacatcccgtcctcagccagtgatggtggctatgaggtcttcagcccgtcggccactggcccctctggagggcagccgcgagcgctggacagtggctatgacaccgagaactatgagtcccctgagtttgtgctcaaggaggcgcaggaagggtgtgagccccaggcctttgcggagctggcctcagagggtgagggccccgggcccgagacacggctctccacctccctcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggtgggccgccgccacccggggtctgcccggggctgggggtcgcgctcccgcaggaaggggtgggagcggccgc

SEQ ID NO: 498211 - DNA, 120 bp, Homo sapiens
aggtgacttttaagctaaggcttaaaagtgtcagccttgggccagttgtggtggctcatgcctgtaatcccagctacttgagcggctgaggcgggagaatcgcttgaacccaggaggtgg

SEQ ID NO: 498212 - DNA, 354 bp, Homo sapiens
cggctataaaattttccctttggattattatattgggggaaaccttttttttccttttttattaagaaaaagggaaaccttaatatgggggttaaaaagggaaaaaatgtgatatttgccttatttaacccccttgccgatttaaagtttccagggttcccccttagggggttaaaggactgaaaaaaggttggggctatttccctctggaaaataaaaaaatttgtttcccgggtttgtcctgaaaagccaatgagaaaatggatataaaagccctttgttaattggtaaaggaggaccaatgggaggttttttttggtttgaagcataaatgtggattttatcccggtttga

SEQ ID NO: 498213 - DNA, 1237 bp, Homo sapiens
  misc_feature (68)..(68): n is a, c, g, or t
  misc_feature (1231)..(1231): n is a, c, g, or t
cagggatggaggccaggtgggagttgcgggggaggcagccctggtgtctcagaaccctgtgttcactntgttgtcctgcttgccaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctgcctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaagaaaaaanaaaaac

SEQ ID NO: 498214 - DNA, 521 bp, Homo sapiens
  misc_feature (397)..(397): n is a, c, g, or t
gggtgtctagagtgtacctcacacgcacttgggggaagataaagcagtttttgaagagagatctttgccatctcagaagaatcaagagaagtttccatttctaggaggatcgggttcctctattatgtgctttttgactatggatctctaagactgatattgaactatctgcatctttccctcaaaggggctgtttctatctcaagctcacctgttttcatacttgttatgacagaatattaaaggactcctgttcccattttccctacccgtgatgaatattttctggtgcccctttttttaaagggcaaagggggggggggctatagctctcttcctttgtctcataaaactttgtctctataggttctgtcttcaacaattttgggagctaccnctattcatcactacttctccatttaccagctgtttcccttcatgacccaaagcagtgattgtagagatccttttacaagtctctatcctctagtgtgtatttcatctttcaaaaactcttttgg

SEQ ID NO: 498215 - DNA, 576 bp, Homo sapiens
  misc_feature (478)..(478): n is a, c, g, or t
aacaacattacaccatccgggaggggggtcacggacgatcgggacaagggccacacggcagggcggctcgcggtccggccctacgagcggcggttcaagggagcccttaccggaataggtgcggtgggggacggagttttcaaagaaaacaggagactaccccagcctctcggccagggacatccaagtgctggcactcacataccagtgggaagcagagtgggtgggggtgtctcacctaaaacaagaaccacagaaggttaaggtgagctcatcgattcagcacccagaaacacctctgcacatgtcgggttcccatcggccctacaagcctaaacccccaaaagaaacagaaaagggacactcagttggtgagcctgagaaccgggaatttagttccttcatgtgcgggagaaatccttggcccaacatcgatcatgaccggcaggagcggtggatggacagaggtgaggacgtnccaagtgaggaggcggaggaggaagaaacggggttcgacgacagaaaagatgacagcgatgacgacgggggtggctggataccccccagtaacatcaa

SEQ ID NO: 498216 - DNA, 442 bp, Homo sapiens
cctctgtggtcttcctcccaataactcataacccgagtattttctatgaggaaagacgtcagacaaattccaatactaggcaacctataaaatacttggcctgtactcctcaaaactaacaaggtcatcaaaaataaagtgtgagaaattgccacatttaaaaagacatgacaacttaatgtaaagtggtatctgagatggaatcttggaacagagaaagggcattgaataaaagctaagaatctctaaataaactatgccattttaaaaataatgatgtgtcaatattggcttattaatcataacacatgtatcatactaatgtaaagtgtcaacgatggggaaactgaatggaaggtatctgggaactttctgtactgtctcctcagttgtttctgtaaatctaaaactgttctaaaaaataaagtttgttaaaaagaaa

SEQ ID NO: 498217 - DNA, 128 bp, Homo sapiens
agggagtagtccttgctatattatgcttggcataatgattttctttcccttgcggactatatctatagcgccagttcaattctatcgctatactttatctgggtaaatggtttggctaaggtagtctg

SEQ ID NO: 498218 - DNA, 901 bp, Homo sapiens
gacagagtggggacgtccgggtacgaagcgggagtgtacgtgtgtgccagcgaatatgaaaataattaaaactatgggtgatgttgagaaaggcaagacacgtatagcatgatgaatggtgttgcccagtgacatagcgtaagaaaatgggaggccagcatcacacgacttgggccaaatctccactggtctcttttgctcgtagagatagggtcatggctgccctggatactcttgacaccatgactccggtcaagtggatgaacgaacagggcgtcatcggggagatgacggataccctagaatggagtatgacggagaaatcccaaagaatgtagattgcctggatacactaatatgaatgtttgtcggcatttgatggatagtaacggacagaaaggggcaggacttaaataggattaatagtcataaagaagttactagatggagtaatatgttgggctacgtggcttatttattagcaaataccagaaatatgtttcatgagttcttggaatgtgtaccaatcctataagtagtagtcgtcatagagcaggaatgcagcatcatgacatgtagctgagagaatattaggtcggagcagtccgtgatttacagaagtagagactggataagtgggttgaaatgaatatgtacaggtttctgaatttatattagtcacctccgagtcatgtaaactggtatcaactgtttagcccttccaagagctgattagaggtcggaaaacaatggcaagtggaagcaaagcaggtgtgagtgcaatctttaaaattatgggaatggttggatagatttttcaaacgggaggaagttattgccggggaatggcgagggttaacacccaatctgtgtgggcagtaaaaccaaggacgggaaaaag

SEQ ID NO: 498219 - DNA, 147 bp, Homo sapiens
gaggtcgctctagccgatcgcttacttatgccgtggggggagaccccaattctataccaacacctatactagattaatcggtcaccctgaagtttatatatcttatacctaccaggcttcggaataatactcccatatatgtaacta

SEQ ID NO: 498220 - DNA, 467 bp, Homo sapiens
acaggtgctcaaatcctcagcagctgcattgtgcaataccgcagcattatgtattggtattggcttttgtcattgctggattttaagatgttgaaaatggctttttcatgttatttttttccctcagtggtatcaatttgaagttttttttgtttgttctctctttcttgaaatattcctgtttcaatgagaataatgtttgaagggtttaagatcaaaccgttgccctgtcatgtgtaatgcagtcaaagtgttttttattccagcagagttccacaaatgtttgaaaagttgccagtgcaatcgtcaagtagatattttttttcttccttttttcctgtaaatacttcagcaccatctctacttgatttttaaatggaatgtaactgcgtgcaaatcgttcacaatgcttcttttaccccttcattttaggggcactcaaaataaaaataaaggatttagacaga

SEQ ID NO: 498221 - DNA, 808 bp, Homo sapiens
  misc_feature (54)..(54): n is a, c, g, or t
  misc_feature (425)..(425): n is a, c, g, or t
  misc_feature (462)..(462): n is a, c, g, or t
gcgaagaaaaaaagaagaaaaaaaaaaagcatggtaaatatagaacagcgcttnaatacaagcaggctggtaccgcatccggataacccgggatatcgtcgacggagctgtaacaacgggctgtggcgcacggcgtcggttcgctgccttccagtacaccaggcgctaaggtcgtgggtgcgccgaggaaaccgctactggttaccggcgcgccggtcggatcttcgctttttagcgtcgaattactgaccggaagaatgtcaccctgcgggccagacactgaacttgttcccgcagccaccgcttaaatcgggaggtgcaggcagggcgtaagtctgtttggcgactgtggtacaagccataccaggaccagaaagcgaaccatcctgggcaacaataatcggatcgatacgaactttggtgtngtttgacgtgttaagacggtcagctgccgcgcgaganagtgaaataacgcggtcgttgccgtaagggccgcgatcattaatgcgcaccacgatcattcgcccgttagccaggttagtgattctggcgtagctggggatcggaagcgttggatgggctgccgtcagactgtgtcggatcgaatgcttcgccagaggccgtcaggttactgccgggttcggcatcatagattgccgacagtcccgcctggctaaatcgagacggatcctgcaccgattttggtagctattaaccgtcgcgctggtaatcctgattgccgcgcgttcagtgggttcgaaacgcgggtccgcccgctaatttcaactatagggccgtacataccgca

SEQ ID NO: 498222 - DNA, 129 bp, Homo sapiens
aggccactctgacgatcccaacactgtcgtgacgctatctggtgacttgtctacctacactcccggttgctggagagagcagccaaaatgaacgatgctttatggtggtggctccttgaccttgcttat

SEQ ID NO: 498223 - DNA, 756 bp, Homo sapiens
  misc_feature (373)..(373): n is a, c, g, or t
  misc_feature (410)..(410): n is a, c, g, or t
gcgtcggtcagattatattcgaatgcaaccaggggctgaacgtcattgactgcgctcgtagggcaatccgttattggttaccagttgcgcgcggatcggtgatcttcacctataagtggtcgaatcactgaacgagtacaccgaatgatcatcctgctgggtgggagcagcacatgataggtgtgcttcactcggcgtcgccccgcctgtaacattgcgaggcggatcgttgcgagggcaaggcgcgtacctgtcgtcgtttggaggacgaacatgataggtataactagacgtcgcaatgaaccatccgaactcaagagatagggagtccatcctgggcaacaataatcggatcgatacgaactttggtgtngtttgacgtgttaagacggtcagctgccgcgcgaganagtgaaataacgcggtcgttgccgtaagggccgcgatcattaatgcgcaccacgatcattcgcccgttagccaggttagtgattctggcgtagctggggatcggaagcgttggatgggctgccgtcagactgtgtcggatcgaatgcttcgccagaggccgtcaggttactgccgggttcggcatcatagattgccgacagtcccgcctggctaaatcgagacggatcctgcaccgattttggtagctattaaccgtcgcgctggtaatcctgattgccgcgcgttcagtgggttcgaaacgcgggtccgcccgctaatttcaactatagggccgtacataccgca

SEQ ID NO: 498224 - DNA, 134 bp, Homo sapiens
gaggaacgatgtcgtgaaaaagagatttttcagaaggttgtcagcgttcagatattcacgtaccatcgtgtcatctgggtctgttagtgtaagtgaccctcagtgcagtctgtcccagcagtttatgtcctatg

SEQ ID NO: 498225 - DNA, 774 bp, Homo sapiens
gcctggtgtgattccagttcctgcgcggtttgttctctggagcagcgttcttttatctccgtcacgtcttctctccatacctaagtgtcgtgccgtcatcccgatggaagattcgatggacatggacgatgagccctcctgaggtccccagaactatcttttcggttgtgaactaagaggccgatcagatagattatcgactttaaggtggatagatgatgagaagatgagcaccaggttatctttaagaacggtcagtataggggctggtgctataggatgagattgcactatgttgaatgcagaggcaatgaattacgaaggcagttcgcaattaaagtaatattggtaactttgaaaatggtctgtacagacaacggtttaccctgtggtgggctttgaacataacacacgacctagtggatctataagtgttgacacgtgtaggtatcagggcacagtgcattattagttggacagatacttagtgagctgtggaggaagatgcagagtcagaagatgaagaggaggaggatgtgaaactcttaagtatatctggaaagcggtcttgcccgtggaggtggtagcaaggttccacagaataaaagtcaaacttgcttgctgatgacgatgatgacgatgatgatgaacgaggatgatgatgaagatgattgatgatggatgattttgatgatgaggaagtgaagaaaacgcgcagtgaagaaatctatagagatatccgaggcaagaatgcagaaagtcgaaatgagaatg

SEQ ID NO: 498226 - DNA, 294 bp, Homo sapiens
gtttgccattttttatattcaaacgaaccaaatccatcaacatttgaatgtcactggtaggactgggaaaaaaatgttggtgatgaaggcaagggaaattgagaaattaaggcggtagtgggggtagaataaaagggaaagaaatttccccaagggaatgaactttaaaatttttaccagacccatatttatttattatcaatcccgatctagggatttatccctatgaagtatggatgtatttattttaaaaattcacactcaccttttccaagaatatttgatggcccatta

SEQ ID NO: 498227 - DNA, 318 bp, Homo sapiens
tcagttagatggaaatgaagaaaatggtgttggaagtaaagtgactgcccacgtcccatagctcaggtacgggggtagggaggacgaccaggcttcctgattcctggtccagtgggctcctcaggacaacacaattccttccgttcctaaggtttgatgaatcaagtcaattctgctgagagagactcataccatagcctgtgaagtctgcatcgggggaatggtatgaagctggtgctaaagggatctcttgtgaactgaaggagacctttgttgaatatttctgctgtttactttggccaccagcgaaagtcaacg

SEQ ID NO: 498228 - DNA, 89 bp, Homo sapiens
gttcctctccttaccacccgatcatttccttattgcacacagttacaggtggatgtgtctgtgataatgaaaagcatcagaaaagcttt

SEQ ID NO: 498229 - DNA, 121 bp, Homo sapiens
tcaggcattgaaaccagctggggcaatatagagagaccctcccccacaaaaaaatttttaaaaattagccaggtgtggtggtatgtgcctgcaatcccagctgttcaggaggttggggcag

SEQ ID NO: 498230 - DNA, 127 bp, Homo sapiens
  misc_feature (35)..(35): n is a, c, g, or t
  misc_feature (59)..(59): n is a, c, g, or t
  misc_feature (85)..(85): n is a, c, g, or t
ggctaatgtggcctcaatccgagctagcaagacgngtaaactatgctcgctgtcgtagngacatggtcggaggtctactaagcantggcctgggcactatagagtgcattggtgaactccctggata

SEQ ID NO: 498231 - DNA, 177 bp, Homo sapiens
tattcattaaactgataatatagcgctaatggttcacgagcacagattataaaggaagggctgcctacccacctgctctgacataaccagctgtatgattctgtatctatcatttgctgaagttgagataataatagtgtatgtacttcataaggctactgagaggattaaaatgag

SEQ ID NO: 498232 - DNA, 695 bp, Homo sapiens
cggtggtcagtttctgcgactggtgttggcgactgctgataggaaagaatgtcgttcaggagaatgctacacatatggtggcaccctgtgctccccggaactgtcaaagccactagctgttaatgccaagatgtgtcaagtttacaagattatcagccctgtcttgaacgtacaaacagggagacaaattatgtgggtgtctttctttttttaacccacgtcttgtgaactttccaacctctttttgtggttgggtggcctccgcacggggacggtaatccaattgtgcggtatttcaggggtggacttagtggggcctagcgacagagaaatttttacacggaaaaaaccgtccgaggagctttggccacaaagggtgtgaggtttgtggggtggacttctcccatgtgttatgggggaaatttttccttccgagcccattattccttggggttccagagatttcctttaacggccaaagattggcgggtgggttccaacagatatttaagctaatgggcctttaacagagggggaaatattgaacggcaacaggggggcaactgggtggaaacccctgggggggtaggacacccacccccaaattttgtgtgaaaaaacaccaaatgttttttcccatttttttgtggcgggtttacatttccaatagggaagccccaccgggtaattagggc

SEQ ID NO: 498233 - DNA, 149 bp, Homo sapiens
ccattgagcgtcaggagtgtgggacagcctcgacacgtgataaaaacctgtctgtactaaaaatacaaaacttagctgggtgtggtggcgggcacctagtatcccagctgctcgggaggctgtggcaggagaatcgcttgaacccagga

SEQ ID NO: 498234 - DNA, 147 bp, Homo sapiens
tattgatccctaaccagaatcccagaagtatccctagtccttctggatatggagaggcactaacaggatatatgtatacttaactagtttcacacacacacaacaaaaaatcacctgtatgtccgctcgggttaggggatggctggt

SEQ ID NO: 498235 - DNA, 891 bp, Homo sapiens
ggcgaggacaggtacgtcgcaggcttgtgcgggtcgggctcggacctgcgctgcctcgggatgtaaagtataacaagagggtcggcgatgggcagcgtatgcctgtgaggtctgcgggtgcccctgtcccccagctccccccgcatgccggctccgcagtggtccatctccggttgccgggtgcggattcgggttccggaccgatggctgtgtgttctccgccgtttacttgtggccccgataggccgggcttactgtggcgaccacgagatgcagctttggcgctatggatggagcccggggctacctcctcaaccggatttggggctgctcctggaggagctacgcagcgcttgtggcagcactgcctgaaggtatgagaccagattctaatctttatggttttccatgggaatttggtgagtctgtgcagctgttgtgggacttgtttggcgtgttctcttttgtgttcgtggacgccagttgtaacagtcgccctaggagtcggccttactgtggcaccgagtacgaacaggcttgcttctaattgctttctggacctagttgaacgcacagaaacgtaaactacttgaaacagatttagccttgtttcaccaagagtatgaaggctatgacagtagagtcatctttacacggactgccagctttgagaacggaggcaacagaagcacaaagtttggaggtacgaaaatcgacttggcatcctgtgaaaacgctgaacagggtccaacttcttgaccttgaacgatgaaaatactctgtcctagtaacaaaggacttacacagaccagaaactccaaacattcctgaacgcaggatggaattggatgcgggggatttttcacaacacggataacaggcttctacaag

SEQ ID NO: 498236 - DNA, 693 bp, Homo sapiens
ttgcccacgaaacctcccaccccggcgccaccacagagattacttcaaggttggggaggatttgaggaccagactgtggatgggagcccctctaagaccctggtgaaatgggagagtgagaataaaatggtctgtgaccagaagctcctgaagggagagggcccccagacctcgtggacccagagaactgaccgccacgatggggaacatgatccctgaccctgacggcggatgaccgttgtgtgccacccgggtcttacgtccggagagtgagtggcccccaggtagaacccccggccggaagccccccccctgccccatgcgtcacccgccctgcgttcactgccccctccgtcccaccccctccttctaggatagcgctccccttacccccgtcacttctgggggtcactgggatgcctcttgcagggtcttgctttctttgacctcttctctcctcccctacacccaccaagaggaatggctgccagagccccgatcaccccttccgggttcactccccgcctcccccagtcagccgtcctagcccccaacccgccccgagcagggtctcttctaaaggggacttgagggcctgagccggaaagactggccctttagcttttaccccttgtccccgtagcctataccgtttagaatatttatttgttaattttatttaaatgcctttta

SEQ ID NO: 498237 - DNA, 352 bp, Homo sapiens
gtgttggggagacacagaggcagacacaggagcaggatagggttggatgggtgcaaagaaacctcaggggcggggtaacaatcccagatcttgccactgcatggttcatgtgactctgaatgagtccctgacatttcagagcatttttcccaattgagtaggagctcctgccctgcctgaggctggaagctcttggtcccctgtgacgaccttggatgaagacagacccttgtgaggacagaacctggaagacagctgaaccggggccggtgctgaggccattcacctggctcctgtctccaaggcccaacagactcacaggcagacagctgcacatcacagggatggacag

SEQ ID NO: 498238 - DNA, 104 bp, Homo sapiens
cataagaaccagtagcgaaatcggacattggatcgctacaaatgttatgtttgacgatcatctgacatcagagaaaattccctgagcatttgtgtttatctctt

SEQ ID NO: 498239 - DNA, 143 bp, Homo sapiens
aagctcggtcccatgctagcaggaactgctatatatgtgtgcatatatatatatatgtctgtgtgtgtgtattgatccattcaatgtcaatatttttggaacccagacaattttctcattttctagtgaatggggcccaaatt

SEQ ID NO: 498240 - DNA, 557 bp, Homo sapiens
ctgaagtattgtaagattggtgccatgctactggacagtgtacaggtccaatgatattcatagttacccagggttccaaacttttccctcatgtcatatgatttgcagagaaggaagatgaagcttgtttatttgtaagcttcagtaacctacaaccgaagaaaggacaaggtttatatttaagacattgtgccgcatagtgccattggatagggaagaacttcagaattgtggtatctggccttgctagtgctcccgaaggtgtctcccatatgtaaccagcatctaggggctaaagatgcaaaggaaagcagcatgattgtctgtacaaatgtgcagcgaaaaggaatatgtttcgagtgtcagatcttcgagttgcttaagtgatttcttttttcttgatattttcttaatttctatatgtatagtgtaatagccttttgttaactaattttcttttttccttttagtaattaagcacgatcatgtccctttttaagccttacctgagaggaacaatgccttaaaataaaaaagcattaatgagaaaaaaaaaa

SEQ ID NO: 498241 - DNA, 494 bp, Homo sapiens
attatggccggggagcttagggtttttaggaatttaggaagctgccgcagtaattggagtctaaggactcgtgacaatcttcgggtgcccttcgagataaattgggaagatgccactgtactatgctgttcagtttcactatacgtctcatctctcttaccctcagtaccacacaatactaacccttcccctactctgatgtattacatcacctccgatgagatgaagtgttttcttcactggtatgccaattggtcagagtcacagcgcgaacgtttcctagaggacctggtagctaaggcagtgccagaccaaccaccttttatctttgagtgccagctacatctttgggatcagtggtttctaggctgggctgaacagggacccaatgaatttgtcagacagctggagttcaaagagccagaatttgcggcaaagttttaccaagcaatggctgctccagcttggtaggactgataagcattcaagcgagg

SEQ ID NO: 498242 - DNA, 172 bp, Homo sapiens
  misc_feature (123)..(123): n is a, c, g, or t
aaagtcgatgtaactgcaggttgcacagtaggtacaggtggaatcatggatatgacgccagccaatcttactctagagtctttatcttaactgccatgttgtactccagttccagcctgaatngtgctttcttgcctttgctcttgcttttctcttggccctctcccaacca

SEQ ID NO: 498243 - DNA, 734 bp, Homo sapiens
gctctctctctctctctctctctctctctctctctctctctctctctctctccagagtgtcgcgcgcgcgcccccgacatcgtgtgtgtgccaggtgcccctggggcgtgggaagaagagacgccgggcgaggacgccgaggacgaccgctgctcgcgagacgactgcccgtcgtcgctgcatcccgcgctgctgcggctgaggcacgcgcggcgcggctggtcatcagtcgacgccgtgtcatcaccttcggggaacgttgtcgtgctgctctgttgctagtatcttctccctcttatcttatctaatcactagtagctagatgctagcgaggcgtgcgctcgttgctcgctgatagctaacagagccgccctctgtccgtagagaagatagctggctaagttcgcaagcgtgcgttgagtgatcgatcccaactccctaattccgtccttttgtcgctacactagattcgtttcgtttagacaagagatgaagctgatgcgtttgcttttccgatctggcgaaccaatctatactatcatattctatcccgccaagctcggatagagagaaaagcgtggcgctgcgttagttccatagattagaatcgctaatccaagcgatgagcggagggaatgcttagccaggatagaagaggcgcggagcgaatgcttggtttagttaaagtttgttcgagcgaacgacaatcgaatttgagttagtcggttctttag

SEQ ID NO: 498244 - DNA, 242 bp, Homo sapiens
gctcgactgactccaggtaggcgacggtctgggcgaaaggcctctggtcgctccattacgtcccgagttctagtcaattgcttgtcgatcagccatttaggcgacgaattgaaagtccagagagaactaaatcaatcgtataaacagattgatttaaggcattttttacgctttttatcgatatctatttaatagatgatcactgccatcaaccaccggttaccgtcctgccccggctcctg

SEQ ID NO: 498245 - DNA, 138 bp, Homo sapiens
attcaacaatcctcacacaggcaattgtaatgaaggattgaagaatgttactgcaggtgctaatccaatggaccttaagcgtggtatcgacaaggctgtagctaaggttgttgatcatattaacggcttctgcagaag

SEQ ID NO: 498246 - DNA, 966 bp, Homo sapiens
ggctgtggtgcatgcgtgtacgcattagcctcttgctacgctaacgcctcccgatctctcagtgctggcctcccggcggaccgtctcccgttataaccgaagaacatgctcgttctctgtaagtgctagcagttctgtattggcgagatatttgaagttcatgtggtaaaacttgacaatgcacgtctgtgattatgcagaccatgtgtggggtggactccgggaagtggatgcatggacggagatccagtgacccacgtctcctcgtaccacacatgtgaggtgcgacaaatacttaaaatcaggtcatttcaggtggtgcacccaccacaaggatgaccctccttcctccctgaagatgatgagaacaaagaaaagcgaacagatgatatccctgttgtgggaccaagaattcctgaaatgttgaccaaggaacactttggaactcagttctggctgcaagactacgttagacatcaacagggttgcttgggtgtgacatgcaagactgtttgccaatatgaatcaaggggaaaacctcctgaggagattcgccaagaccttcaagtatcaaagagtgacttttactgaagaggaggaccccaggttacgccaaagaaggaaccagtggtgtgacgagaaggtgaacctgtagtgcctgcactgttaccctgtaggattgtccacatactagtgccctgctccgtcatctgttattcgaccaccgtgacacagcagcagcagtccttgtttaccgaattgtctcctgctgtgtgttgggcccactcccaacctaggcagttcctctcgttggggggcggtctttttggctggaacagacggcgtcctaaggggttggctcccttttggagagtggctttgccccttgcgctagtgtggtacccgcagtgcggccactttctctggggcgcaatggaatttccgagtgccgctatccgcggcgaa

SEQ ID NO: 498247 - DNA, 132 bp, Homo sapiens
tgctgttttggtcactatccagactctattccaccaatccaatgccacaccaccaaatggtggcaccaacatgctccctatatgtaacactagaacgatacccccgagtggtacctgagctcgcaattctgt

SEQ ID NO: 498248 - DNA, 308 bp, Homo sapiens
  misc_feature (64)..(64): n is a, c, g, or t
  misc_feature (219)..(219): n is a, c, g, or t
ttaaaggcttctcctttaatgtgtgtttttttaaggagccgggggaaaaacaagggaaacaaanttttcttctcttggagaatttttgttctcgcggccccaccccccacaccaaaaccccgcgcgggggaaaaattatattttgtagggcggggggggatataaaggaaaagaaaacacacaaattatttgttgtgcggccccccccccccccccttntgaggggaaggaagcctgttgccctttattaaatattataatacccccgcgggggggggggggggggttttttttttttttgggggggg

SEQ ID NO: 498249 - DNA, 83 bp, Homo sapiens
  misc_feature (39)..(39): n is a, c, g, or t
  misc_feature (57)..(57): n is a, c, g, or t
gcgcctttttctggtttccgaacccttgccggttaaccnggataccctggttcccgncctttttttcccttttggggaaaggg

SEQ ID NO: 498250 - DNA, 391 bp, Homo sapiens
  misc_feature (7)..(7): n is a, c, g, or t
  misc_feature (10)..(10): n is a, c, g, or t
  misc_feature (91)..(91): n is a, c, g, or t
  misc_feature (328)..(328): n is a, c, g, or t
  misc_feature (330)..(330): n is a, c, g, or t
  misc_feature (380)..(380): n is a, c, g, or t
  misc_feature (387)..(387): n is a, c, g, or t
aaatcanggnactagatccttaatcacatacaatatgtggaaagaggttagatttgggagactttgcttgaaggtccgtgtcggatccttngtgtgcacggccagagtattgcctccgttgatgttcatggcgcaagagccacagatgccttctctacaagatcttcggaaggttaaagtagaatccacttcattcttgatcttgattaaagcatccaacaccataggtccgcacttattcagatccacctcgtacgtctgcattcgaggtttatctccagtcttgtctgggtcccatcggtaaatggcaaattttttgattctgggnantgcagcagcagctgtctgtgcccctcgacaggcctgaaactgcaggccgnacatctncgag

SEQ ID NO: 498251 - DNA, 145 bp, Homo sapiens
tttgggttttggggggggaaatcccccttggggccacccccccttttttgggggggggggatccccggcccttggggttcccctttttttttttgggggggggttttttttgggtttgcttttaaaaaaggttaaagtttgggga

SEQ ID NO: 498252 - DNA, 191 bp, Homo sapiens
gcctttaccaccaatcccagccggctaaaagaatcaaaaccttctatgctctagctccgtgccacgtgaagtatacaaaaagccttataaacaaacttagattggatcctcaatccctcttcaagtttatatttggtgacaaaatattatacccacacaacttcttagatcaatttcttgctactgaagtg

SEQ ID NO: 498253 - DNA, 527 bp, Homo sapiens
  misc_feature (45)..(45): n is a, c, g, or t
  misc_feature (222)..(222): n is a, c, g, or t
  misc_feature (224)..(224): n is a, c, g, or t
  misc_feature (236)..(236): n is a, c, g, or t
  misc_feature (254)..(254): n is a, c, g, or t
  misc_feature (260)..(260): n is a, c, g, or t
  misc_feature (282)..(282): n is a, c, g, or t
  misc_feature (284)..(284): n is a, c, g, or t
  misc_feature (286)..(286): n is a, c, g, or t
  misc_feature (304)..(304): n is a, c, g, or t
  misc_feature (331)..(331): n is a, c, g, or t
  misc_feature (340)..(340): n is a, c, g, or t
  misc_feature (344)..(344): n is a, c, g, or t
cccgtgtctcatcccccttcatcgctcaggggtgtagacaccctntctccatcgctcaggggtgtagataccctctctccatcgctcaggggtgtagacaccctctctccatcgctcaggggtgtggacaccctctctccatcgctcaggggtgtagacaccctcccttcatcgctcaggggtgtggacaccctctctatcgttcggggtgtagacatcctntntccatcgctcangggtgtagacaccccctntccatngctcaggggtgtagacaccctntntncatcgctcaggggtgcanacaccccatctccatcacttagggggnggaaacctntctntatcactcagcaggtgtagataccctctctccatcgctcaggggtgcagacaccccatctccatcacttagggggtggaaacctttttttatcgctcaacaagtgtaggcacccccctccatcgctcaggggtgtagacaccctctctccatcactcaggggtgcagacaccccatctccatc

SEQ ID NO: 498254 - DNA, 268 bp, Homo sapiens
aatagaagaccatagaagaacacaactccatataatagaacgaaacgggatcaaacaagcccactaggaatcacctcccattccgatcaaatcaccttccacccttaatcacacaatccaacagcacgccctcggattcatatctcttccttctctccttcaatgccattaacactatactccacagcactcctcggcgcaccagacaattataccctcgccacacccttaaacacccctccccacatcaagcccgaatgctatttcc

SEQ ID NO: 498255 - DNA, 898 bp, Homo sapiens
  misc_feature (178)..(178): n is a, c, g, or t
  misc_feature (254)..(254): n is a, c, g, or t
  misc_feature (277)..(277): n is a, c, g, or t
  misc_feature (322)..(322): n is a, c, g, or t
  misc_feature (324)..(324): n is a, c, g, or t
  misc_feature (330)..(330): n is a, c, g, or t
  misc_feature (409)..(409): n is a, c, g, or t
  misc_feature (413)..(414): n is a, c, g, or t
  misc_feature (455)..(455): n is a, c, g, or t
gcggcccgccgagccccgccacctccctcgggctgcagctcccggcgtgccccgcactctccgctgcccacaccgtcgcgcctctctctccaggcacagagcgaagcgagcgcgcgagcacagcgaggcacaggctcgagtacaggaatgatgaagcatcaaagttaatgatatgaangtaaggaatctctacacaagaggagatcaaaagagaaagaagcagtctctctgtaagcgagacaaaagacaaatantgagaggaagcaaagcagatctnggtgggtgacattggtgatactgtagaggacccctacacattttngngaagtngctacctctgaatgatggccgatatgcttgtacgatgccaatagaaacaaaagagtctaagaaagaagacctagtattnatannctgggctcctgaaagtgcacctttaaaaagcaagatgattnatgctagctctaaagatgccattaaaaagaaatttaccaggtattaaacatgagtggcaagtacatggtgtggatgatattaaggaccgtcgacaacttggagagaaatgtgcgaggcaatgtagtagtttcacttgaaggaaaccattataaaatgacagtcaagtgccaccggaccaaaggagcatacaaaatacagcacagacatgaatagaataggataggataaagcagaagcccctatcacaggccaaccaaaaagaatgcagaatataaaataaaagccacagagaggcaaaatgggatcagaactaaaaaaacaagaagtccgaaataagcacactgataatcacagaaaaaaaaagaacacgaaaaacaaaagaaggagcaaaacggcacaaaaaagacaaaacgaacaaacgacaaagaaacacaaaagaagt

SEQ ID NO: 498256 - DNA, 294 bp, Homo sapiens
tgatcctgccattaaggctatgtgcagtctgccctcctgctccagtggccttgattttaggccaggaatcttctgctccatgtggcttaagccttccagctgagtgaagctaggcaaatggagtgggggcatgcatatataattgcccatatcatgctccacacccatcagtcaacactcatttgacatatcgagttcatttgcctatgagccatttctgttaccatcatatgctcatattgagtgatctgtttatacccctagctcttcatttatgaatcttgtctattttta

SEQ ID NO: 498257 - DNA, 350 bp, Homo sapiens
  misc_feature (82)..(82): n is a, c, g, or t
ctgctgtactgcagcagtctcattgcagagctgctgggaatacagcatgaagtgacaggagaaggatgtgtctactccagancatcttgaatacatattctccagaaaaggaagagttccctttgctttaggagttgcagactctgcctcaacttgtgatgaacccaaagcccacaccagcttccaaatctccctaagtgtcagttacacagggagccgctctgcctccaacatggcgatcgttgatgtgacgcatgtctctggcttcattcccctgaagccaacagtgaaaatgcttgaaagatctaaccatgtgagccggacagaagtcagcagcaaccatgtcttga

SEQ ID NO: 498258 - DNA, 188 bp, Homo sapiens
ttttgtattttttggagaatgaaatgttccccatcataggggattcttaagcacgtctccacgtatgcggcgtgctagctggatgtctttgggctataatggtaacacgttgggcttggatagcacacaggtgggtgtcttcaaaaaggccaaccagataggcctcacttgcctccggcaaatgtggg

SEQ ID NO: 498259 - DNA, 680 bp, Homo sapiens
gctggcgtcgcctggcctatatggtactgttcgagcgcattcgcaggatgtacccggggcccatgggtcctagccgtctgatgggagctgctctccttgtggactgatgcctagtactacgttcgtcgtcgaccgctactctggtccctggatatgtctgtgagaatgagccccatatccaactagcattacattatgtccgcggatatttgggtcgcctgtggtcctcaagtcctcagcggatcctcaagtcctagacggaacacgccgggtcgtgaaaggagacaatgacagaattgaatccattggacagtcaggtgctagcagagacgcggtccactgtgggtaccaggagcattaccaggaatcacgagcacccatccataggagacaccagacacatacagcagctcactgggaggacccagcatcagaacagatcagagagacaaccagacaaacaacaacacaagcgattgtgaagactagggactactggagagacggacgtacgcagatgcacccggaacgacactacacattgataacaaaagcacaagactcgagaccaataggaaaagacgaggccaggagagaagaaacgaccacatacaggtccaggacataaagcgacacgaagcaaagaaaaggctactaacgggttggaccacggaatctta

SEQ ID NO: 498260 - DNA, 162 bp, Homo sapiens
tcatcctaagacattgtcatagtccacaacttggtagggacttcagccagcacgctctttgccaggcagctggagatgcgtgtttgacgttcctgaagggcacgaactggacgatgtctcgaagaacaggctctcccttgggtgacctcagaatcccatgaa

SEQ ID NO: 498261 - DNA, 415 bp, Homo sapiens
ccgaggctgcggcgtgcgccaccacaatgagctaattttttcttttttttcctttgtagagacaggattttgccgtgttgctcaggctgatctcaagcgcctaggctcaagcaatcctcctgtcctcagtctcccaaagtgctgggattacaggcattatccaccacactagaacaagaaattagagtagggactctgccagggatcgtagctcatgcctgtaatcctagcactttgggaagccaaagcagaaggataacttcaggccgggagtttgagaccagtctgggctacatagcaaaaccccatctctacgacaaatttaaaaatcagctgggcatgatggtacatgcctattgtcctagctactcaggagactgaagtgggacgaccgcttgggcccaggaggttgagg

SEQ ID NO: 498262 - DNA, 307 bp, Homo sapiens
cctggtttgttgtcacttttcatctcctctttgctttctgagaacacttaaacgtttcttgcaggtccattttattctacttgaatgaccgtttactttctggttgccacatgtttttctttcttttctgctcatccattatactgctgtgcccttactgtgattgattttccaaactaaattaccttgagcagcagtttagcataatatgccttcagtggcattctacaacattgagtttccctctagcacagttctgtctagcaagtgcgtgtgagatgtgtgtgtatatgctgtgtattgtgta

SEQ ID NO: 498263 - DNA, 415 bp, Homo sapiens
  misc_feature (320)..(320): n is a, c, g, or t
aaaagacactccacccagggcctgggctcagggtctctggggagcaatccctgacttgggggctgggtggcccctcacagtctcaaaagagaaagggtgaccccttggtctccaggaaggagaagaagcagcattgtagccagtaggggcttctgagcaggctctctggggctgatccccaaggatggggctctggcatccgatgccccaaagcggtcaaaagcttcttctcccccagtgctgatcttgctgggccttagctttggagggtaggtgagggagaggaaggaaagggtggctgaatggggagggcaggaagngaggggcggggggtgggtgggtggggggcgcggatcggcagcagtgcgttggggccctcgtgtgtaattgtgaataaatgtagttgtcttggaaa

SEQ ID NO: 498264 - DNA, 305 bp, Homo sapiens
gcttggtggtaccctgccccgcctctaaaggcaacggataattggcagccacgtgtggaagatgacttggatgccatctaacactttatacaaaaatcaactcaagagggatcaaagacttaagtctaagaccttataccataaagttgtagaagataacatcagataaacacttctagacgttggtttgggcagagttcatgaccaaggacccaaaatcacctgaaataaataaataaataaataaataaataaataaataaatatataaaacctaattaaaataaaaagcttctgctctgttt

SEQ ID NO: 498265 - DNA, 299 bp, Homo sapiens
  misc_feature (148)..(148): n is a, c, g, or t
  misc_feature (154)..(154): n is a, c, g, or t
  misc_feature (191)..(191): n is a, c, g, or t
  misc_feature (210)..(210): n is a, c, g, or t
  misc_feature (231)..(231): n is a, c, g, or t
  misc_feature (234)..(234): n is a, c, g, or t
  misc_feature (245)..(246): n is a, c, g, or t
  misc_feature (252)..(252): n is a, c, g, or t
  misc_feature (261)..(262): n is a, c, g, or t
  misc_feature (286)..(286): n is a, c, g, or t
  misc_feature (291)..(291): n is a, c, g, or t
ccccttttttttaaggggggccttttcattttcatttttttttggggccccccctttatgtatgtagtccttggggggaaaatgaaccccccttttttatgggaaaactttgggttaaaagggacccttttgaaggtttttaactggngaaacnagcctggaataatgcccccaaagattgagtggaaatngccccttttgaaggggccntttttatgagccaaaagtttntcntttaaaagttnnttttgngggaaaaanntgtaaaataattttaaataaaggnatagnacccttta

SEQ ID NO: 498266 - DNA, 700 bp, Homo sapiens
tcatgatgcatttacaggcgcagcatagcggcccacagcaacgctgcactgtgggtgtccgcactgggcatcaggtctgtccagttatatccagtttcatcatgggaagcagacgagttgaacccacaggtctgagactgtccaaggctggaccgcagacacgaacgtgatcaccgacaagaacaggacgcggcgaactggtgacagacgacgatcccgacacggccgcgagcgctaggccgcggaaaggccaggagagaccgagccacgggccaacaggaactggacgagagagccagagagagaacggggcagcgaatgggcaaggaaggcacaacagacaaagagaccacaacatgcacgagaaggacaaggcacaacgagggcgagagatgagaagaacagacgagaactccgcaggccacgcacagacccagcgacagagacacactcagcaaccacaaaagatatagaactatccacactctatattagcaaaatacagagcacccccatccttcaatcaaagacaattctcgagcgagctaaagacacgctagagcgcatacatggacaagtaagaaatactccgcaatcttaaacacgtacatataaatttctccacgtatcaaaggccttaaagtctaacgaaagatgtcatcagaaactaccaggtacacagagccaaaaaactaagggt

SEQ ID NO: 498267 - DNA, 642 bp, Homo sapiens
  misc_feature (129)..(129): n is a, c, g, or t
gtcatatatagattttcaataaaagcagaaactttcttaccttaaaaaaaaaaaaaaaaaaaaaaaaaaaaaaaaaaaaaaaaaaaaaaaaaagaaaaaaaaaaaaagaaaaaaaaaaaaaagcgtggngggcggactgggcccagacgcctctagcccggcgttttttgggggggggggcctttgccggcggccgttggcctttcgcccttggggcgcggtttccattcccctgtccggggtttgcgccgttggttttggccaaccctgggggtttcccacctggggcgccttggggcgctttcccttttagccagctggcttaagggggagggggccctcgcggggggccctttccagatggtgctgcggaaagagtggccattggaaattggaattttttattttttggccaaattccgggaaaatttttggtaaaacagataactccacacaccttgggccgaacgcgggaaacccctttataaaggaaccctttttacccgggtgggggttccgggttgggcgggatgggaaccggttttcggggtcaaggggcgtgtgcttcccccccccgcgtccccccggggtccgggggccgggaggagtcccccaacccctaaggggggccccgataaggcc

SEQ ID NO: 498268 - DNA, 646 bp, Homo sapiens
actagttctagatcgcgagcggccgcccttatcatatttgctactcagtatcccttgtttcctctccgttaccattaggggccctgggggtatcatgtgcattgtccccagttatggtccccgtggatctagactgttgtagattgtaactagcatgtaaagaaacatgattatgcaaggaaaaaataggctaaaataaaaaaaatagataaacgcaaagtaaatactataagatattacataggatatataatatagtaaagaaattggtttaaggtgctaatctataggcacaatagtgaatatgaatgaagagtaggtgctgcaagttaatcctacattgtgccagtgtatattagtaccatgtaaatgaatatgaataaatgaacatgaggattaacgaactgttgaaaataggctgagatactagttttctttcttattaaagagggggcatgatattaaagatagttttaagtaacaaattacttattacaaagttacaacatgtggaatcaatagttaatttgttcattaagtttattcattcagcaaacatttgttgaacatttaatgtgtaccagatattgcaggatcaggaaataaagaactaaaaatggacatacagactggaattgctaagtaa

SEQ ID NO: 498269 - DNA, 326 bp, Homo sapiens
caaaagcttgaattttattgttactgtgcttacaggatattgacaagtgcagacagcagctttatgatattactgtaccgttagaagtttttgaatatatagatcaaggtcgaaatccccagctcttacaccaaagagtgcctggtagagggctcttagcttaaaaatgagcaagttaaaggcaagatcgacaccatgatggaaatttataagcctgtttgattcaaggaactttctaaagtatttcccggaagacataggctaagttatcgaatgcatccccgtggggaggatcacccgccttcttaacccagctcaccctccct

SEQ ID NO: 498270 - DNA, 913 bp, Homo sapiens
ggaagcaggaaccgactctcaccatccccactcccacctccatgaattccatcggacagttgtgcgaaagcgggctggctttcgcacaaccattggtggactgtctgtcctgtaagccccccaggggctgatgccctcccagtctgcctgccctgttcttagcacagcccctggcaccccgtgtgatctcaggaaacacttgctaaacatggtatcggaggagaaacggagcccacagcttagtgcaaagacctggcggcgtggactgaggctgcagaaacgcagaaacgcgcttttcctgccagaaggggacatctgcgtggtcgggagtacctctggggcacgtgccctaattccagaaacatctaagctggagcgcagtggcactgtaatagcttactgcaaccttgaactcctggcttcaagtgatcctcccgtctgggcctcccaaagcactgggatgacaggtatgagctaccgctctcagccacaactgggttttaagagcactcctccagcccactccagtgtcttccatcattctgtgaaagcaccaaaagaggaccaagcccaggaagccgccagcaggcctctcaccagccaagatggctggaatcctaatatcaagaaatgaaactccagcaggccatggaaatgctaaggggttggcatttctgctctagagagagccaaagagaaagctctatttatatctccttgcgtttggtcgcagcctcatcaaccaaaagaaccttccgccccactcaacacatcaatcaaattggggagggggtgtgaacagcagcagcgggtgttacagaggagtctcaagggtatcttagagggtgcctctctgaacagtcgtcccctccaaatcccccccaagagaattactaggacattctccttcccc

SEQ ID NO: 498271 - DNA, 288 bp, Homo sapiens
  misc_feature (231)..(231): n is a, c, g, or t
tccccggtgctgatgtggtagatggaggtgagtgagcaagatcacgcactgcctccagtctgggtgacagagtgagatctgcctcaaaaaaaaaaaaaaggaaaaaaaaaaacaaaggcaatctagtggcagaaacactctgctatactgactcttctactgtgcatattgtttttcacctgtattgtataatcacatcatgaacaatcttgatattagacatttcttgtntaacatttaattttttaattttatgtaattttttgtttaagagacaaggtcttgtta

SEQ ID NO: 498272 - DNA, 443 bp, Homo sapiens
ggtcgcagccatcatatcccctccccaaatgctcaaactaaatctgcacatacgtctgtattaggatttggtacatgttatttagtgtgcagaggtatatacaatgcatatatactgtacgtgtctagttaggacatgcgtattggttcatacttccaaagttatttcagtacttcagtggtcgcaccgtcatgatctattgcaacacgaatgaaagcgctgtcgactccgcagcgccggccggtccccagccatcacccgcgccgtcccgatggcgccgctcgcgttgctcctttctcggcgccaggatctctccccaggaaccagcgcagattcggaggccacgctgcgctgcgctgcgctgcgctgcgctgtcaggacgcgcagttcccgccccgctgaagggacaccgttttacaacacgccgcgtagaccgtgacagg

SEQ ID NO: 498273 - DNA, 563 bp, Homo sapiens
tctgacgacccttggcagtatgttgatctgacagagctgggtgcccatcgtgcctcaaaacttactttccgtgagccctctaatcctatagaggttggacaactagcacccatgagccaaatctggctcaaggtctgttttcttttcttttctttttgagacagagtctcactctgtcgccaggctggagtgcagtggagcgatgtcggcccactgcaacctccatctcccaggttcaagcaattctcgtgactcagcctcccaaggtgctgggattacaggtgtaagccacagcgcccaggccttttttttttttccttccttccttttttttttggagacggggcctcttgttgtcccccgggtgggttaaagtggattgatctcggacctcatggtaccctcgtgcctcccagattcaggtagatctctgtgcctcagcgggcaccctttgcgtgttgagtagctggacacccgacgctgggcccccatacccagctatttggttttgggttttttacaagaggctttatatatggggggacggcacccagtcacttcat

SEQ ID NO: 498274 - DNA, 263 bp, Homo sapiens
gttgagggaggagaattgcttgaacctgggaggtggagtttgcagtgagctgagatcgcaccattgcattccagcctgggcgacaaaatgagaccccatctcaaaaaaataaagaaaaaaaaaagggattaagaagacccaagacccagggaagccagaggtgtaactttcagtcaaaggccaaaggtttgagagccccaggaggctgctggcgcaagtcccagagtccaaagcctgaaggacctggagtaactaggcattca

SEQ ID NO: 498275 - DNA, 1038 bp, Homo sapiens
cgctgagctgaacggtgaagctcactggcatggtcttccggatgtcccattgccaacgtgtcagtggtggacctgaactgccgtcatagaaataaccctgcacaatatatgatgacatcaatgaaggtggtgaatgctaggcagtcggagggccccctcaagggcatcctgggtctatcacatgagcaatccagtggtggtctcctcatgagccgttcaatcagcgacacactcactcactcgcaccttcgatagctggggctggcagttgccctcaacgacaccatctttgctctaaagctcagttgtcctggtatgacaagcgtaattaaggctattccagccaaccaagggctgtgtggacctcatggtccatgatgggctccaaggaggtaagacccctgtgaccacctagaccccagtgagagcacaagaggaatgagagagaccctcactgctggaggatgtccctgcacattcaaggtcccccagcacactgaatctcctgcttcctcacatgatttccatgtagactccccttgaagaggggtgaggggcctagggagccgcaccttgtcatgtaccatcaataaatgtaccctgtgctccaagcgaacataaagagattttcacactgtcagatctaatctaacctacggggtcgcgatgtcactgcaacctcgggggcgctctgtgtccgacgaattttatggcaaggttggcctgaaggacgtccccggaaaataggtggcaggcgcgccgcaacaaccagccgtcagcaggaggaaacaggcggcagcggagctctcaggtgccggacccctcgggggtggacatgccgggccacggactccagcagatgaaccctcaacggggaagtacatcaggggaacggcacaaacaggataaggggagtaacaggaccacgagatacacgaactgagcggagtataaccgcaaataacaaacaaaaaggcaagatacgggacgcaacacaggaagcgaagaaaagccacacaaagcaacaaccacaacaaa

SEQ ID NO: 498276 - DNA, 643 bp, Homo sapiens
  misc_feature (5)..(5): n is a, c, g, or t
ttcgntgaacgacaatactatatgtttaaggggttttatagtatgaaatattatgggcatgttgcctcagtggcattgtaggagacagctacctgctttacctaggaataatagtttgcatgtcacatttagagatacagctcaaaatgcaaatccttcccgagagcgcgaaagcattaacaaatgagagtgggacaggcattaacaaagcattaacacaggtctttacatattgaaaatattaaactaaggctaggattatagacttgattttaagacatggtagttaatagaaaagttctagattgaaatcaattttgcagaaatatacatttcgatatgtggatatatgtatgcgtatatatatatctactaggaaaatatatcgcttaaggtgccagtgccatttcttagttaccaattttacattctgcattcacagcatttgccatcccatctttacacttaaagccaccatattactcttaagtactttatacacattttcagtcatgatctaaataatcatttatagccacaaactaatactgtgtagtgaatgaagcactttcatcagcaaaaattgcagattttttggacatgatcctgggaatagttcagtttttacaattagtgattgacg

SEQ ID NO: 498277 - DNA, 164 bp, Homo sapiens
tggttgcacaccctgcaggaagttgtagcggaggcgctggtgggcctggcaggcaacgtgggaccctatggctccggagacagtgcacccctcaatgaggcgatggctgtgctccagcatcacgacgccagtcagcgtgcacctctctgccagtcttgctcgag

SEQ ID NO: 498278 - DNA, 430 bp, Homo sapiens
  misc_feature (15)..(15): n is a, c, g, or t
  misc_feature (21)..(21): n is a, c, g, or t
  misc_feature (185)..(185): n is a, c, g, or t
tggggaccatgcacnttgtcncagaaacacagtaagcctacttgacagacaaagagcaacgtaataatgctatagtttaaaaacaccctccctggtcatctagtgttgaggaaaaacattaagtaaaataaaaataaaaatatggggccaggcgcagtggctcatgcctgcaatcccagcacttngggaggccaaggtgagtggatcacctggggtcgggagtttgagaccagactggccagcaggatgaaaccctgtctctactaaatatacaaaaattggccaggcatggtggcaggcaccagtggtctcagttacttgggaggctgaggcaggagaattgctggaacctgggaggcggaggttgcagtgagccgggatcgcgccattgcacttcagcccggggccgacaacagcgagactccatctc

SEQ ID NO: 498279 - DNA, 182 bp, Homo sapiens
  misc_feature (50)..(50): n is a, c, g, or t
  misc_feature (155)..(155): n is a, c, g, or t
gctccaggggctgctgctgttgctgctgctgagcatgggcggggcatggncatccagggagccgcttcggccatggtgccaccccatcattgccatcctggctgtggagaaggagggctgccccgtttgcatcaccgtcaacaccaccatctttnccggctactgccccaccatgatgcgcg

SEQ ID NO: 498280 - DNA, 176 bp, Homo sapiens
ccgtacccgctgccaacatcatcagtggctctagactggtcgatgtcccacttgactttctggcacttgatacctcctaaaggtagcagctctccgtgttcttcagttattgggggatcctagctagaggctgacctttttcctctttgctcctaccatgccattgggccagcggg

SEQ ID NO: 498281 - DNA, 176 bp, Homo sapiens
tgcacacgccgagtgaccacaccatgttcccaatgactgactgctgtttcagtttatttacgacttcctcagggaaagccttccacacttccctgacggatgactttcccctgttgtgtgtgctcatagcaccatttacctacttcgtatacttgtatggagtttcggcgtgtgca

SEQ ID NO: 498282 - DNA, 1144 bp, Homo sapiens
  misc_feature (228)..(228): n is a, c, g, or t
  misc_feature (236)..(236): n is a, c, g, or t
  misc_feature (240)..(240): n is a, c, g, or t
  misc_feature (242)..(242): n is a, c, g, or t
  misc_feature (244)..(245): n is a, c, g, or t
  misc_feature (263)..(263): n is a, c, g, or t
  misc_feature (271)..(271): n is a, c, g, or t
  misc_feature (280)..(281): n is a, c, g, or t
  misc_feature (289)..(289): n is a, c, g, or t
  misc_feature (307)..(307): n is a, c, g, or t
  misc_feature (311)..(311): n is a, c, g, or t
  misc_feature (323)..(323): n is a, c, g, or t
  misc_feature (326)..(326): n is a, c, g, or t
  misc_feature (329)..(329): n is a, c, g, or t
  misc_feature (336)..(336): n is a, c, g, or t
  misc_feature (358)..(359): n is a, c, g, or t
  misc_feature (366)..(366): n is a, c, g, or t
  misc_feature (372)..(372): n is a, c, g, or t
  misc_feature (374)..(374): n is a, c, g, or t
  misc_feature (378)..(378): n is a, c, g, or t
  misc_feature (380)..(380): n is a, c, g, or t
  misc_feature (390)..(390): n is a, c, g, or t
  misc_feature (392)..(392): n is a, c, g, or t
  misc_feature (396)..(397): n is a, c, g, or t
  misc_feature (402)..(403): n is a, c, g, or t
  misc_feature (405)..(406): n is a, c, g, or t
  misc_feature (408)..(408): n is a, c, g, or t
  misc_feature (432)..(432): n is a, c, g, or t
  misc_feature (442)..(442): n is a, c, g, or t
  misc_feature (450)..(450): n is a, c, g, or t
  misc_feature (453)..(453): n is a, c, g, or t
  misc_feature (465)..(465): n is a, c, g, or t
  misc_feature (468)..(468): n is a, c, g, or t
  misc_feature (477)..(477): n is a, c, g, or t
  misc_feature (486)..(486): n is a, c, g, or t
  misc_feature (587)..(587): n is a, c, g, or t
cgcggtccggtctgccttgggctgccgaacatgacaaggcgtggtgccacatgcatctcagaagccgacgcagctcgacgcagggccggcaggatgggtgggcgatcgcgtgtcggagggcgccgcgcgggcaggcgggcgggcgccagagggggaaagaggctgggggcggcggggttcatgccgtcgtggccgtggccgggccgtgggaatgtcgatgcctgacgngatgccgntgcncngnntcggggaggagctgaagnatgccaangagatcganngacgccgnagaagtactccttcatgnccancgtcaccaaggngcncangaagcanatccagtttgctgatgacatgnnaggagtncaccanantccncnaccaaaactngngcgnngatcnntnncncgcgtcgatctcacagtcctccantgacagctanagttcagntgnatcctacacagntangctctgatnatgaggttnctccccgagagaagcagcaaaccaactccaagggcagcagcaatttctgtgtgaagaacatcaagcaggcagaatttggacgccgggagattgagattgcngagcaagacatgtctgctctgatttcactcaggaaacgtgctcagggggagaagcccttggctggtgctaaaatagtgggctgtacacacatcagcccagacagcggtgttgattgagacactctgtgccctgggggctcagtgccgctggtctgcttgtaacatctactcaactcagaatgaagtagctgcagcactggctgagggctggagttgcaagtgttcgcttggaagggcgagtcagaagatgacttctggtggtgtattgacccgctgtgtgaacatggatgggtggcaggccaacatgatcctggatgatgggggagaactttaacccactggggtttataagaaagtatccaaacgtgttttaagaagatccgagggcattgtggaagaagaaccgtgactggtgttcacagggctgtatcagttctcccagaggctggggaagctctgtgttccgggcattgaacgtccatgattcttgtaccaacagaagtttgataacttgttctggctgcgagaatccattttggatggcgctgaaaggaccc

SEQ ID NO: 498283 - DNA, 835 bp, Homo sapiens
  misc_feature (376)..(376): n is a, c, g, or t
  misc_feature (481)..(481): n is a, c, g, or t
  misc_feature (518)..(518): n is a, c, g, or t
  misc_feature (573)..(573): n is a, c, g, or t
  misc_feature (579)..(579): n is a, c, g, or t
  misc_feature (630)..(631): n is a, c, g, or t
  misc_feature (633)..(633): n is a, c, g, or t
  misc_feature (640)..(640): n is a, c, g, or t
  misc_feature (658)..(658): n is a, c, g, or t
  misc_feature (681)..(681): n is a, c, g, or t
  misc_feature (691)..(691): n is a, c, g, or t
  misc_feature (696)..(696): n is a, c, g, or t
  misc_feature (702)..(702): n is a, c, g, or t
gccagtatgaatataccttcaaagcagcaacacaggttccccatgagaaaaagcaaacacagggaaaataaaaacacaaaggttcaatctcttctgacctttgaaagacacagcacagacagtggtccttaggacgaagcgcaggagacccctaattccgtcaccatggcgatagggcataaacattgctgggtgagggcacaatccacattgtgaggtccaactgctgccaggaagacaggagtgcttttacatagaccgaaaggtcattgaaggctcagagttttgtttcaagaactgaatcccaagcccacacgttattaggctgcacttcttaaaacaagttatgagatgggaaaaagggcacccacaaacntacgtatacattatgtatataataatatacagtatcatatatataatatatataacctatgtataatattgttttacatcctgcatcttatgttatatatattgnataaaatataataattgataatatataagttttatanttatacaatatgacatatagtatatattataatttatgacatatataatatatgntatatntcatatatagaatatattatacggttaatatacgtattaaatatatatacnntntatatantatatataatatatctgntatatataatacccatatgcatnatatatatantatgnctatgntatatatagtataaaacaacatataataatatataattgtatatataaaatgcgacatataatatatattatattttataacatatgaaatatatattatatattatatataatacgggtaccgagctcaggt

SEQ ID NO: 498284 - DNA, 559 bp, Homo sapiens
  misc_feature (13)..(13): n is a, c, g, or t
catgtgctgtacncaccggttactgggatagacttgcagtaactccgccctgacccaccttcccgatatagtccctgatggggcgggcctcctgatcgcccttggcttgcttctcgtggcccctgttaagcccacctgaaaaagccatcccagctcagtagcttttcctgggataactgtgatgaagtggaatgtgaccctgctggtgatcagaatcctgactctggagcctgacccctttcgtcgttcctggggaatgtgaccctcaggtgtcgtgggcagcaccagtgtccccctgagttctcctctgaaggtggatttacgttttcggagaaggaggtggctgggctctgtgatcaatgatcccattgcacagactacattggcagctgtacctttgaacacttctgtgatgtgcttgacatgttaattcctactgggcgagccctgaccagagacacctgggtacctagtggggcttccttgcgcactgtaccgttcaaagaatgtgaacctacatcactgagccaagagcggaattcgttgtgcctgacctgga

SEQ ID NO: 498285 - DNA, 1100 bp, Homo sapiens
gctgccaactctcgcactctgttgcttccgccgctccgacgggcgtgtctctctgccggtgcgcgatggaagaagcagatcgccgcggctggtcattgatcgatggctccggcatgtgtgaaagctggtttggctgtgggagcgagcgctccccgagctcgtgtttccttccatcgtcgggcgccccagatgatccaggggcgtcatggtggggcatgggccacgaaggactcctacgtgagcagacaaggcccagagcaagcgtggcatcctgaccctgaagttaccccattgagcatggttatcgttcaagcgaatcgtgggtacgacgtggtcagtaagatctggcaaccacaccgtatctacaacgagctgcgcgtggacccggaggagcagccagtgctgcgtgaccgagggccccctgaagcccaatgccaacgagagagaagatgacttcagattatagtctgagaccttctagacacgccgtgcatgtactgtggcctatgcatggccgttgcgtgtccctcatacgccttgtgggcggcgagcactggcaattgtcgatgtgactctggagaccggggtcaccctaactatggtgcgcctattctacgaaggctactgcccttccgcgccagtcgcatccatgcggtcatggaccgtggctggagcgaggaccatgaagggactacctcgatgaatgatcctccaatgagcgacggctacgaggttcgacgaccacggtcggagcggggaaatcgtgcgcgacatcggaggagcaagctggtgctacagtcgtccttgtgacttcgagacaggagatgggcaacgtgcgcatccgtcctctttctctggagaagagctaacgagcttgtccggatggcagggtcgatcaagcattggcaattgaaccggtcccggttgtccggaaggcgcctgttcccagccttccttcctggggtatggaaatcttgcgcggttccatgagaacaaccttcaattccatgcttggagttgtgccggtgaccttccggaaagaccttgaagccacaccggtgcttgtcggggggcacaccaaggttcccggatggtgaagc

SEQ ID NO: 498286 - DNA, 742 bp, Homo sapiens
  misc_feature (170)..(170): n is a, c, g, or t
gtgcctataatgccatattacttggttagattgaggcaggaaagtctgtcgagcccgtgaggtggcccttgcaaatgagtgctggattgctccactgcgtttcgacctgggtgaaagtgaatagtctgatcgtgaaaaacatataggggcacaaagatctatttatatancaagattactttcggtcacggttatgaggtgttatggtgcttgaattctagcaatattggaaaaggaacgtcgtttgcctgtaatatgcctttttcgagggaagttatctggtttagtgaagtatgtaggatatattaaagccttcgtagcagcttcaagcatagttttgcaggtatttttgtgttcatggcctgtgtagctcaggattgagatatggaagttacaatcagagagtataatcatgtagtttcgataatcaagcagaatagttggtcgaagtcgttgtgcttgggtgcttatgagatgatggaatgaagcataatgagatgattatcgtgaagctgtggcgggtgtgcttttcggaaaaactgaatttaagttgatgaattgctctcgtgaatctttgatattaaggttagagctggtgccaatgttttgtgactggcaaaagtgtgaacccatattggtgttgaataaaccttcaggttggagagacgtcagatttgtttgtagaatgcttagacgatcaaatcagaatggaatttctgtattctaagaattaattaagata

SEQ ID NO: 498287 - DNA, 261 bp, Homo sapiens
  misc_feature (34)..(34): n is a, c, g, or t
  misc_feature (92)..(92): n is a, c, g, or t
  misc_feature (126)..(126): n is a, c, g, or t
  misc_feature (137)..(137): n is a, c, g, or t
  misc_feature (141)..(141): n is a, c, g, or t
  misc_feature (178)..(178): n is a, c, g, or t
  misc_feature (188)..(188): n is a, c, g, or t
  misc_feature (197)..(198): n is a, c, g, or t
  misc_feature (204)..(206): n is a, c, g, or t
  misc_feature (208)..(208): n is a, c, g, or t
  misc_feature (212)..(212): n is a, c, g, or t
  misc_feature (227)..(227): n is a, c, g, or t
  misc_feature (236)..(237): n is a, c, g, or t
gggggtgaacacacaccctaacccaggttttctnacccgctttttaagatggccaattcttcttctcccccccacccaaagacatgtgagcnactgctaatgaaaagcagtaaacagccgcttagntattgcagttntcanctccactctgaggtgaagattccaattacattcgaanacttaagctnctttcaatnncccccnnncncacntccctgactccagtntttaccatnntccggcactagccgatcggtgtct

SEQ ID NO: 498288 - DNA, 151 bp, Homo sapiens
atctcatcagcacatcctcttggtgagagctaatgcagtccattaatgtcacctcaggataacctcgcttacaatgggcagtgagagtcccagaagggtcgcagcgtagaacagtaccacatctgtacacgcacgggtctttagctgccac

SEQ ID NO: 498289 - DNA, 1030 bp, Homo sapiens
agcggagctctgtcgccgctggagcagctgcggctcggtgacccatagacacatgccggggtcgggagcctgcccggggcagggctcgggagagcgggcccacaccatggaggctcccagtggcatccagagtgccccagctgcgtgcctctggtcgccgtgtggttgctacgagtaggtaatgtgagctctaaggctagggatcgttgggcggaggcgcggtggccgatggccactgcgacggtggagttggttggagcggagagctaggtgctcgggtggcagaaggtaggcacgagccgggcaggcgggcatgacgaggtgagtggccccaggaaaagctggcacgcggcaccacatgtgaagggcgtcgaatcggagaacatgcggacacgcagggaccagacggcacgagaccttttggcaggggacagcgcacgccagcaggaagccacatgaagcccgcgaacgcggcaaccaaccagagcagcggggccagccccagcagcatgacactggttggttcaccttgtgccgggataggctccaacgactgggtggttgggacaccttgccatttaagcggcagtggcgcccaatcgggtcatagtaggtggtactacactgaaacagccacgcaggtgtagatggtctaccgcgcataaactttttcccccgtagtcaggtgccagaatttacagcgacgttcgagacgacagcccccatgtacatgcatgccgagtgggcacacacgtggatttgcggcagctggggacacctttcgggtagagagcgtacactatataccacacacatagtggttgaagttcgtgcccttttcgggaaacaaggccctattttttgaagtgtgacacatcatacttgtgttggacagtggtatggcgctcagcttaattcccccaagttggttgtggacagagagcatcgatgggtgcatggctacgaattgggtaactgcaattcatgaaagcaattgatggcgataacgatcgccagtactcaccactgg

SEQ ID NO: 498290 - DNA, 229 bp, Homo sapiens
  misc_feature (71)..(71): n is a, c, g, or t
ttttttccccccccccccattccccccaaatgcccattattaattaaccttctttttttggttggaacccngggcagttttgcttcccttcctaggatttgcgccctgcattgtagcttggttaacggagcacttttcctttttccaaaggtttacattttagggggtggggtgagtttttttgtaaaaagatgaacgcaatgccaataaaattgaacaagaacaatga

SEQ ID NO: 498291 - DNA, 140 bp, Homo sapiens
tttttttccatcacaaatagcactttttatttgccactatttgaagcctgaactttaaccagatgcttggactggtggttcatatccatcagctcgttcaacccagcacctgcccgtcccagtggcaaaaccagaactac

SEQ ID NO: 498292 - DNA, 1663 bp, Homo sapiens
  misc_feature (1320)..(1320): n is a, c, g, or t
taaactttaaacaaatttttattacacaaaggtgtgctcccattaatgtggattacttcctcatacttggtacacaatatatttctcactcctccacagaaaaggcgtgctataacttcttcattcgtgggtgggtggcaagcacataaaactccgtgattttaaaccagaaatagctagtaaaaagtgccctcaggtgatttcaagttgtgaaagccagttacccgtggatcacatgtggacctctggtgtacccgagatattcagagaagtgttcccaaatgtgttttttatattctcacaaaattcacaaaattaacatatactctgtgcgtgagcgccatgtggcacaaaatgtgacacacagtcagagtatagacacacatatatattatatcatttctgtgcggtccacactgtgcacacacgacagcgtaaactgtggagtggctataatgaggtgcgattctcaacgccgagccccttatttctcttctcaatttatgtctctcgcaaaagtagtgggacatctctctctgtgacacggatactcatagtggggtgacagagacacaccagacgtaggcctatgtgggcggcttattccctgtgtgtccgagcgaagggtactccactaatcacactcacacgagggtgtcacagaacgccacgttgagattcttaggcgggagatttagaaacacgtagaggcccaaacactttcgccacaatagacacgaaccgtgtaccccaaatattgccaagcagccacaatttgtgggcaaccccacaatttctcccaaggaggggtgtcccaaatctcgctccatgtgcatcgtataaggcggaacaaatttcatccgtgggtgcaagagtacacacaacaccgatatccagtgggcagtggctaaggtttatcaaccaagcaacgaaggggcccacaaactctcatggaccagggacatctcccgcaatcgtttcaagaagcgacgaaggttttcccatcccaacacaagcccccttcttgtgtgttcgggggctcaccagagaggaaacttcccacgtatattatgcccagcgcccaattatattttcccgaacaaagtatttcgtcccgaggaccgagtataggcgacttcactataatccccaaagttctttcttgtaggcggaccctcttgtgggacaatcaatgattgtctcgtacacaggtgttctcaaaacgaagtccgctgtcaaacgcacccgtggagccccgaaagtatccacaaacaattgcggagagaacgtcgaaccggcacttatcagaggataattccnccctgtgcgagggggcccaccaagagcatagaagcgagacaccccggagatatccttggttaccacagtgtgggccccatataggtgaaagccagaactatatagacaggccagggggcggggcgttaaaacagccgggcgcagtgggacaacccgcgcagcgagggacacatgtggcgacgacccaccactgcggggggcgcaaagtggcacacacacccgaggataagcagcggagcaatacgatacaggtgactcaggtgaacccgcacacggcggcacggtatggtaaccaacaacgacggactgaccatacctagacacgccaagcagccatacgaag

SEQ ID NO: 498293 - DNA, 195 bp, Homo sapiens
gaagaatcatataatactagccatttgttagctttgttctaataattttcaaattttttatttcactgccatgattttattcttcgttaaaccttgactatatttattgcataatacctcagattctattgtttcctccctgtgtaacctttcatcatgtgaacctgtgtgatttttctgcgtcacactatccga

SEQ ID NO: 498294 - DNA, 127 bp, Homo sapiens
tctgtgtctgagaaatttgtttcctgtatcatagctggagaatggggaaagaaatctgcagcaaaggggtctcactctgttgccaggctggtctcaaacttctggactcaagtgattgttccccgct

SEQ ID NO: 498295 - DNA, 320 bp, Homo sapiens
tggtgttctagaggatccctccataatgtgtgccaaatgaaaataaatcaggctgggtgtggtggtcacgcttgtattgcaacacttggggggccaaggagggccaatcacccgaagccaggagctcgagaccagcctggccaacacagcaaccccatctccaccaaaaaatacaaagattagccgggcgtggtggcaggtgcctgtaatctcagctacttgggaggcttaggcaggagaatcgcttgaacctgggaggtggagattgtactgggctgagatcgtgccactgtcctctagcctgggcacacattatggag

SEQ ID NO: 498296 - DNA, 200 bp, Homo sapiens
  misc_feature (20)..(20): n is a, c, g, or t
  misc_feature (28)..(28): n is a, c, g, or t
  misc_feature (30)..(30): n is a, c, g, or t
  misc_feature (71)..(71): n is a, c, g, or t
  misc_feature (165)..(165): n is a, c, g, or t
  misc_feature (175)..(175): n is a, c, g, or t
ggacaacagcaagcaccccntcctcctngnaatgcatggcctttccagaaacctttgccaaaggcactgtngaatctatcatgagggataaaatgcccaaaaagggaggaagatggtggttttcatggaggggaagaaacaccacaatcaaggaggaaagtaagncagagcagtncttggctggcaaggcccatagcacc

SEQ ID NO: 498297 - DNA, 155 bp, Homo sapiens
taccccgcaagacgggcagcccccgggcaaatttatacagagagtgcatcattctccaagccaaagtcaggtggaggcatgatggtggtgctagagaaacgctgggctggcttccagcatagaaagccaggctggagtgccggaatggcatcagc

SEQ ID NO: 498298 - DNA, 230 bp, Homo sapiens
gacggcaggcggaagccatactgcaccagggtttccttgcgcgagcggtcgccccggcacatggcgctgagctggccgatggtgacgtggctctcgtcgatgaacatcagcgcgtcgcccggcaggtagtcgatcagcgtgggcggcggctcgccgggcgctgcgcccgacagatggcgcgagtagttctcgatgcccttgcagaagcccagttcctgcagcatttccag

SEQ ID NO: 498299 - DNA, 515 bp, Homo sapiens
cccccccaaaaatttttatggaaactttttcttttaaacccctttttaaaaaaaaattccggttttttttttaaaggggggaaaacccccccccaataatgtcccattttcgggccaaaaaaaaaagggggccttttcaaaaaaaaaaaaaaaaaactcctccaaattctgtgtcttgggtataaaagccataaaacctttctttctgtaaaaaattttcccccccccacatgctgaatcctcttttttttttggcgctcttttaataacaaaaatcccccttaaattttcccacagaaaatacccctttatatctctctcgccgggggtttgctaaaaatatcctcccctctttctttgttatacccccccccctctcacataaacaaaacatacttctcttttatttatttagcgcaccacaaacactcgcgctaaacaacactaactttttttttttggaaaaaatctttttttaacaatcacaccaaataccgggcgttacataaagatcc

SEQ ID NO: 498300 - DNA, 245 bp, Homo sapiens
ttattcggttcttgctttgggggctgggtgagcctggactgtggtcccaaggatgtgggcagaggtttccctaccctttttcacccctccccacccctgtcagtttgctccccatcccccagcctggggccagaacagcctaccccaggacaggggtccctttagttgtttccctacccccctataccccctggcagagacagccatacccccccccccatatttaataaatgttttcccccaga

SEQ ID NO: 498301 - DNA, 413 bp, Homo sapiens
tcttcggactcattcgttggactggtgtacatgcagtccgtggacccgaagggttcggtgtagaggaaacagcagttggtaagaagatcggtgaggaggagatcgcagaagccagaggagaaaggtgagctgcgatggtcactcattgctgcatggcccgtgacccaggaggctggcgcaggtcaacatcaccctccaggagcagattgaggccattcacgagggcgaaggcctggtgccagaggatgacactaaagagaagagtcggccccaggaagcccaatgaaatcgctcaagagccaccgccaccatcttcagtcaccaacatcgccagctcggctccacccatcacttcagtgccccgaccagcgaggagagtgccacctccaggttcgcccccgagggaggggtac

SEQ ID NO: 498302 - DNA, 111 bp, Homo sapiens
aaatgacccagtctgtgcattcagggatataccaggtgttttctctctgctaagtaagggggtaccacacagggtcacagctgctcagctaactggcaggcttgctgagtg

SEQ ID NO: 498303 - DNA, 239 bp, Homo sapiens
  misc_feature (112)..(112): n is a, c, g, or t
aaaaaaaaaaagaggggggtggtccccccccccttttaaaaaaaaaaaagggggggtttttttgggccccccaaaaaaaaaaggggttttttttcaaaaaaaaccccccctntcaccgcggggggggcccacacccttggggaaactcttttgttttccagggaacccctttaaaaaataccccccgcccctttaaatttcccgatccaaatgggggaaagtccccaaaattgaaaaaa

SEQ ID NO: 498304 - DNA, 985 bp, Homo sapiens
aggcaggacacgccgtgaactcagtgcggatcctggaacgggcgagggaggcttgcaaggcatggcatgagcactgtggagctgtcaagattgccccagcccctgggacttacaaagatgcccgacccaggacctgcctcgctggatggtgaaggcgcaacttcccctctgttggagctggccatgggcgtgtgggaagggctggtattgaggcccaggacaatgcagaacagacaggacgttcacagagcaggtgccatgtccctcggggccttgggggctgctgaggcctgagaaaggtcactggaggcctggacggaagtgcagggttatctcagtacttgatttaaggctcctgcagggtgaaaagctgcccaacggcggaccgggtggaggaagtcagctgtgctgcttaaccgtggagtctccgtcccggatcctgctcaatcagctcttgaagggccttgtactccctgctgatttctcggaaacatttttgaaacacgcctatggagacgggccaccgttgagttcagaaggtccgtgcgcctcaacggccagatcacggacccgtacacccacaaaggggcaggagccatccccctaaggaggaaggagactggcagaatctgaacaggctcctggctcatctctctccggagcggtccatctcctctgtttgcagggtcggagccgtgatgatgagccttctgaagggctcaggttaaaaggtgccgccacgctgtggcgctctaccatccagaaaacatggtgccagtgtcaacaactaggaactgtcaaatgctggaagggacacgggacgatgcggcagatcggttagaaatcagtatcgccgcctacaaacgcaagcagaggcaagagactaacaaagcatagggaggagacacacgcactagtgtaggcacaaaacagcgaagctgaaacgcagcgacaaaacacggcagcgcgccaagcaccccaccgg

SEQ ID NO: 498305 - DNA, 509 bp, Homo sapiens
tgaggagtattacgatagtgtataatttccacatttaagaagtgggagcaaatgccctacccataacttatatttatattagtaatgcatataattaaattattagaatttagattattagaatcgatgattataatttagataatcaaattttggacacagtttgcttcttgttttatctttgcatttataggcattattagtattttgatgatttgttacatggtacgtcgatttagaacttgatattgtctccatagtcaggtcttcctgatgtccctaattgttgtcaatagcaatatcttatggcacccaggttaaaaattctgacgacctttctatgaataaacataattacccccaaaccctacatctaagcagttactaaggaccctggaattcctttatagtcagtcccgtccttttcattctcatggctgtgctgaaggttgggcgcctgccctctcatttggactatcatataacttcctaactggctttcccacttg

SEQ ID NO: 498306 - DNA, 145 bp, Homo sapiens
ttgcacgcttgaatgcctgtaagtctgaatctagaggtaaccactatcgctaagaaaaccctcaacagcgcatcaccccgtctaacactcccctagaagtcccactccttaaacacatccgttattactcgcatcaggtattatc

SEQ ID NO: 498307 - DNA, 200 bp, Homo sapiens
gttttattagcgagggtgcagccaaaaataaattaattaaagtaaaagttatttctgataaagtccaaattatccatgtttctgttctggatggtgggtgttttcttttctagctacttattcccgaggcatgtggaatttcctggaccagggatcaaacccgtgccagagcagtgacccaagcctttgcagtgacaatg

SEQ ID NO: 498308 - DNA, 299 bp, Homo sapiens
agagattattaaacagagtactaaccagatgcttttccctggcagtggaatgagaatgaatagcaggcgggagagactgccatgaggtacaccagtcagccagcggaattagctagccatgtggataggtgaggaaaaagattcatagttaggtcggggcagcaagaattagagggaaggtcggatttatgatagtgtccaaggttgaattctaaggtgaaatttggtggcagatttcatgtgtaaattgggaaggtagattgagtttttttaacatgggttttctaacatgtcaatag

SEQ ID NO: 498309 - DNA, 1002 bp, Homo sapiens
ggagagagagaactagtctcggagttattattatttttttttaggcaggtaaccatttttttaaataaaaacaggaaggagggtgcctacccaccccgtgcctgctactggctctgaagggcactcctcaatttccccaaaaaagaggacgcgtctctgaccctggtgatctatgacgggggttcaaacagaaagtgcctggggccctccttctaagtcttgtcaccaaaaaagggaaaaacgaaaagatcttctcagttacaaatcctggggaagggagactatacctggctcttgccctacgtgaaaggtcttccctacccgcaccaaaaaatacggaaggggctgtcctattccactggtgcccagtgtacgtggggaaggacgagtaactttggagatcctggagggccctaatacaccacaggtagccttcagatgatcatccaaaacctagcgcatgcgggaagtgccctgagaaacaaagtgatcccacccacgtatgcccctagagagtataggcccaaacaacgaccggacctatgtctactagacaacacttaacgcagacacagtgactttacgaaattctaggacagactagggaatacatagacaccttacaaccctcctacaggacacagtgtataaaccaccataaacacataatacaagtcacaaaaagaaaactcaccgaaaggtcaatcccccgcaacggagaaacgggcgccacagaaagtcaaacagggcaataggcgggacccccaacaaccacagaacaacgacaaccacccgcaacgcataaaggagcaacatatacaagaaccaccaacaagaccaaacgggtgttcacaacagatagagcaaagagagagcgaaaaacaacacacacacaacaaccacggtacaaaagaacgacaccacacaccacaaagaacccatatgcgacccgaaaggcacccaccacaaccccaaggatggatgaagaaacacacagcgaat

SEQ ID NO: 498310 - DNA, 754 bp, Homo sapiens
  misc_feature (132)..(132): n is a, c, g, or t
  misc_feature (426)..(426): n is a, c, g, or t
tggaaaggaatcccggcttctgtgtttctcccagcctgtggaatgtgcggggggtggtgactcctcggctctcgcttgcaggcctctccgcctctcctgtgggttcccaggcgatttcttgctgtgccccangcctctcccacaagtgtgggctgtggagcatttgtgcaggggcatgtgtgtgccggccatataccgtggccatacattttcttgtttttcttttattttgtggggcgttttcttaacggtggacaaccgggggttctcccgccatgtgtttgtgccccaggctgtggctctctcaaactctccggaccctttggtgttgactcttgcctgtgccctacagccctcccgatattcacgggctgttgacccacccgccccacaagccctatattttgtggtctctcctaaatgggnggggggagctcatttttctcttatatagatgagagttttatccagtaggattagagcctctacttgtggactagcgcggtggtgacacccacggggggtgacccccttgtttgaatttttagtgtttgtgcgcccatttatctctccaccccatcgttttcttccgcggagaagagattttttgttggacccattggacttttaatttaagcgggcgggggggagaaaaatcatctgcgcagagaaaaaatttttttctcccaggctggaggcgttttttttatcaagaagattccccttaggcggtttgtaaacgttgaacaattgt

SEQ ID NO: 498311 - DNA, 522 bp, Homo sapiens
tcgacagaggtccctggcaggtctctaccgtctctctattgcctcaggtggctttccttacttggatatatgggaagagtacatggcccagtagttggattatatattgttacctaggacctaaacacttccttttccttttttcatccaagtaaaatccgtaactcaagatgtaacaccttagtaagcctttctgactccggatgggaaaagcagtttctatcctacccacggccttatttcataagttaacttttaaaaaatgtctctccaggccaggcagggtgactcccaccggtagtcccagggattggggaggccgaggcaggaggatcccttgaggtcaggagttcaagaccagcctggacaacaaaacaagatcacttctctacaaaaaatattttaaaattagcagggtaggggggtggtgaccggtagtcccacctactcaggaggcggaggggggaggatggttggatcccaggaattggaggttacagggtgctatgatgtgaccactgc

SEQ ID NO: 498312 - DNA, 176 bp, Homo sapiens
cagtagaacttgtgttacatttggcgaaactgttgctctgggtgcttctggaatgtaatatggggaaccctcagtataatgcgaagtatgaaatcttgcttgctcctagacaattacatgggagactatactgaatcctttacataatcaacgtcacacctaacaacccaaaaggg

SEQ ID NO: 498313 - DNA, 460 bp, Homo sapiens
ttttttttttccccatttaaaaatatcttacaggggcataactttccctgcacaaattgggtttaagaaacaaaagggacaatttgctaatcaatgatgagcctttaatccaaccattatttatcccctttccatccttagatcccttgaagagaccatttagttaagactaccaacaggtgacaccctgacctccttaccaaccttgccttttagaggtgaccagaaacctgtgcttttccaaagtactgttatccgtgtaattagtataatatcaatgtggggaaactctaccttttggatttgaggactctgttttctttgaaccctctggttagagactgtatattaattgcaccttagaaccttggggcaaagagaaggacacatgttcctagccctttggttggtctccgggccattattgttccacctttcatcaaaatggcttttttttgaa

SEQ ID NO: 498314 - DNA, 467 bp, Homo sapiens
  misc_feature (62)..(62): n is a, c, g, or t
ctgtgaatgcagccttggcctcagccgcgaggccctcatcgccctccttgtggtgctggcgngcatcagtgccagctgcttctgtgccctcgtcatcgtggcaattggtgtcttgcgggccaagggtgaaacatgcccgagacaagtggacaacaggttggtggagaattttggggtccaggaagatctcatggacctgcacccggtttacgtggagtcccagctaatggacgctgacctggaggtctccctggtgccaccactagaggatcagagccttgtggccatccccatggaggcttcttcagaggagccgccaccacccccgcccctaccacctgagtagagggctgagggcagctgggggaggggaattaaagcgtatttagtggctgtgcactgtcctccctgcaggccctcctgagggcagctgggggaggggaattaaagcttgtttagtggtaaaa

SEQ ID NO: 498315 - DNA, 551 bp, Homo sapiens
  misc_feature (62)..(62): n is a, c, g, or t
  misc_feature (194)..(194): n is a, c, g, or t
ctgtgaatgcagccttggcctcagccgcgaggccctcatcgccctccttgtggtgctggcgngcatcagtgccagctgcttctgtgccctcgtcatcgtggcaattggtgtcttgcgggccaaggggaatggcgtttcctaggcgtgtgctgggggagctccgggggcccagcactgttccaggactcatgttngccttcgtcccctcagtgaaacatgcccgagacaagtggacaacaggttggtggagaattttggggtccaggaagatctcatggacctgcacccggtttacgtggagtcccagctaatggacgctgacctggaggtctccctggtgccaccactagaggatcagagccttgtggccatccccatggaggcttcttcagaggagccgccaccacccccgcccctaccacctgagtagagggctgagggcagctgggggaggggaattaaagcgtatttagtggctgtgcactgtcctccctgcaggccctcctgagggcagctgggggaggggaattaaagcttgtttagtggtaaaa

SEQ ID NO: 498316 - DNA, 479 bp, Homo sapiens
  misc_feature (122)..(122): n is a, c, g, or t
ccttggtcttgcaagaagggctttaccccctgggtgggctgtcacctggggtaggaatggcgtttcctaggcgtgtgctgggggagctccgggggcccagcactgttccaggactcatgttngccttcgtcccctcagtgaaacatgcccgagacaagtggacaacaggttggtggagaattttggggtccaggaagatctcatggacctgcacccggtttacgtggagtcccagctaatggacgctgacctggaggtctccctggtgccaccactagaggatcagagccttgtggccatccccatggaggcttcttcagaggagccgccaccacccccgcccctaccacctgagtagagggctgagggcagctgggggaggggaattaaagcgtatttagtggctgtgcactgtcctccctgcaggccctcctgagggcagctgggggaggggaattaaagcttgtttagtggtaaaa

SEQ ID NO: 498317 - DNA, 386 bp, Homo sapiens
agcttctttttgtttctacctggccaaagttagatgggacaaagatgaatggcatgtcccttctttgaagtccgtttgagcagaactacctggtccccgaaaaaaaatttaggcttccccatttaattattgagagctaagaatgtacccataagtggccaaggttccattcacatgctcatatgtttataaactgtgttttgtagaagaaaaagaatcataacaatacaaacacacattcattttttttttttttttttaccattttcaacctgtattggacagcactgccttttttgcttacttgctgcctgttcaaactgaggtggaatgcagtggttcccatgcttaacaaatcattaaaaccccctagaacactcctagga

SEQ ID NO: 498318 - DNA, 995 bp, Homo sapiens
cccagccatgtccgacgagagagaggtagccgaggcagcgacggggaagacgcctcttcgcgcgcctccgaaaaccgaggcagcgagacgacccccagcatcccgcggcctccgaaggggccgccgccgccgcacgacctcgccctgccactgctgctgctgcctagtgctcacctgtgcttttggagtgctactgacaatggtgaaagcctgcagagccggacacggatagctgcccccgtgaccccatgtgtgcccggaccagactgacgctgctgtcttgcgtgtgccatgctgggctcaactatcgcagacactcatggcctaggcatgggtgcatgttacagacgcgatcatctcctgcacttcttgcccttgtcaactacctgtggcatttgggatgtggctgcggggattgttagtagagtctgccaagtgtgagctgacgggatagtcaagcagaacactgcaaatgtgaatgtgaatgacacctggtgtgacttgggtgtctgaaagaacagtggtccaagggcattgttgtgaccagagaagatggttgtactggtgaccacatcaggataacagagaagcattaccatgaaataacaataggaggtgatcattgaagactatattgatgagaaacgctggcgttgtcgattgagatactgaggtacaattaagcatataccaagccataaaaatggaggcacatactaataagagaatatacgagtaataacataaaaatggcattgtagccacaagagggtatatggggagacaccaaatgttgatggaacaggaggagtagtagggaatattgggtgaccattgcacggtttggacggaaacagtggtgtaagttgtgacatgttcggaaagagctaggaagcaaagaatatgaggtctggatgagaatgggggtccaaatacatagcatatcaaaaatggtagtggtagaactaaaaaatccacttatagagggagctggg

SEQ ID NO: 498319 - DNA, 120 bp, Homo sapiens
atcgtgcagaaatcaccttatcgtgcagaatgattttggtctcatctagttcggcctgcactttagtcatgggatcagcttctcgtgggttctggtatctactgaggtgagaggtgatct

SEQ ID NO: 498320 - DNA, 665 bp, Homo sapiens
gggtatataagataaaatggtttatttaaccattcccttttaatgaacaatagtcatttagatttttaacttacccctgttgattatagtgctataataaacatccttatacatgccttcctgtgcatgtttttcagtatttctctaagataaattgattcccagaagtacacttgtagagtcaaaaagtcatgcatgttttggccaggcatggtggctcacgcccgtaatcccagcactttgggaggccgaggagggcagatcatctgaggtcaggagttcgagaaaagcctggctaaaccccatctctacaaaaaacacaaaaattagctggttgaggtggctggcacctgtggtcccagctactcgggaggctgaggcaggagaatcacttgaacccgggaggcggaggttgcagtgagccgagatcatgccactgcactccagcctgggagacagaaagagactgtatcttaaaaaaaaaaaaatttattttcagtacagccataaaaagcaagaaacagccaggcgtggttggcttatgcctgtaatcccagcacttgggaggccaaggcaggcagatcaccaaggtcaggagatcgagaccaccctggcaacatggtgaaagcccgtctctatttataatacaaaaattagccgggtgg

SEQ ID NO: 498321 - DNA, 119 bp, Homo sapiens
tcatttttggtcgtcactcggcgccatgtctgcccgggctggtctcaccacactcctgcgctccggtgatcccccacgcctcaggctcccacagtgctgggcttccaggtgtgagccct

SEQ ID NO: 498322 - DNA, 169 bp, Homo sapiens
gcggtgactctgaggatccctaagcggagcaggcagattatgcacctcctcgcctctcttcttccaacacaacatacccccagcaggcgtgaccgtccgcttactgatgctccgttactgatgctcgcttactgacgcttactgacgcttactgatgcccgcttactga

SEQ ID NO: 498323 - DNA, 771 bp, Homo sapiens
ccatgaacctggaggctggaaggttccattgccagtgccctgccctggcctgcgtctggaccaagcctgtgccgatgagaatgagcccctgccagcccaacccctgccatggtgtgcggtgcgccctgccgtgtgctgcccgagggtggtgctcagtgctgagtgccccctggggcgtgatgggcaccttctgccagacatgcctcgtgggcagtgacgtgctctgtggcccttcctggctgacttcaacggcttctcccacctggagctgagatggcctgcacacctttgcactgggacctgggggagaagatgcgctgctgtgatggtcgtgttccttggcacgaggccccagctgtgcctcctgctctacaacgggcagaagacgtgactggcaatgggtgtgacttctgttgtccgctggcactgcgggacctgccgcctggagttccgctacgacctggtgcaaggtgggcagcggtcatcaggatgcagggagccagtcaccctgggagcctggaccagggtctcactggagcgaaacggcgcaaggtgccctgcgtgttgggcgactgagccccgtgtgttgggggagtacccggtaccggcacaccgttcctcaacctgaaggagccgctctacgtaggggggcgctcccgacttcagcaaggctggccgtgctgtgccgtgtctacttggctcgacggtgccatacagtggactccttcgaggcgccaaatgatgcccggacagtacaagacatgcagaaca

SEQ ID NO: 498324 - DNA, 867 bp, Homo sapiens
  misc_feature (533)..(533): n is a, c, g, or t
tatcaccaacttttaataattaacatttgtgtttctcaatgctgacaaattttaaagccgatccataacagcaaaatatttttccccaaaccctatgtaaacatctctaaaatcttatttcttacagagccttattcgataatcatacctaagaaaactaacaataattatttaatatgtaattttcagtctttcctcatcacgtaaaatggcttcttaaccatggtttgtttgacttaagagccaacaagggttaccacttggttgctttatagtgtgcactttggctcgcatcgctcagaaatgtcaggcatgggaattgcacattacccgacaggtagagttgaaaatgaaatatgccatgaaatgacatatttgagaacttctcacagagtatgaacaatgatgtctgccttttgaagcagtaatctaagtactttttgtactttcacttctttcttccaaatatattcattatgttccaaatgtataaagaacctaaagtaggaggtcaacatcctgtgttagaacanttgcagacttgacacgtggagaagagggtgcatttttatatgaatttgagaaatactaacataaactaagcaataggaggaattttctgtatacagatatgtttggttttaaaatatttcccgaatttattttttaatttcgaagcactctaaatggatgacattcttctgagtcgacttataggttaaagtgctcggatagttaccctaaagattgtgaggtaaaacaaggggttggggttgttttaaacccttaacctgggcggaaaggtaaggggggcacggggagattttaaccacggggggccccggagaggggggagcaaaaaagggg

SEQ ID NO: 498325 - DNA, 87 bp, Homo sapiens
  misc_feature (4)..(4): n is a, c, g, or t
  misc_feature (33)..(33): n is a, c, g, or t
  misc_feature (47)..(47): n is a, c, g, or t
  misc_feature (52)..(52): n is a, c, g, or t
  misc_feature (63)..(65): n is a, c, g, or t
aaangcagacttctggttcaagatagctcactngaatacatgtttanctctntctttcctaannnattgaattgatagaagatgcga

SEQ ID NO: 498326 - DNA, 769 bp, Homo sapiens
ggcagtggtggaggaacttccggcagcggcagctcaagtggccaaggcaaccatgggtcaaagtcagagctggtggtcatggtcctggaggtggcaacgaaggatgacaaggtacaagaaaacagaaatatgaacctcctgtaccaactagagtggggaaaaagaagaagaaaacaaagggaccagatgctgccagcaaactgccactggtgacacctcacactcagtgccggttacaattactgacacgttagcagcgaattaacagactatcttctcactggaggcacagcaattcattagcaacatcaggaacaaactgaaaccattacgcacacgacaaagccacgaggaggaaagcatcaacaagtggcatgactctgagggggaccccgatgtcagtaggaaccttggaagagattatagatgacaatcatgccaatcgtgtctacatctgtgggctcagaacactacgtcagcattcttaccatacgctagacaaggatctgctggaacctggactgctcggacctgctcaaccaccaggtgcatgccgtgatacgggtgctgatggatgacacggatcccctgggtcacaggtgcatgaccggtagaaaagtgccccaaggagaacctatgcagcatatggcgggaactggcacaacccaaattaagaacataaacgaaattggaagaatccctctcacccataccgtaatatactgaatacatatgtataaggcacctaaaggagtcaaaactaagatca

SEQ ID NO: 498327 - DNA, 105 bp, Homo sapiens
cgtattcctgaggaggcacaggaagatgaatgaggaagaaggtgtacagacgcgatgaagaaggtgaaggggatgatggttatgaacaaattttccagctgatga

SEQ ID NO: 498328 - DNA, 1011 bp, Homo sapiens
tttatgaactgtcccatcacaagacatacagtggtctagcaactacattatgaactgtgccatcacaagacatacagttggcttcttgtgatgggacagcataatgtatgcagaatagttgctgacagatgtgacagaatgtggagtggggagggtagaggaaacgcgactacgagatactaaatgatctcaaaaggtaaaataccctcaccaccaacaggggacaagacatggccaacaaagcatccagctaacaggacaacacaagacactagcaactaacaacagaaacaacaaaacacaaacgggcacgcaacacaacaaaaaaaatacaaccaacccaaaaacgaccacaacaccaaaacaacacaacccacaaacacaagaacgacaaaccaaagcgcgcacacaccactacagacaaccgaagaacacacaactaacaaacaagggcccaaaccgcatcacacaaccctaccaaacacagcaaaacacaacggaacacacaagaaaaaatctagcacacgacgcaacacaacacacaacagcaagagaagcaaaaaaacatagcaaccaaacaacacacacaaaaaacaacacgacaacaacaggaaaacaaaaaacaacatacagaacgagcataaaagcgaaaaaacacaacaccgacacaaatcactgaccaccagaccaagacccaaccaaacaacaaaaggcacgaaagcagaaaaataaagacagcggagaaggagcaaaaaaagacagaaaagaacaaccaagaagcagagaagcaaccaaggcagccaaacgaccaacagagaaatcagagagaagaacacaagagagacagaaggagacacaccacaaccgacgaagaaccgagacaaacgcatgaagagccacagaacgagatcaacgcagagcagaggcgaaacaaagcgagagaaacaagacaatagcggaaccgaacagagacagaaccaacgcagcagccgaaaagacgcagaacagaca

SEQ ID NO: 498329 - DNA, 703 bp, Homo sapiens
  misc_feature (498)..(498): n is a, c, g, or t
  misc_feature (520)..(520): n is a, c, g, or t
  misc_feature (529)..(529): n is a, c, g, or t
  misc_feature (538)..(538): n is a, c, g, or t
gagagaaaggaaatctagtggaacaggaaagagagttacaccttgtgggtgtgagtttgggacctgttggcagaagggaatgtcactccctggaaacaggttcagcatgtttgcacttgttattttgtagctttaatgatttttgttttctaatagggcaaatctctctaagcttggtgtttagagctgcttcatattttgaactagaactgtggcaatggaactagtttaaaatatgaagcagctctaaactagttccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgttaactcattactttgtttgatgtgtcttacatattnttgactaaaagttatagaagtnattctcggnggaatcttntacagtggagaatggggatgcagttatgccccagatttaaaactgcatccccattaaccctgttggcccgggtggaatgaaagccaccccttttttatggtgaaaaaacatttttttttccccctttttctgcacaattccttgaaaataaacctttttttccct

SEQ ID NO: 498330 - DNA, 680 bp, Homo sapiens
  misc_feature (162)..(162): n is a, c, g, or t
tcttgtgggcatttctgaatgcccagcatccctattcttgcactttggggtggttttaagtaaataggggtgacttgaacccagacactggaataccatgacagttgtctgataagcagattgcttcaagtgtctgagggatggaaagtgtctacagcatgnagacgctggacaaaggggagattcaatgtcctggttgggactgagctgtaccatgtgagattttatcatgctactcagagcagtgcacaatttagaattatgagttgtttacttctggaattttccatttaatatttttgactgtggttgactgtgtgattaactgaaactgcagaaagtgaaaccgtggataaggagggtgggtatactatacttagttctttaaaaaaatgctggccggatgcggtggctcacgcctgtaatcccagcactttgggaggccgaggcgggcggatcatgaggtcagcagatcgagaccatcgtgtctaacatggtgaaaccccgtctctactaaaaatacaaaaaaattagccaggcgtggtggcgggcgcttgtagtcccagctactcgggaggctgaggcaggagaatggcgtgaacccaggaggcgcagcttgcagtgagccaagattgtgccactgcactccagcctgggcgacagagcgagactccgtctca

SEQ ID NO: 498331 - DNA, 220 bp, Homo sapiens
agagacaagatgtacaagtagaagagacgagatgctggtggcaggccattgaggacagcttaatggttgtatcaactataaagagctcgtccgcgatggtgctgaaatggctgatggaccttcccagctctccccaggagtccgctgcctttcccttgtgtgcaatttttgtatcttcgcctagacctttcccatacggctttcttgttctctagcaatc

SEQ ID NO: 498332 - DNA, 483 bp, Homo sapiens
  misc_feature (149)..(149): n is a, c, g, or t
  misc_feature (151)..(151): n is a, c, g, or t
  misc_feature (154)..(154): n is a, c, g, or t
  misc_feature (173)..(173): n is a, c, g, or t
  misc_feature (177)..(177): n is a, c, g, or t
  misc_feature (183)..(184): n is a, c, g, or t
  misc_feature (186)..(188): n is a, c, g, or t
  misc_feature (193)..(193): n is a, c, g, or t
  misc_feature (197)..(197): n is a, c, g, or t
  misc_feature (199)..(199): n is a, c, g, or t
  misc_feature (208)..(209): n is a, c, g, or t
  misc_feature (216)..(216): n is a, c, g, or t
  misc_feature (221)..(222): n is a, c, g, or t
  misc_feature (226)..(226): n is a, c, g, or t
  misc_feature (228)..(229): n is a, c, g, or t
  misc_feature (231)..(231): n is a, c, g, or t
  misc_feature (234)..(234): n is a, c, g, or t
  misc_feature (236)..(236): n is a, c, g, or t
  misc_feature (239)..(239): n is a, c, g, or t
  misc_feature (243)..(243): n is a, c, g, or t
  misc_feature (254)..(254): n is a, c, g, or t
  misc_feature (272)..(272): n is a, c, g, or t
  misc_feature (289)..(289): n is a, c, g, or t
  misc_feature (293)..(293): n is a, c, g, or t
  misc_feature (299)..(299): n is a, c, g, or t
  misc_feature (302)..(302): n is a, c, g, or t
caggtagatttctaaactattataccaaaagcatgatccactcagggtaaaaaacaaaaaaacaaaaaaacactggatatcataaaaattaagaacttctgctcttcaaaagacattattaagacaagaaggccagacacagtggctcncnccngtaatcccagcactttggnaggncgaggnngnnngatcncgangncaggagttnnagaccancctgnncaananngngananccnatcnctacaaaaatncaaaaaattagccaggcntggtggtgcacctgtantccnagctantcnggaggctgaggcaggagaatcacttgagcccgagaggcagaagttgcagtgagccgagaatgtgccattgcactacagcctgggcgacagagggagactcagtctcaaaacaaaacaaaacaaaaagtagatgggcaaatctaccgtgggcaaatctaccgtgggcaaatctaccgtgggc

SEQ ID NO: 498333 - DNA, 680 bp, Homo sapiens
  misc_feature (84)..(84): n is a, c, g, or t
  misc_feature (139)..(139): n is a, c, g, or t
  misc_feature (238)..(238): n is a, c, g, or t
  misc_feature (311)..(311): n is a, c, g, or t
  misc_feature (313)..(313): n is a, c, g, or t
  misc_feature (337)..(338): n is a, c, g, or t
  misc_feature (341)..(341): n is a, c, g, or t
  misc_feature (352)..(352): n is a, c, g, or t
  misc_feature (355)..(355): n is a, c, g, or t
  misc_feature (362)..(362): n is a, c, g, or t
  misc_feature (364)..(364): n is a, c, g, or t
  misc_feature (370)..(370): n is a, c, g, or t
  misc_feature (377)..(377): n is a, c, g, or t
  misc_feature (380)..(380): n is a, c, g, or t
  misc_feature (387)..(387): n is a, c, g, or t
  misc_feature (389)..(390): n is a, c, g, or t
  misc_feature (409)..(409): n is a, c, g, or t
  misc_feature (412)..(414): n is a, c, g, or t
  misc_feature (417)..(418): n is a, c, g, or t
  misc_feature (429)..(429): n is a, c, g, or t
  misc_feature (446)..(447): n is a, c, g, or t
  misc_feature (451)..(451): n is a, c, g, or t
  misc_feature (459)..(460): n is a, c, g, or t
  misc_feature (464)..(464): n is a, c, g, or t
  misc_feature (466)..(467): n is a, c, g, or t
  misc_feature (470)..(471): n is a, c, g, or t
  misc_feature (473)..(474): n is a, c, g, or t
  misc_feature (478)..(478): n is a, c, g, or t
  misc_feature (483)..(483): n is a, c, g, or t
  misc_feature (485)..(486): n is a, c, g, or t
  misc_feature (488)..(488): n is a, c, g, or t
  misc_feature (490)..(490): n is a, c, g, or t
  misc_feature (499)..(499): n is a, c, g, or t
  misc_feature (511)..(511): n is a, c, g, or t
  misc_feature (514)..(514): n is a, c, g, or t
  misc_feature (516)..(516): n is a, c, g, or t
  misc_feature (520)..(521): n is a, c, g, or t
  misc_feature (528)..(528): n is a, c, g, or t
  misc_feature (531)..(532): n is a, c, g, or t
  misc_feature (554)..(554): n is a, c, g, or t
  misc_feature (564)..(564): n is a, c, g, or t
  misc_feature (568)..(569): n is a, c, g, or t
  misc_feature (582)..(582): n is a, c, g, or t
  misc_feature (588)..(590): n is a, c, g, or t
  misc_feature (594)..(594): n is a, c, g, or t
  misc_feature (607)..(607): n is a, c, g, or t
  misc_feature (680)..(680): n is a, c, g, or t
aagatctatagacccaggaaggtctctgggtgggatatagccaagatgatactccccctacttctggctcttctatttggggcngtttctgctcttcatctaaggtctgagacttccacctttgagacccctttgggtnctaagacgctgcctgaggatgaggagacaccagagcaggagatggaggagaccccttgcagggagctggaggaagaggaggagtggggctctggaagtnaagatgcctccaagaaagatggggctgttgagtctatctcagtgccagatatggtggacaaaaaccttacgtntnctgaggaagaggacacagttaaannggngggcatccctnggngccacancncccccnaccgccnggngagaagncnncacaccgggaggcaaccgnggnnnacnngccccagggcnacaccggcaaccgcggnnccanccacaacnncaanannggnntnncganaaacngnnancnaacacacanaaaaaacccganacnanccgnnccgccanccnnaaaaccataccctacatcaacnacatttaacncccnnctaccaacaacancccaannncacntatcccatcatanaaacaaatcctaaacacctcctatatcactccaaatctcttaaacccccccattatccactacccaaaaatcn

SEQ ID NO: 498334 - DNA, 320 bp, Homo sapiens
  misc_feature (106)..(106): n is a, c, g, or t
  misc_feature (108)..(108): n is a, c, g, or t
  misc_feature (111)..(111): n is a, c, g, or t
  misc_feature (130)..(130): n is a, c, g, or t
  misc_feature (134)..(134): n is a, c, g, or t
  misc_feature (140)..(141): n is a, c, g, or t
  misc_feature (143)..(145): n is a, c, g, or t
  misc_feature (150)..(150): n is a, c, g, or t
  misc_feature (154)..(154): n is a, c, g, or t
  misc_feature (156)..(156): n is a, c, g, or t
  misc_feature (165)..(166): n is a, c, g, or t
  misc_feature (173)..(173): n is a, c, g, or t
  misc_feature (178)..(179): n is a, c, g, or t
  misc_feature (183)..(183): n is a, c, g, or t
  misc_feature (185)..(186): n is a, c, g, or t
  misc_feature (188)..(188): n is a, c, g, or t
  misc_feature (191)..(191): n is a, c, g, or t
  misc_feature (193)..(193): n is a, c, g, or t
  misc_feature (196)..(196): n is a, c, g, or t
  misc_feature (200)..(200): n is a, c, g, or t
  misc_feature (211)..(211): n is a, c, g, or t
  misc_feature (229)..(229): n is a, c, g, or t
  misc_feature (246)..(246): n is a, c, g, or t
  misc_feature (250)..(250): n is a, c, g, or t
  misc_feature (256)..(256): n is a, c, g, or t
  misc_feature (259)..(259): n is a, c, g, or t
atattattggccccatgacattcagtgacagtgtgggagcaggctactctccagggacatgtatttggaggcatatggagaagcggggccatggcgaggtggctcncnccngtaatcccagcactttggnaggncgaggnngnnngatcncgangncaggagttnnagaccancctgnncaananngngananccnatcnctacaaaaatncaaaaaattagccaggcntggtggtgcacctgtantccnagctantcnggaggctgaggtgggcaaatctaccgtgggcaaatctaccgtgggcaaatctaccgtgggc

SEQ ID NO: 498335 - DNA, 1144 bp, Homo sapiens
  misc_feature (361)..(361): n is a, c, g, or t
  misc_feature (436)..(436): n is a, c, g, or t
  misc_feature (465)..(465): n is a, c, g, or t
  misc_feature (549)..(549): n is a, c, g, or t
  misc_feature (556)..(556): n is a, c, g, or t
  misc_feature (558)..(558): n is a, c, g, or t
  misc_feature (561)..(561): n is a, c, g, or t
  misc_feature (578)..(579): n is a, c, g, or t
  misc_feature (678)..(678): n is a, c, g, or t
  misc_feature (730)..(730): n is a, c, g, or t
  misc_feature (750)..(750): n is a, c, g, or t
  misc_feature (837)..(837): n is a, c, g, or t
ggcaagtcgctgctcggaacactgcgaggccgcgtctctgtgccgtgggatggggtgtgctgggcgcggttcccaactgaaggctattgtaaggccctaccaccttgaaagctagaaacgacgcatgacgaggagtaagaagatagatgcatcactgctcgagaaagcctgtgtctgatacacagcattcgggacactctattgcaatctaccagccgctaagattactaccaatgagactgcagtaaggtatacgctcgtagagccaccagcgacgaagagtagtacatgtgtcgtacaggatttagcttatatttggcgctcgatcactacggcgcgcgggtggactagtccgatcagngttgccatcgatgacaccgaggctcgtggccgacatctgcaatcctggagcaatagaccagtaggtttgcttcanagaggtaaggcgctcgttggaatgagacnatcgtgatggccctaagtgatgtgactgaggtttgggctaaggagtccgggggtccgtcagagcgtgtgccattgagacacccncctgacnantcntatgccttgctttagcnntaggaagcctggttgggcaaccctgtggaccatagcaggcacttggcttggacctgggacaaacgaggtccaaaaggtgtaccgaacgcgtgtagatcnttgggcgtggacgctcagatcttatacaccaggtcgttcgtaggatagcacnaggtctgaccctgttcaccntgtgcaaacgggtaggccctatgggcaagcccattggcggcgacttttgctgtcgcccaagctagcgaggaagccattcgttgcaanagaccccgatagtgcacagaatggccgctaggagtaggacacaggctgtggctttgggcagttgcccctttgcccccaggtgcacctcgatccgatttggcatagacagcccagggctacaagaggtggaatagcctcccgtgtccctggtgttttgacctatgattgggatcattcacattgaatctgatcgatgttccgtgggacccacgaggagcgtactgtcaacgagatgcgtgacaggaccgagctgcgtccattctgcaggggcaaactctaaccgacaaaggcttcctcaaccgggacc

SEQ ID NO: 498336 - DNA, 431 bp, Homo sapiens
ggcgtggggaggagagatacaggctccacactcacactctctgtgcagttgatcgttttcttaaaccaaattagccggggctttcgttactatggtgcagccggggcttgcagaatcccagtaatagcatttattaggtctatttgcctggaagcatgccttcccggatctgataatgcaccagtgcagggagagtgtgggagatgctatcaagcatttgattacacttgcaacagggatttttaaggggtggggtgcggggtgaggggtgagaggaaaagaaaggagggaaacaaaccgctctcccgaggagctcaccagggccggccggcgcgtgcgttgccgcatccccgcgtgggttccacaaaaggcggcccccggtctccgggtcacggtttggggattctccttccgggtcctggcggagggcg

SEQ ID NO: 498337 - DNA, 187 bp, Homo sapiens
tttcaagggttctgcatctcgtttattagcacagaaataacaggtttagagtatattacaaaaagagctcaaactgttcagatacagcaactgggcttactaggggacagatttttttttacgtcagactactgttttggggggcggggactcctcatcctaaacaaagtgttaaggttcatagaca

SEQ ID NO: 498338 - DNA, 751 bp, Homo sapiens
agcggttaagactcatgtctatgactttcactctaagactggcaaaaggacacgcagtcttctatgttgatgtcaatattcactttcaggtagaagataatcttatctaatttttgagaccagaataagccttttaaggtaaacctcaaaattatcatctcatggtaatactgaccattttagtcccctacgtttgacatggcagatagtgactacactggtgtctgactttgtgtcctaggagatttctccctgagaaaatacaagggctgttggtgagagcagacttgaggtgatgatagttggacctctggtctacaagagatttcataactccttggaaagcttcttataagtcattcttaacttcttggtagctagaaatttagacgtagttgaaatctttaggcacatgaacttctgagggccacatagatatgtgactcgacgggacacaagttcttaaactgattaactagctgctaatatagtttggtcgaatttattgccactgatgttcgtaccttgtggtatatctgtccctattaaataagtgctgttttgctcctctttaatattgctgtgaacagtggtgcccattgtagcactatgttggacttacctcttattatttcatacgaaaactacgttaattttaccttactttcattgtaacataagcctgtcttcctatctggattttcgtgtgcatacatattctactgattaatacttttgcattttaatcctg

SEQ ID NO: 498339 - DNA, 1225 bp, Homo sapiens
tgggctaaagcacttgtggataatcagcaaacgtgtaaggtagggctcaagcctacctcccaaaacccgtttaacctccttaacagcggcttctttccttcttacagagtgacctaacgttgcttctttcagcctcctgtggtgtggccccttcctttgtgaaactccctttgtttccgcagcctcggagttagaagttcgacctcccttcagagacagaggtggagtgggcgtgattatgactacgtgggtggtagctgtggctccaagagggcaccccacggtgtgggggccttgcacttgtgaacagccgccagatgtgagacaaccactttgatgtggctgactgttggaaggagcaggtcacggggttattctccttgtgaaaggcctcttataccatagtgctgtgacccctatgttgacactctccgagaccccaaatcccgtggtttgttacacggtgtttagacaaggttggctgaacaggcacgaatcgcccaattgccacaacaggtgttgaaacggaacacacccagggccaagtgataacaagagcgccccaagcccatatatttcccaaacgtttggtgggttcctcccagactactcctcgtgggccccgaatgtttgcccaagtcacgccgtggggaaacaacctggctagaaatacattcaagtggtgtggccacaacacaatcaccacaggaggaacaccgtgccacggcgacacagccaggtaacagcacgcacgcaacaggggcgccacaagttggaagcccccaaaagaggcaaggggttctcccaacgggaaagataaacaacggcagctgtaaaacaaaccaggaaggcaaaccgggaatgaatctggaaaacccgaaacgacagcgcgaaccgtaggatccccaaggcgtataacgccacagggaattactggccacaaaaggccccccagggcacgtgcaaacggaaaacaggacgtacttacgccaaacaaggcgcactaacaccaaaaacacagaaacaagcagcggacaacacgcacatgcacagtgccgacacgatgccacaaataccactatatcacagcaaccatgacatagacgagcaataaacaacaaggaacactccagacacacccccccggcgacacacaacaaacaccacaaaagaataaccacaacagccaccacacaaaacccagaacgcaacaccagacaccccg

SEQ ID NO: 498340 - DNA, 253 bp, Homo sapiens
  misc_feature (1)..(1): n is a, c, g, or t
ntactcaagaagatcacttgctcatgctggctatcagcttcctgattgcccaaagacccaggcccggcacacttctccccaatgcacggtggaagttgggccggatttcacggaaacatcttacttcgattggtctggatcactccaggcaccatccagtgtatacccagtacattatacgcagggttctcattctaatagcgattggctaaactcgtatctgttcacgatgtcttgctcttggacacccaac

SEQ ID NO: 498341 - DNA, 599 bp, Homo sapiens
ggacgcgcttgtcttaatgagactcttgttactacagctgtgcatggcatatggttgtgcgtgccttccgcacataacacatatgtgtacgtttgacctgacatgttgaaccccgccctggctgttgttatgactgctgtgtctgcctttcctccacttgaggttcacctaggcgttataggctaaagaagctactctggctaagtgatctggtatgcggtagtgtctatctttagctagagctgtgatgctcttggatcactagcctgtgaggaaaggggcgtgttatccctagatgtagcgtgctacaaggtgcgttataagcttgattcttagatgacctgggaagctaggccagctaaagaactccttagtccatacattgagagcattttgacaggctcttacttataaatatgcatgcctggtcctagcacgccctgtccgtgatcttcatgggcacgtatgttcacgtaatggttctagtgagtgtgccagtgcttacacccagaaatgaacggatactagtttgtccttcggtctggtatatgctgagttttcaggtgattgtaagcttcggtactttttcctttcctcct

SEQ ID NO: 498342 - DNA, 184 bp, Homo sapiens
gaggcgactctaaggatccttattctgcaccacagcatgacaacaaataccgaatgaaaacacaacgatttaagggagagaaggagtaggtatgggtagatctcgagagtccacggaacaggtttcactttgccctttcaagtttatataaaactaaagccacacaatttaaatttgaagcctg

SEQ ID NO: 498343 - DNA, 405 bp, Homo sapiens
  misc_feature (8)..(8): n is a, c, g, or t
  misc_feature (93)..(93): n is a, c, g, or t
attgtgtnaccccaaaacatatcctaaaacatagcaagggtatggtaaaaaatatggtaaaaagacagataaaaaatggtaacaccctgtaanagggcactgaatgtgggttggctgtgtccccccaccccaaatctcatcttgaaatccccacgtgttgtgggagggacccagtgggaggtgattgcatcatgggggcgggtcttttcctgtgctgttctcctgttagcgaatgggtctcatgaaatctgatggttctttaagggggagtttccctgcacaagttctctctcttccctgctgacatgtaagatgtgacttgctcctccttgccttctgccatgattgtgaggcttccccagctctgtggaactgtaggtccaataaacctctttctattgtgaa

SEQ ID NO: 498344 - DNA, 114 bp, Homo sapiens
caactggcagctggaactgtggaacaccaattcggtgcacaaggggtaagttgaagcactgagctttcattgcagttagatgcaacaggaaacaacttgtctgtgtctgggatg

SEQ ID NO: 498345 - DNA, 764 bp, Homo sapiens
cgcggtggctcatgcttataattctagcactttgggaggccaaggtggacaaattgcctgagttcaggagtttgagaccaccctggacaacatggtaaaactctatctctactaaaatacaaaaattagctgggcaaggtggcgggcacctgtagtctcagttaccctggaggctgaggcacaagaatctcttgaacccaggaggcggaggttacagtgagccaaaattgtgccactgcacacgagcatgggtgaaagagcaagaccctgtctcaaaaaaaaaaaaattgggtacatttggagtagagcaattgaccctctataaggggggttgagtggggcttcatctaattacgttgaaggccttaagattgaaagacggatctcctccaagaaagagaaaattcctgccagctgatggccttgggactgaagctgcacatattactcttttccccaggtctccagctgggcagccttatgctgaagaatctgggattgggtcagcttccacaactcatgtgagccagcctgggttgtgctggcttatggctggtaatcccagcactttggggaaggccgaggtgggcgcgctcccgaggtccaggagcaccaagaacctctccctgggttaacaacggggggagccccaatctttgctcacaacttctccaaaataagcccaggcgtgagtgagcgggaggcccgtaagttccccagtctatttggacaggctgagcggacaggagcactgggcgtggcac

SEQ ID NO: 498346 - DNA, 342 bp, Homo sapiens
  misc_feature (4)..(4): n is a, c, g, or t
  misc_feature (8)..(8): n is a, c, g, or t
  misc_feature (124)..(124): n is a, c, g, or t
  misc_feature (323)..(323): n is a, c, g, or t
aagnaaanccctgtcctattccataaataccccatgatgaaatagtcccacaaaattgtgtcccaccaattgtgccgtacactctcaggcgaataagcccaaaggctcataataattgaagctnaaaaataatcgaagctgaacacggtagctcatgcctgtaatcccaggattttgggaggctgaggtgcgcggatcgcttgaggccaggagttggagaccagcctgggccacatggcgaagccccctctctacaaaaaaataccaaaattagccgggcaatggtgggacattgcctgtagtcccagctacctcgggggacntgaggtgggaaggatcacc

SEQ ID NO: 498347 - DNA, 1455 bp, Homo sapiens
gagctttacaaaagctctttcaggtccccatttatactttacgtgaggctgcgaactgatttcacgcaacaccctaacttaactaacaacgacatgggctacggctatgtctacgcttctcatctaacaaacttctttactctactctctctcactctctacttactactgaccgactcctttctactactctactcactcctcaccttcttacacaccacacaacttaaccctgggcaaccacactacttaccactggcaaccctgctcacttacgcctcacgccgcttcccggcacgccactccttaccactgctcctcgctactccaacctgcgcacgcgaccgacacacaactacctcgactaacacacaccaactccacgctcgcctgctgcacacaacaccacaccttcttcctctcataccaagctccctccttataaccttcttcaactccctctcctcttcattccatctctcgctgcgcgatcctctcttccccccccctttgcccctccctcgactcccaccctctcctacacccctctccaacgccttctcactgctaaccgaacccgtgcttcaactaacacacccttgccacttactctttaacaaatctctaacctctcttgaccactctcactatcttgccacaccactcaacctccgggctaccaagccccttaacttcctgggcgccccagcccatggatctacaacctgtctaacacacccccctgccagccacgcctaaacactacaacaccaatcttaaacctctccctctcctataacttccctaactccctctgcgcaacacttacccctcctttctacttggcaccttacaccacctctccacctccccttctctgcctacacaccgcccctcaccccccttcccctacctctcaccccctccaccccgcctccaccctcctcctaacaccccctcctctacccacacccccttacccctctccacggaccctaaacacccccctcgccgtcccctcacactctcacctcggccctccctcaccttacaacctccccccgcgctcctcctcaccccccccctccttcaccccacacccccttaactcctcttcagcccctccaccacactctggcctctctcccccatcacccgcccccccccccttcctctccacccacccccacacaccgcgcacacccgcaccccagcgcactccgccacccacgcgctcggccgcaccccgccgctccacccaccaccccccctccccaccacccctcaccccctccctccctccaccacccacacacctcgcccacaccctccgcccacaccacccaccccctccaccccacccaccccccccacccccaccccctcccccctcccacacccccgcctcacccacgcccaccaccacccctcccccccccccgcccaaactccccc

SEQ ID NO: 498348 - DNA, 222 bp, Homo sapiens
tgtggctgggtgtcttaaccctgaatcaggtgatcgccgcatcggtctccatggtgctgggattacaggtgtgagccaccgtgccccgccctttccccagattctatgtgcttgttgtttgggaatgcgagcagagacattgaggcgatgtcgagaaactgtgtcatctcatcgaagctctattacaaaggcacttgcatgagaactattttgactactttg

SEQ ID NO: 498349 - DNA, 476 bp, Homo sapiens
  misc_feature (123)..(123): n is a, c, g, or t
aatcctcctcccagtcgccccgtttatctcccctacgctccaagagcgcagcccatgcccacagggcgcgcactccagatgcagagcaggctcaggactcaccgggcataagcgagcctgtgntggagcgtctggacctgagaaggcagaggcgcgactgtggtacatgaggaagggcaggaggaggatgtgggatggtggaggggtttgagaaggcagaggcacgactggggtacatgaggaaagggagggggaggatgttggatggtggaggggctgcagactctgggctagggaaagctgggatgtctctaaaggttggaatgaatggcctagaaccggacccaataagccaaagccacttccagcagcggttagaaggccttgcgcccccagagagccgatttcacaatccagaagtccccgtgccctaatggggctgccctgatttactcctgggtccttgtgtgcggggg

SEQ ID NO: 498350 - DNA, 902 bp, Homo sapiens
agattaactttactttaaagactggcaaagaacggtatgttagaaatacatgtaagtctgctgctattaataaattcaagctgtttgccctttgctgtatggagcctgaatgtagagacttgaagtatttgtagatatttgtgctgtcccatgacagagcagggatatgaaacttgccctggcatccagacatgttctgaggctggctcagatatttgttttcttctggataagtagcatcaaaacaaatagtaattatattatttaatagacttaaaacacggcaactacatttgtataggaaaaaccacattagtaacattacatggagaaaagcattttatgtaactatagttccagcaaataccactatgccttcattaatgccttaaaaccatcttatttacatctgtagaaccactggccatttaatagggcaattcaggagcaatcattaacaaacagttgcagttttcattaggttttctctgtttattctaatatgtaaaactgaaattaaagtaaatccttcagagttcattctttaaaaaaagtaagtcctaaggaaaaactgttatattagctatttaaaaggatgctggatactgtcgaatcagtcactgttgaactcctatcgagtttccatggaaccagccttgcaaattataaatggctagatatttactctggtaagattcacccgcaacttattctattcacagaaggccttaaaatacttcacggtaactctggggccctaacttcatggacttggattggtaccaatctccttgtgaacccacgggaagggaggcgctcaacgcttcacaggtgcgcaatgggtcccacggaaatgccttggtcaaagacctgcctttgcttggcacaccggctccgcgagc

SEQ ID NO: 498351 - DNA, 3156 bp, Homo sapiens
gacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggtgaagaaaatgaagctctcattaactgactcaggataatacagccagtaaatggaggagacaactcaaactcatatcctctaacttcaaatttcatattactttctatttaaataaatgcttatgtagttcagtcattacatcctatttaaatagtgtttaaatctttggcaatcttctttgaccagaacttctgtctcttatgtatatcccaatacagtgtaagctgtaatttgaaaaagggggttctactgttttatataaatataaattaagtaaagctgtgaaaattactcttagtgccttttaaggagctaaattctgtttgggatgatcagagataacctcaaagaagaggttttgaaattggggaggggctttgcaagctaagcttctggtaggggccagggaggcattctaaaagaagggacttccttcgtatagcacacaaagccctcttaaagtcctcttgatttggtctctagtcatctccctgacctccttccagcccctcatgcacaccttttatacagccatagtgcactgcaatactcatagtcccctcagtgagtatatcagattgtctcatgcttttgtgcctttacacaagatgttccttttacccattgagaatcataccctatcagatcccttacctaacagcccttcatactacctaccaccactttatttcagaggcctttttctatatgcttctacaacattcgtggtacttacaatcataaatgtatgttttggtgtttcttattaaactatgaatacttaaaaaaaaaa

SEQ ID NO: 498352 - DNA, 224 bp, Homo sapiens
gtctgtgctgtggtctagcgccagcagcgaatcccctgcagctctcggctgctccccaagggcacaggttttattttttggggtgataagaatgctctaaaattgatgtagtggtagttacacaagtctgtgaacataaaataagccactgaattgtatatttttttcgtctttatagggccacacctgtggcatatagaagttcccaggctaggggttgaatc

SEQ ID NO: 498353 - DNA, 637 bp, Homo sapiens
ctgagtgttgagtgggtggtacaggtggaaagggcaagggtacactccacttgggtagtgccaaatggaggtggggggatgtactccatcgagtccagattgccagtgaggcaaggcggtgggaggtgggggcactgtctccgggatctcatcctcatggtctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattgttaactgtctgggggtgtcccttcaatgaattagagctcatgcccttttctgggtttggtgttga

SEQ ID NO: 498354 - DNA, 570 bp, Homo sapiens
tgatcctctatagaggccatcctctgttgctggcagcctcttaccgtttccatgggcttcaaaggtaggctatggtagttttgctgatggcccctgcaaccttcccagccactcctgttgcaataaggacttaggatccgtttatcacaaagtcgggattgtctcccccatccgcgaattctgtctgcttgatctggaatacacaggtagcccttcctggctctgtgatggtcgtctctcagcttccccgcacagcttgcccaccctcatagttggtgagatagcgaagttctggctctgagttgtgaccccttacagagtagatgcctcggcaggctgggattggcacctggagggtacaggggaccatcttcgttattccgctcttgttctcattcctccaacttcctcccctccttcaatgtatttttttgtaaagttgatgccttactttgttggataaatatttttgaagctggtactgttctatttctctcttggattcttttatgaactgtaaggattgttttggcgggatggagttagaaccttcaatgataatgttttacc

SEQ ID NO: 498355 - DNA, 5279 bp, Homo sapiens
gacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcaggcaggtggggggacctgactatgctgccctcaccgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaaaatcctaattaaaa

SEQ ID NO: 498356 - DNA, 5246 bp, Homo sapiens
gacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaaaatcctaattaaaa

SEQ ID NO: 498357 - DNA, 486 bp, Homo sapiens
tacatcccattgtacacgtcagtaactctcatagaggctaagctgttaaaatttccatatatatacaaatagcaaagatatttctttccctttctttctattctttctttctttctttctttctttcttttctttctctctttccttccttccttccctccttccttccttcctttctttctttatgtatgagacagagtttcgctcttgaccccgaggctggagtgcagtggcctgatcttggctcactgcaacctctgcctcccggattcaagcgattctcctgcctcagcctcccgagtagctgggattacaagcacacaccaccacgcccggataatttcacccggctaatttttgtatttttagtagagactgggtttcgccatgctagccaggctggtctcaactctttacctcaagtgatccgcccaccttggcctcccaaagtgctgggattacaggcatgaacaactcgactgacca

SEQ ID NO: 498358 - DNA, 4945 bp, Homo sapiens
gacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaaaatcctaattaaaa

SEQ ID NO: 498359 - DNA, 4092 bp, Homo sapiens
atctagcagatctcgcgtcgaccttctgctctgtgatcagtgggggtatggggggacagtatagcagaaggcctggctcaggtggttttgacagtgaactgaaccagtgaaaccagagggaacttgcatcgtgattcccatgggagtcccagacaggtaacggctgagtctcctacttctacagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaaaatcctaattaaaa

SEQ ID NO: 498360 - DNA, 201 bp, Homo sapiens
tgcactgtactctagcctgggcgacagagtgagacctgtctcaaaaacaaacaaaagaaaacaaaaaccaagaaattccagattggtcttctatagctacttcactaatgtgtcacatcatagatttcagtgactcagtgaatctcagaggttatctcatcaactcggcaaagaaaccctgcaggaactatggctagggcc

SEQ ID NO: 498361 - DNA, 3827 bp, Homo sapiens
  misc_feature (104)..(104): n is a, c, g, or t
  misc_feature (287)..(287): n is a, c, g, or t
  misc_feature (305)..(305): n is a, c, g, or t
tatagacttcaagaggaatcaattttgggcacttaggaagttgggaagaggggctggaagagtcaagcaaggagaattgttacaaaaacaatgaaaggaaagantgcagcatgcctaaacagggagggaagtgtgccccttttttgccaccttgcctgctgtctgtggagagacaacacaaaaaggactggcttttcgtgaaagcaatctatgatactgtcttggatccttaaacttaattccaaatttttcacttgggatgattctcccctttttcctcccacttngatcctcatagctatcanccctcctccctgagtattctgatgaccgatttactctgacagctaaaaacaactctctcagtatttctcctctgttccttgcagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaaaatcctaattaaaa

SEQ ID NO: 498362 - DNA, 424 bp, Homo sapiens
  misc_feature (14)..(14): n is a, c, g, or t
gctggacggacagnatgagagtcttaaaggcacggcttaatacttaccattatatttgcctcaactcaagtattaattgaaatagttggtcagatattgaagaacgcctgacaagaataatgaataactggccatcccttcacaaacttgcataacacatgtatgacaaaaggataaaataggacggctgaaatcccgagaaagtctgtctgtctgcttacaaattcaaaaaaaaaaagcccatgatccttggaaaggggaaacagagatagtttcccagtcagatcataatttctaccatctctgtgacactcatcactccaaaaggttcccactctccgcaccccgatacactttgggaaccaatatatcacatgtcgctcctgaacaaatggggaaacaatgtgaatcatgcgctctaccc

SEQ ID NO: 498363 - DNA, 4144 bp, Homo sapiens
gacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgatctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaaaatcctaattaaaa

SEQ ID NO: 498364 - DNA, 344 bp, Homo sapiens
tacgctgtacgcagtatgaaatgccacatatgctaggcactaatggccatttccacataagattagtggaccaaggttgcctcagctaacatactacagaatgagaaagtgcagataaagacgattactgctcctatgctctaaaactggtgcttgggtgatcagaagcagcgagccaatggcaagagcacttctgagtgataactaaagcagattggtggactgttcacattctccaatgatcaaacatactttccactgtccattttctctttcacctcattttgcctctctatccgccatccctgcttatttcttaagcccatagatggcactcattaaat

SEQ ID NO: 498365 - DNA, 271 bp, Homo sapiens
agaggaccccttggagccttacctaatatgcagagaatcccgtgaggccgttaaccctagggaatgggtgtagatagttttgtgagtggagtgatatcaaaatgacgccagaggaatagtagggaaatacggactgttgcatggtatgtcaggatggtatcttccagaaatgagtcacactggttggtggcggagagagacaagaaaggtggatgttatcattcaagatgatatcagttcaagaatttacccaggaggaatacggggtaag

SEQ ID NO: 498366 - DNA, 5302 bp, Homo sapiens
  misc_feature (4964)..(4965): n is a, c, g, or t
  misc_feature (4971)..(4971): n is a, c, g, or t
gacagctcagatgaagtgattctgaagcccactggaaatcaactgaccgtggaattcctggaagaaaatagcttcagtgtgcccatcctggtcctgaagaaggatgggttgggcatgacgctgccctcgccatcattcactgtgagggatgttgaacactatgttggttctgacaaagagattgatgtgattgatgtgacccgccaggctgactgcaagatgaagcttggtgattttgtgaaatactattacagcgggaagagggagaaagtcctcaatgtcattagtttggaattctctgataccagactttctaaccttgtggagacaccgaagattgttcgaaagctgtcatgggtcgaaaacttgtggccagaggaatgtgtctttgagagacccaatgtacagaagtactgcctcatgagtgtgcgagatagctatacagactttcacattgactttggtggcacctctgtctggtaccatgtactcaagggtgaaaagatcttctacctgatccgcccaacaaatgccaatctgactctctttgagtgctggagcagttcctctaatcagaatgagatgttctttggggaccaggtggacaagtgctacaagtgttccgtgaagcaaggacagacacttttcattcccacagggtggatccatgctgtgctgacgcctgtggactgccttgcctttggagggaacttcttacacagccttaacatcgagatgcagctcaaagcctatgagattgagaagcggctgagcacagcagacctcttcagattccccaactttgagaccatctgttggtatgtgggaaagcacatcctggacatctttcgcggtttgcgagagaacaggagacaccctgcctcctacctggtccatggtggcaaagccttgaacttggcctttagagcctggacaaggaaagaagctctgccagaccatgaggatgagatcccggagacagtgcgaaccgtacagctcattaaagatctggccagggagatccgcctggtggaagacatcttccaacagaacgttgggaagacgagcaatatctttgggctgcagaggatcttcccagccggctccattcccctaaccaggccagcccattccacttcagtgtccatgtccaggctgtcactgccctccaaaaatggttcaaagaagaaaggcctgaagcccaaggaactcttcaagaaggcagagcgaaagggcaaggagagttcagccttggggcctgctggccagttgagctataatctcatggacacatacagtcatcaggcactgaagacaggctctttccagaaagcaaagttcaacatcactggtgcctgcttgaatgactcagatgacgactcaccagacttggaccttgatggaaatgagagcccattggccctattgatgtctaacggcagtacgaaaagggtgaagagtttatccaaatctcggcgaaccaagatagcaaagaaggtagacaaggctaggctgatggcagaacaggtgatggaagacgaatttgacttggattcagatgatgagctgcagattgacgagagattgggaaaggagaaggcgaccctgataataagaccaaaatttccccggaaattgccccgtgcgaagccttgctctgaccccaaccgagttcgtgaaccaggagaagttgagtttgacattgaggaggactatacaacagatgaggacatggtggaaggggttgaaggcaagcttgggaatggtagtggcgctggtggcattcttgatctgctcaaggccagcagcgaggccccagcttctcccagcactcaggaggccatccagggcatgctgtgcatggccaacctgcagtcctcatcgtcctcaccggctacctctagcctgcaggcctggtggactgggggacaggatcgaagcagtgggagctccagcagtgggctgggcacagtgtctaacagtcctgcttcccagcgcaccccagggaagcggcccatcaagcggccagcatactggagaaccgagagcgaggaggaggaggagaacgccagtctggatgaacaggacagcttgggagcgtgcttcaaggatgcagagtatatctatccttcactggagtctgatgatgatgaccctgctttgaaatctcgacccaagaaaaagaagaattcagatgatgctccatggagtcctaaagcccgcgtgaccccaactctgccgaagcaggaccgtcctgtgcgtgaggggacccgggtagcctctattgagacaggtttggctgcagcagctgcaaagctggcccagcaggagctacagaaggcccaaaagaagaaatatatcaagaagaagcctttgctgaaggaggtagaacagcctcgccctcaagactccaatctcagtctgacagtaccagcccccactgtggctgccacaccacaacttgtcacctcctcctcacccctgcctcctcctgagcctaaacaagaggccctgtcaggaagtctcgctgaccatgagtacaccgctcgtcccaatgcctttggcatggcccaggcaaaccgcagcaccacacctatggcccccggtgtcttcttgacccagcggcgcccttcagttggctcccagagcaatcaggcaggacaaggaaagcgtcccaaaaagggcctggccacagcaaagcagagactcggccgtatcctgaaaatccacagaaatggcaaactacttctgtgagccctcctgtgtcccacccctcacccctttacccccattgccttctccattgtcaactcttggggcactcctggatcctatctgccctggacaaggtgctgaggtgcattgtcctgctttcttgggacttaccaaaggcacggacccctccaccgactccttctagttcccttccccactttcactagagcatcctgcctgccttctccactgaggagcaggtaaatgggagaggtttccagctgactagaaccctcttttctactcgtccaaaccactcccgtcacctgccttgtctgttctttattcttcatcccccgctagagctggaaggcaggatgaggagaggtatgaaggagcctgagccatgaagtgggaagcccagtgcttgacactttctgcaactctagccctatatccagaagcctgcccacctccacccattctgtttgccccatttccccagtccagtggacatgccccacctccagacttgctcatgggagaaggctgtggtctctgccccctcttgccaaatgcttcatggaaatgaagaggaaggcctagagcctccttcctgccccactgtgggccatttccagaagtggcctagaaatgccaacttcacttacctttcaaaagaaaggtgattcctatcacttgtcaaggtagggagaggtcagatgcccaagcctttgaccacggttttgtagcctgttggaggaagctacttttagctggctacacatgaggccacttgttttagggtgagctccagggatttgcctggattttgaaatcatgtagaacattatccacgtggctgtggctgtggctgtggctgggccctggcaggtggaaaaccatctcccagaaacctgaaagcacctgccaatgacgcagataaccctggccctacagcctgcttgctccgcctataccacagagcacagcctggacattatggagggtgtggcgggacggcccacacctgggtcctccatcgggaacttttcatgcttctttctccacctgaggtcttggtctgaagaagacctcaggactcacatcttcactcctgggcctttgcacttccagacgacaggtcatcgttcaagcagaatgcagacaggccattcacgagcccaagttgaagagaagagacgcccatccgtgaaggagcagaccatccatccgatcctccccttcccctgtccttccttcgtggattgtctccattgtccagacagtgcccccacctcccaccgccttgcctcactggcaatctggactcgatggagaacatccccccacctccatttggcactacccaagtggagtgtacccttgccctttccacctgtaccacccactccaacctcaccccagcttgcccaatgcttctggggaatttaatagctaccatgcaggccacagggaatttgtgaggcttcttttgtcatctttgtatctccagtttgtctttcttttctccatagccctgcctctactttccttccttggaatcaggggttcctttagcccatttgctttctctaccttggggaccccaggggccaagcagttctccatctagtcacaccaaaggcaaaaagcctggctacctcccccctagcacgtgagtccctactcccctcccctctgtttctgcccagctttgcttattttggggatttcaaggcagcagagggtagtgaggggagagcaggagaagcctctgtcctgtataggcaactgcctgactatgcggtgactgctgtaaccaagatcaggtccccagcccttttgtccattaacaccccttcttgatctttcaaaggcagctaattgctagcaaatccccccgattccggccttttccctctatttctttgttagaagttttctgtggagctgaaacccagcctctgtttgactgggtttcatttagcttagttgggttcttagagccccctgtttgttgttttgtgttgtttccaatgaaaagcaagtttaccctcagagttatgcttttccaaagaggctgatgtctttgtttttgttttttttaatgtttcaggttctaagtgaagtgagttggggaggggttgggagtgttagtaatcaaggtttagaacaccatgagatagttacccctgattcctttgcccgacccaaaggggtttttccccacccccccttaaaaaggnnccttgnctccagtccctagctgggggctggacagggggaagggagagaggatttctattcacctttaatatatttttacaaaaaaagcaaacaatttaaaaacaagcccaccgcttctgtacatgtctaaatatatttttagaagtgggtaggattgtgaatttctgatgcagggcctttttataaataggttagggtagcatcattcagacttctctgttgtttttgtccctgtctttttcttatgttgtgttactaatgtaatttatattttttttagatcctccctttcctatagagataaaagtgatttatcttggcaaaatcctaattaaaa

SEQ ID NO: 498367 - DNA, 364 bp, Homo sapiens
atctagcagatctcgcgtcgaccttctgctctgtgatcagtgggggtatggggggacagtatagcagaaggcctggctcaggtggttttgacagtgaactgaaccagtgaaaccagagggaacttgcatcgtgattcccatgggagtcccagacaggtaacggctgagtctcctacttctacagttcaacatcactggtgcctgcttgaatgactcagatgacgactcaccagacttggaccttgatggaaatgagagcccattggccctattgatgtctaacggcaggtgaggtgggaaggaggagcacagaggtactgggactgtcagtggtaatatgccctgagaacaaggtagagccgag

SEQ ID NO: 498368 - DNA, 121 bp, Homo sapiens
tggggtgatctagaggatcccggtattattgtttgaggttagttggattagtcatgtggggtggtgattagtcggttgtgatgagatatgtggaggtggggtgtgtgcgtgtgatatgtag

SEQ ID NO: 498369 - DNA, 133 bp, Homo sapiens
aggggcacatacccttgcatctaccgggtcttgcattgtacctgggatcaaacaaccccctaggaatcacctcccattccgataaaatcaccttccacccgtacatgcacgcccggtacccggtacatgcaag

SEQ ID NO: 498370 - DNA, 230 bp, Homo sapiens
agaggatccccgaatagtgaataggtaggtaatttagaatatacagtcagaggagaaaaagagaatgagaaggaataaagaaaactatataagattgctagggtgtagtggctcatacctgtaatcccagcacttatgggaggccgaggacgagagtaatcactctgagcccagagagtttagagactagcctaggacaacagaagtgagacccatgccctactacaaaa

SEQ ID NO: 498371 - DNA, 133 bp, Homo sapiens
ctagagcatcctcttattggttcttctactattagtgactttcgcttcgaagcgaaagtcctaatagtagaaaacttcaataaactggagtgactatatggatgccccaccctacgtatcgaagaaacaatag

SEQ ID NO: 498372 - DNA, 150 bp, Homo sapiens
taatcacggatcccccggccgcacagcttcgtctaaataatacgcagaatttagccacggcatgatggctacacatctgtaatcccaggcattactgtggaagtgcttgaggcacaagaatcgcgtgtacccaagaaggtgtggcggccg

SEQ ID NO: 498373 - DNA, 1001 bp, Homo sapiens
  misc_feature (295)..(295): n is a, c, g, or t
tgcccacaaaaaagggggttgggggaaaggggggcccaaaaccccccccggggggttttttggttcaccaaaaaaaaaaaaattccccaaaaaaaaaaaagaggggggacggcgcacataaagatcaccaggaggggggacaaacgttactgcgggcaacccagatttattaattacaaagggggcacccaacgagggcggatcgttcaacacaccaagccgagcggacagcgcaataaaaaggaatgtgaggagagaaaagagtgacgatagggacactcgtgaagagaacacnaatcacagtcggggggggacaaacatgatgcacacaccacacacgaaagaacatatcaacgcccgcacgcaggcataaccaacaacaaagtagacgcgggtagtaagaggtggacacaacgcacgcagcaaacagagagagaggcagagcaaaaaaatgaggacacgagagagcaagaacatacagcaagagaacaacactcaatatcacccgagaggacgtgatagagattaataaaaagggagaacagaaacagacagcgactaagaagaacgacgagaaagaacgaacagatagctagagagcacaactaacagcagaagaagaagaaacaacgacgaggaagccacagcaagaaaagaaaagacgaaagcacaaggagcaggcacataaggacatacgacatgaggaaaaaggaaggcaaagaaagcgagaaagacagacgagggggagggagggaagaaaaagacgcaagagagcagacaaagagcaaagagcacgaaagaggtaggaagaagaatagaaaggaaaggagagaggacggagaaacgagaagagacaacagaagtgacagacagaaagagaggacgaggagaaacaagaacaagagaagagaagactaaaagaagccaccagaacagaaagcaagcaacaacaggcaaagcaataagaagatcagaagaaagtaagagacaaagcaggaaaa

SEQ ID NO: 498374 - DNA, 143 bp, Homo sapiens
tcccgggggcgggggggtttttcccccccccccccccaggggggttaaaggtggggggttttgtggcccttccaaaaaaaaatttgtttataaatataaaaagttaaaatcaagaaaaaatcattaaaataaatttaaagtta

SEQ ID NO: 498375 - DNA, 974 bp, Homo sapiens
  misc_feature (166)..(166): n is a, c, g, or t
  misc_feature (185)..(185): n is a, c, g, or t
  misc_feature (188)..(188): n is a, c, g, or t
  misc_feature (207)..(207): n is a, c, g, or t
  misc_feature (223)..(223): n is a, c, g, or t
  misc_feature (242)..(242): n is a, c, g, or t
  misc_feature (248)..(248): n is a, c, g, or t
  misc_feature (255)..(256): n is a, c, g, or t
  misc_feature (261)..(261): n is a, c, g, or t
  misc_feature (263)..(263): n is a, c, g, or t
  misc_feature (271)..(271): n is a, c, g, or t
gacttccggtcgctattcggtctactacagcggccggtttctagcgtacctgctgccgcaggttccaccgcgctccaggtatttttttttctgaaggaaagctgcttcctcatatgtttcaagaatggctctcctatcattgtaaaatggggtggacaggagtatncagtgaccacactttcagnagntgatactgtgctcgatctnaaacagtttctcaagnccttacaggagttcttccngaacgncaaaagnnacttngnctcaaagntaaaggcaaaccttgccagacacactgatgtcaacgcttggagctctcaaactgaaaccaaatactcaacactcatgatgactgggaactcgtgaggaagagcttggcacgcatgtctcacggtccaccaccctgaccactgcatgatgtccgccacatggaccttcgatatggaagactgaacgtcacgtccgaacttctacacatacgcggaacgacacacctacctggcacattcctcgcagaagtcgccgacataccaacgtggcacactttcgcacatccctcccacggccaaaggcgcaacgaagccacacggctggcctagcaatggtcgaccaataaccattcaatcaggaaccaccagggcactacgcccccgacaccactgccgctcacacaccctgcgccccaaaattggcctggacacagttcctcaagacatccggcccgtagtgcgcagcactcctgcacccgcggccaaacgcggccccgcaacccaaactatctaccactcgcacctggtcaaccaacaagtcgacacaccactcgcgcccgatcccccccaccagtgccccctcccaagaacacaccactcacgagacgcaaacagacgcgcacagataaacaggccaaacgcccagcagaagcgctacacacccgaccgccgcgcacgacagacgaaagcgactcgcgcacacac

SEQ ID NO: 498376 - DNA, 123 bp, Homo sapiens
tgtccaaacagtattgcaccgtagtcatcacaggagacgcaaagaggtcctagatatcccccttttggaatgtgagagacttgttgtctgatatttgccactccgctggtgatagcccgtggc

SEQ ID NO: 498377 - DNA, 369 bp, Homo sapiens
tttgaacccctggggaaaactcttggtttggattaaacccctttgtctacccagggaaaacctcccctttggttttgggcgggcccatttctttcagaaagttttttgattccccccgggtttaggattctggggaaagggggagggggctgggggggggttttgttgggtcccaaaaagttatccccttttaagcggggccccaagaccccgtaggggcttttttactatattggaccttttttcccttgcccttggccccttggataggttcgaggcccgatttgatttttagccgcccccaggtggttttaatgattttttgcttcccgggaaacttttttaaaaaaaaggttgttttttttctta

SEQ ID NO: 498378 - DNA, 632 bp, Homo sapiens
ctctttcctgcccagagctttaatgatgggggggcccttttttttggggcccttttaaaaacccaagggcccccgttgggggggccccccccccctgggggcacaggaaaacaaaaactccccccctccttggtgggcctaaagccaacttattttttcttggactgggattaaacccaaggttggtgcctccccccccccccaggaaacaagtttttagcacattttcctgggtttgcccttgcaaaacaacccccccctttttgtttttggggggaagggttatggcccccccgggttttccaaacacctctgcccttatttacctggggttatttgtgggcggataaaagagggggggattttaacaccccgggggcgtttatttttttttttttattaaaaataaagttccgggggggctccccacaataaaataacattttttttccaaaaaaaccaccccctcttttttaagcaaaaaaatttgttgcttgcgatttccctcattaattggcgggtggctcctccccctctgaaataaaaaaagacccccacaaagcgggtttatatacttttctctgggcgccatctccaacactcttctatagaagagaatatattggggcccg

SEQ ID NO: 498379 - DNA, 428 bp, Homo sapiens
  misc_feature (50)..(50): n is a, c, g, or t
  misc_feature (61)..(61): n is a, c, g, or t
agtagctctgcagtcccagtgcttgtgatcatattcaggtatcatctatnggatcacttgntaaccagttgagaatatgctacttgagccagccttccttataggaagctaacgctatctatttatcctgatggtagctgctaagcacaagcaggacaacaaaaaaatctcaaaactctcagaagttacataagcgtctcaccaaagttatctgtggtttgggcttgtgagcgttctcataccaaaataccaaagaccagggggcttaaacaacagaaattggtttcctcacagttctggaggctaggcgtccacgttcaaggtgttggcagagtgggtttcttctgaaaaccccttttgggttgaagaagtctaccttctccgagggtcctccatcggacactggtgtctctctctatatgtcccaa

SEQ ID NO: 498380 - DNA, 115 bp, Homo sapiens
accgataacaatctccgaccttacttactcaccttgagcatccggatgacacatgatctccatctcctcaacacagacaggatcactggtctctggcttccctctccctgacttt

SEQ ID NO: 498381 - DNA, 1064 bp, Homo sapiens
ctggcgcaatagatatagtaccgcaggggaaccgatgaaaaattataatccaagcataatatagcaagggactaatgcgctcgtagtaccgttcgtagcatagatgaagttaacctagaaataacctttgcagatggacgagccaagagcgtaagagcccctgaaaccaggacgagcataccgtaatgaagcagctgaaaagatgcgacacccgtcatatggtagcagaatagctgggaaggatagagtagagtaagaggccgacaaagctagtcgagccgtggtgatagcttggtcgtccaaggatagaatacttagttgcgaacctgttatacatttggcctcgacgaagaacccgtctaatatgcccccgttaaatttacagctggttagtccaataggaggacacaggtcgtttggacacttaggaaagagaacccgttgttaggagacgagtacacatatatttaatcacccaatagtagggccgtaggaagcagccaccaagtataacgaaagcgttcaaggctcaaacactccagtagctaaaagatccgcaatacatagtaagctgaactccgtcgacaaccgaagtttggaccacttctatgcaacctatagaagaaccgtaatgtaagtatagagtaacagtgaacaacagttctcctccgcattaagcctgcgtcagattaaacaccgagtgaacgtgacaagtaacaggccctatatctacaatcaagcaaggagtcattattagcctcagtgttaagccaagagaggcattgctcataaggaaggtaaaaaagtaagaggaattgggaaatattacccgcatgtgagcaaaaattgctgtaggatcacaagtattagagggacagctggcagtggaaccctgttcaggggcggggtacccaagcgtgcaaggtagatattcacttgttcctaagtaggactgattgaatggcccagagagtaagagatataattaacacgtatggactgcgtaaagggcttaccgggaagaaacctatgatattatacaaagacaaaaccaggtaaacaat

SEQ ID NO: 498382 - DNA, 912 bp, Homo sapiens
acagcgtctctggaccgccgggagcgtgacgtagcgtgcagcgcgaccataggtggcaccgtagcgctccagtgccctcgcccagaggtgtgtctcgccgcaatggtgcagacaaggcagcgcgattgtgcacgcccccgggagaaggcaattgacccgcggaaatatctcgacagggggtgcataaccctatagcgcgaaatccgcaggggtccccccccactaaagagtctggcggcagaaccaaagaagtgggtgccacggcggcaaaaccccacgagggcccctgaaacacgctggttccggcggaacacgcgcccccgttcatggcgcggtaccaccaccagcggcccccccgagagggggcttagtgtgcgcccctcgcccccaccgcgcgtcgtagactcccccgccaatggcgccccgggggtgggggacccccaaccggcgcgcaaatgctcatagcctgggaccgccgcgcccccacccatagagtggggtgatcccccacgccgcccgcggttgtcgcccccctgcgtctttcgaagaggaaaaagtgaagaaggcgcggcttgccgcacaaaaaacggcggtcgatctaatctagcgggtccatatccaccacgagcagtatcttgtagcacccactgggcgatccccggaatgcgcctcgggccgcgcctgacattgagtgggcaatcttcttctgcccagagagaaggagcagacttcttcttgcaattctgtgaacacatttttaagatttgtgtattgactagagcacaaatgaaggcacccggcgtgtcacccaaaaaacaaatagtggaccgcagagtgagtcataatcacagaaaatagagtgcgatcatccacgtgctctcccaataataaaaattttaaaaccacaaaaac

SEQ ID NO: 498383 - DNA, 346 bp, Homo sapiens
  misc_feature (25)..(25): n is a, c, g, or t
  misc_feature (71)..(71): n is a, c, g, or t
  misc_feature (103)..(103): n is a, c, g, or t
  misc_feature (122)..(122): n is a, c, g, or t
  misc_feature (144)..(144): n is a, c, g, or t
aactgcctaaataggccagccgcgncggttcaggcctgtaaacccagcactttgggaggccgcccgtgggncgctcacttgaccgccaggagttcaagaccanccctggccaacatggtganaccttgtctctactaaaaatanaaaaattagccggctatggtggtgggcacctgtagtcccagctactcgagaggctaaggcaggagaatcatctgaacccgggaggcggaggttgcagtgcgttgagatcacgccactgcactccagcctgggcaacagagcgaaactatgtctcaaaaaaaaaaaactggcctaaataacctgttcacttttcttcaggcag

SEQ ID NO: 498384 - DNA, 604 bp, Homo sapiens
  misc_feature (20)..(20): n is a, c, g, or t
  misc_feature (97)..(97): n is a, c, g, or t
  misc_feature (100)..(100): n is a, c, g, or t
  misc_feature (173)..(173): n is a, c, g, or t
  misc_feature (177)..(177): n is a, c, g, or t
  misc_feature (179)..(179): n is a, c, g, or t
  misc_feature (200)..(200): n is a, c, g, or t
  misc_feature (221)..(221): n is a, c, g, or t
  misc_feature (230)..(230): n is a, c, g, or t
  misc_feature (250)..(250): n is a, c, g, or t
  misc_feature (277)..(277): n is a, c, g, or t
  misc_feature (399)..(399): n is a, c, g, or t
  misc_feature (445)..(445): n is a, c, g, or t
  misc_feature (475)..(475): n is a, c, g, or t
  misc_feature (512)..(512): n is a, c, g, or t
  misc_feature (515)..(515): n is a, c, g, or t
  misc_feature (518)..(518): n is a, c, g, or t
  misc_feature (540)..(540): n is a, c, g, or t
  misc_feature (542)..(542): n is a, c, g, or t
  misc_feature (568)..(568): n is a, c, g, or t
  misc_feature (573)..(573): n is a, c, g, or t
  misc_feature (577)..(577): n is a, c, g, or t
  misc_feature (591)..(591): n is a, c, g, or t
gttgttctttatagagctcntaacatatattttttgcagcaggttccatagttatgaaggggatgccgtggagctctgttttgttttttgtggtggnatngtcttcttgtgaagagcacagggtgctccattgacttcactggctccatccattttcttgggcctgagctgtngttntntgttagtttattccataagcntgagttcctgctgctcctttngtgctcttntaaggggaagcttatagttnttctgtttttttattaaaatgttcatnttcttatccatatttttttgcattttctttataatttccacaaattcgtgaagtttattaaaatccttgttcattagatcctttatctgttttatcttctccattttctccttgagctcttntctgagttgcctgagtacattctttaggtcctgtgttactcctgcnttggtaaaccgcccttcttgtttaactgcnttgtaatcaaatgttttggtcggctctggcttgaatnccnggnaaactgccttgtagttcttgcncngatgtgtattcttcaattctgccctnttggncganatgatggaggaggncagggtgttcttc

SEQ ID NO: 498385 - DNA, 173 bp, Homo sapiens
tttaaagtgccaagggtgatcgagtttatatcctgttcaacacctttaagccttttatgctatgtctattagcttgatttaggatcttgaaatttcataaatggtattttaattatgatgatcataatgcgtcccctgctataggaccacatgatattatatgtttacatttc

SEQ ID NO: 498386 - DNA, 506 bp, Homo sapiens
  misc_feature (101)..(101): n is a, c, g, or t
  misc_feature (134)..(134): n is a, c, g, or t
  misc_feature (307)..(307): n is a, c, g, or t
  misc_feature (350)..(350): n is a, c, g, or t
  misc_feature (355)..(355): n is a, c, g, or t
  misc_feature (366)..(366): n is a, c, g, or t
aagttgtgccacccacagcacaaaaaaagtgactagaaacctggttttggggtttttctgcccattgtcacaaaatttcattctttttcatgatttccatnataccaattctacctatagtgtcagaggctccntggacaccctgaaagagagctctcttctgagtgggctaacgtacagggctacagggccaagctgagaagctctggcattgaaagaaaaataaaacgtgacagccgattgacgaaaaaataaaacctcatttctgaagccagatataactggccaagaaagctgcttgggtgancctggtcccccacctgatcagggccactccctcatctgtcctnctcanggcatcgctgnggtgtccagacaggtccccgtaatgtgccgggtgtccccagctgatgggccacctcagccttcccaacgctccccgagcaccacagatcgccttcactacggccccagcacggccgtactgaggttccatcgcggggatc

SEQ ID NO: 498387 - DNA, 198 bp, Homo sapiens
accacagcggggtggtggaatacttacaccctcttgacagcgagaaacagaaaagagggcggcacctgcagggactgtgtgggcagtcctgcaaaaccaacatgccatggttgatgtgagccttcattccccaggttgccactattgggctcacgtgtggagggttcatggtagccttgtcccccgttgcttgtatct

SEQ ID NO: 498388 - DNA, 474 bp, Homo sapiens
ctgaaatgagccatagttcccctgtagattacccacatgaaaaaatcgtggtccatcctgacagtattataccgagtacatattcgaatgcaagaacatatcattcactagaatataaatggcaaacatatggtcaacatcaagtccttgtatagttcctaaaccgtttaagggaactatattcttttattcatcctatataataaataaattattatatttttatttttatcagtaaccctactaggaggcaaagttagcacatatttggttcctaagcgctagccgacatttatgcagaaggttctctattttggggggcatcttcaagagttcacagatcacatggcaaagttcaaggttgtgtcaggaagtaggagccgtgacttctgactcttaggattgatgaaccttccacgttttgatttttccaaatggcatgttagtgtatctgggagaagattaggatgtgtg

SEQ ID NO: 498389 - DNA, 925 bp, Homo sapiens
cgcttcttctgttgggcgccggtctctgggccccttccccaccatgggcgtccgggtaaagcgcttttcttcccaggatgggccccctttctcgcagtgctttccttggccacaccccttggggatttccccccgccgcggtctatgcagagctcagggccctataggctctattgccctctcggtcccagagaccacggttgtgcaacaagcgttctggttaggcgcccaaatttgtctacgccggcgtcttgtcgttcccgcggctttggatataaagccacctggctttcagagcggggcactctgccttttttctcacgggggttctccggacaccctaatcgctgggttattttccccggggccaccacttcgccacccgcagggtcctctctctttctgagtccaataataatcaggagggccagtgtgagttccccggccgctcaagggcaaggcacacccacggggggattctattctcctgcgcgtttgagcagggaaaaagcagagtcgttcaaggcagggagcctcttccaccacagaacaatgagggggacatcaggcacacgcacttgttagaaccgccccctcaggagagcttgggactactacgacttacacccgttggatgcgattttattgatgtttccaccagcggtttgcctagcacaccaagtccccaccactctctcgcacacggcacgcaaagcagctgctctaatgcccctcctccgcacataaagacaattctctcgtcctccgtaccccggacctcacatatgagtcatccgcgcatcaaaaccccgagtgttttgtctttttcgagccccattctagacccccagtttcacaatccatttttttatgatggaacaaataaggtgaaaaaaaataccacccctaaacgcccacaaaaaca

SEQ ID NO: 498390 - DNA, 819 bp, Homo sapiens
agatactcggcagtgctgacgtagttattactgttatattttactctcaatagaggcttatttatttatttatttattttattatactttaagttttagggtacatgtgcacattgtgcaggttagttacatatgtatacatgtgccatgctggtgcgcaaggcaatttacagattcaatgccatccccatcaagctaccaatgactttcttcacagaattggaaaaaactactttaaagttcatatggaaccaaaaaagagtccgcatcgccaaggcaatcctaagccaaaagaacaaaagcttggaggcttcacatctacctgacttcaaactatactataaggctacagtaaccaaaagagcatggtactggtaccaaaacagagatatagatcaatggaacagaacagagccctcagaaataactctgcatatctacaactatctgatcttcgacaaagctgagaaaaacaagcaatggggaaaggattccctatttaataaatggtgctgggaaaactggctagccatatgtagaaagctgaaactggatcccttccttacacattatacaagaaatcaattcaagatggattaaagacttaaatgttagacctaaaaccataaaaaccctaagaaggaaaacctaaggcatcaccattcaggacataggcatgggtaaggacttcatgtccaaaacaccaaaagcaatggcaacaaaagacaaaattgacaaatgggatctattacactaaggacttctgcccagcaaaagaaactaccatcggagtgaacggcaacctacaaatgggagaca

SEQ ID NO: 498391 - DNA, 551 bp, Homo sapiens
gcggaggtcaatgtgtggctccacagagtgtgaataaagagcagctactgtgctgagcgcggtggctcacgcctgtaatcccagcactttcggaggctggggcgggcagatcatagggtcaggagatcaagaccatcctgactaacacggtaaagccccatctctactaaaaatacaaaaaattggccaggtgtggtgacaggtgcctgtagacccaggttacttaggagggtgaggcaggagaatcgcttgaacccgggaggcagagattttggttagcctagatcacgccattgcagcccagcctggacaacaagagccaaaactctgtctccaaaaaaaaaagtggattttggatcttgaagaggtacttatacacttatgttcattacagctttattagcaatagccaaaaggtggacgcaagctaaatgtccattgagggatacatcgaggaagaaaatgtggtctctacacataacgcaatattattccatcttaaaaaagaaagaaatcctgtcctatgctacaatatcaatgagcctgaagat

SEQ ID NO: 498392 - DNA, 279 bp, Homo sapiens
  misc_feature (29)..(29): n is a, c, g, or t
  misc_feature (32)..(32): n is a, c, g, or t
  misc_feature (160)..(160): n is a, c, g, or t
  misc_feature (187)..(187): n is a, c, g, or t
  misc_feature (230)..(230): n is a, c, g, or t
  misc_feature (271)..(271): n is a, c, g, or t
cggccaggaggaacagaacaaaagcgagnagngaggacgtatggaaaacttctgggcggaaacctctccttatctcactggcccatcccagcctcggccaacttcaaagttaaaagaaggtgggatgatgacgttgtcttcaagaactgtgcaaaaggtntagatgaccagaagaaagacaaaagantaaatgacacactgcgatctgaatttcacaaaaagtccatggngaaatatattaaatagtacagatgtgcttaattaaagactntaaaacgc

SEQ ID NO: 498393 - DNA, 89 bp, Homo sapiens
  misc_feature (52)..(52): n is a, c, g, or t
gtcttttattgcagcatttgaatatcaccaatggaggtcttaagtgtcatgntggcatcatctttctgtagttaggtagctcttagatc

SEQ ID NO: 498394 - DNA, 312 bp, Homo sapiens
cattgctcccatcagatatgtcaggccttttattacctagaggaagggaacgtaaaagaaaagaaaatactggcaaacgaatccagcagcacatcaaaaagcttatccaccatgatcaagtgggcttcatccctgggatgcaaggctggttcaatatacgcaaatcaataaatgtaatccagcatataaacagagccaaagacgaaaaccacatgattatctcaatagatgcagaaaaagcctttgacaaaattcaacaacccttcatgctaaaaactctcaataaattaggtactgatgggacgaagatgg

SEQ ID NO: 498395 - DNA, 271 bp, Homo sapiens
tgggggggggggggccccccgggggcccccccccccccccgggggggggggggtttttttccccccccgggggggggggggccgggggggtggtttcgccccccccccccccccgtgggggccccgcaggccccccccccttttttaaaaaaaaaaaaaaaaaaaatttttttttgggggggggccccccccccggggggggtgggggggttttctgggggggttttttttaaattttttttttgggggggaaaaaagctttcttttttta

SEQ ID NO: 498396 - DNA, 306 bp, Homo sapiens
gtcgaccgcaggtcacccagggtagaaccatcaggcatggaacttcggatccttcgagccagtctcgccggagtaggacataccgcacttgggactgcgcatcgcgacctcaccgacctcaacgccgtccttggcggcagctcgtcgggctcagcgatacggtcgtcaaaaaccttgaccacctcgacgtcgtcatcagtgctggcccgaccagctgtaccagccattcccggcagatcgaagggacgcaggaaggtgttccagaaggtctcagtggtgccgtacccgttcgagatattgggggtg

SEQ ID NO: 498397 - DNA, 549 bp, Homo sapiens
  misc_feature (192)..(192): n is a, c, g, or t
tagaggatactccggagtgcaatggctaggtcatggttagtgcagtctccacctcctgtgctcaagcaatcctcccatctcagcctcgcaagtagctgagacgacaggcacatgccacacaccaactaattttttaactttttgtagagatggggttttgctgtattggccagggtggtctccaatgcctgngctcaagcagtcctcctgtctcatcctcctagaatgcagggttacaggcatgagccaccatgcccatccttgggattggctttttcaatcagcataacttctggggctccatccatgtttttgcatgtatcaatagttcatttttattgctgagtagtcttccatgccgtggatgtaccacagtttgtttaaccattcatctgttgaaggacatctgcattttttttttcttgtttttgactactattgagaagctgttataagcatttatgaacaggtttttcttttcttttttttttggagatggagtcttgctcttgtcccccaggctggattgcatctcagctcactggacct

SEQ ID NO: 498398 - DNA, 194 bp, Homo sapiens
atccccatagcaaaagcacatccccttcccgggtccagcagaggtcggggcactgcacccatcgggggtcaggtccgtgtctccaagcagcaaagaatctccacatcccccatcaggtcggttaggtctccatggctcatgcgtaagcatcaggcatccagcgtggccacaggtcctgaagtgcctcccccttg

SEQ ID NO: 498399 - DNA, 132 bp, Homo sapiens
agatccgcgtgtacgactgcatctgtgctccaggtcatgcgattctgcgctcagcctcctgagtagctaggacgacaggcccaccacaccccgctaattttttggtagttttagtagaggcacagatgcagt

SEQ ID NO: 498400 - DNA, 1608 bp, Homo sapiens
  misc_feature (1608)..(1608): n is a, c, g, or t
ggagagagagagagaactagtctcgagtttatattttttttttttccaggcggccggaaaaatgggggactttcacacggagccgtgccacacaaaaagcgagccgcaccatactattaccaaacacaaaaacagaagggcccgtgcaggggacaaaacacgtggcaaggcagaaagctcccaggggaacaaacacaagaaacatcggaccagtgggctacaaaacaacccacaagaggaggtatattgtgaggcgcaccatacattgtgaccaaacaatagtgcctcctattacacagtgtgaataacgaggtgttccaattctcacacgggaggagaactccctcttcagtgggcgagatggagagaccacaagaaaatagaaaagatgacacagagagcacacacgtgtggtacaactcccggcgcgaagagcaacataaaacgagagccaaataacatatccgcggccacgagggtacacagcgcgcgggcttaacgaaagagagaacggggcccacaccaagagcagcacccaaagtgacagcagaagagaagacaccaccagtagaaacccccgccaccgtgagacacacgacggggagacccagagtacaaccaaaaaaaatactgagagaagagacaacacaatccagacatacacacacaagaggtagatgacgacagaaaaaaagcccgcgcagaggacacaatgcagaagagaaggcgccgcaacggggaccacaaggagtggacaaagcaatcctacaacacggaagatgatgagcacaacaaaagcggaggagaacaacacacacccaaaagagtagatcgctggccgcagtgaggcacacacacagaatgaaaaaagagaagcagtagtcaccaacaaaaaacaaaagaacaaacccgtcggagcaggggcgtgtgacggacagcccaacacaggaggaggacacaccagcgacaagtgcccgcacccacaaagaaagaaaaaggagcagacgaaccaagaatcacacagacacggagcgctaacaatctgatacaaacacgccctaccacaatcccacacacgacagaacagacaacaaccacaccaaccacacacagcacaaaaaaaaacacaaaagcacagcagacaagaaagacgaacaacaacaccaaaagaaaccagacaacaggacgaggcgacaggaaggaagcaagacaggaaaccaaaacaccaagcaaacgacagaaaggacgaccacaacgactgaacacaaacgtgccggccaacacatacaggtgagagacacagctacaacaacaaccagagagagaggagcagccagacagaaccacgcaccaaccagggaagaagaactagatggagtgagtataacacaaccaagaggagggggtgaaaaacaaaccactcacatacgagacaggcaggaggatcgaccgcacacgataaatgaaacgaacaggagaccaagcagcgcgacgaaagaaaaagcaagagatacgaaggagaagacaaaagaacgcaccgcaaggaggaaaatcaccgcccggaggacacaacatcaaggagcaccgacacgaataggaaaacaaaan

SEQ ID NO: 498401 - DNA, 1069 bp, Homo sapiens
ggacgcgtgggtcgacccacgcgctcgcggtacgcgtgggtgaagggatcaacgcgattgtggttgaaacaacatttagttcacaatccagtcagactctggcaacttttaggcgctggtactttctatttctaacacctcaaggttgaagcagaacgaataacgcgagaaggataagttcgaacggggcaaggcgcctgcaacgaggacgaagaggacgaggaccacgccgtgagcgggacgtacagaatgtaccgagcagcggctgcgcaccttgctggtcatcgcggttgtcatgagccctcctgaatgctctcagcaccagcggaggcagcatttcctggaacgacttctgtccacgacgatgctggccaaggcgcgcaggtgcagcgcgctcagcgtggtgcctgcagcagccgacgctggtcggaagatttaccttgcaaccccatggaacacctgctgagtagttatgaaagcaggactcaggactacccctatgcactgtaacctgaattgcaagcgtctgcaaactacttcgcacccagctctctgcccctacgaaacgcctcccgcacgcacgccctgaactgcatgacgcctgaaatatcgcagggcgccaacggacccacgggactccccacctctcccctatacacaacgcctaccccaggcatatccacttagggcacaacaatgccccctgacatacctcgtagctgcgcggcacttgaaccgcgccccgtagggaggacactagaggctccatacaactagaagcagtaaatggacataaacccccacgtcacaaggaaacagccgaacttcaacctggcgaagactggacacgggtcgtgacttcaacactggccacacccaacaacccacaccacaaaaacacctcacccatccccattccaaacccccccctccacctcccagccatacctcaatccgccaacacacccccactccaccacattcaacacacaccatccaaccaactcacacctacaccttaatccctcaacaaccccccatctccacctccccaccgacacacctagat

SEQ ID NO: 498402 - DNA, 476 bp, Homo sapiens
gatataaacaataatatgggcgacatggctaattacttatttaaaatatattagtacttgtggatattgtaaagtcacagacgttgtgggtaagggaccctttatgctgtagatggggcgtatgaatcaggatatgggatggtttgtatattggggaggtaggaatgtactaataatagaggagttattgggtatgactatgctgtgaatttaacaaataagtaatgcacgctgggagtggctagatgcggaggggtaatgataatttgtattggggatagtttgagagtaaactaaatggagaacaaggggacggactgtgtatttactattacaagggccatgtatatattgtaacaccgtactgaattgacgaaatttgtaagaaacgggaaaactattagcggaagaattaattgctattactgaacatcgaataatttaatttgcagcgatgaatatgctgtgtgcgtgaa

SEQ ID NO: 498403 - DNA, 176 bp, Homo sapiens
cattggatgctggataaattgaccggcgtgtttgctcctcgtcatccaccggtccccacaagttgagagagtgtctccccctcatcattttcctgagggacagacttaaggatgccctagcagagagtgaaggaaaagaggtttgcattcagcggttcattaaaatcgatggcaag

SEQ ID NO: 498404 - DNA, 401 bp, Homo sapiens
atcttccagtcgcagcattttagggctggaattgcatcactttattaggctatggctttcggactaagtacgattgagactgtgaccattaaggctaacactgtattgcccaggctatacggcttatttacatgcaaaggtttatcacatacaagattgtagaatggactaacggatacatattgggctattgacatattatgacatgttcccacaaagctttgcattcgataggctgagttatgacgactgaactgctgggtcacagaagccgactatggcctatgtcattaatggtgtttcatgctaagtctggctgtagaaactttactattagaacttcgaatcaggcgagcttaaacatgacattactatcagtgtctagggcactatagtgttgc

SEQ ID NO: 498405 - DNA, 612 bp, Homo sapiens
agttatcatgttaaacttgaaacatgagaatgcttctcatggatgagcaaagaaagtggtttcttgagaaggatctacttctggtgaagatgccattaacaccgttgaaatgacaacaaaggactgaaaacactgcataaacttagttgatagagcagtggcagggtttgagaggattgcctctgattttgaaagaaattctattctagctgagatggcatcaaacagcatcacatgctatagaaaaatcgtttgagggccgggtgtggtgactcatgcctataatcccagcacttgagaggcccaagcgggcagatcacctgaggtcaggagttcgagaccagccatggtgaaaccctatcccagttacttggggaggctgaggccagagagtcgcttgaaccgggaggcgaaggatgcaggtgagctgagattgagccactgcgcttcagtctgggttggcagagtgagactcggtctcaagggggaaaaaaaaaatctctagcttagattgggctttatctttcttagaaatgctccatttaagggtctataactatgctggttaactgataatatagaaataatgagtgatatgtgtatcgtaaagta

SEQ ID NO: 498406 - DNA, 102 bp, Homo sapiens
aaagtggacaacacaacggtgggattacctgacccaggttgaaaaggagtgcaaagaacacgagaagccctcctatgacactgaaacagatcctagatgagg

SEQ ID NO: 498407 - DNA, 493 bp, Homo sapiens
  misc_feature (2)..(2): n is a, c, g, or t
  misc_feature (131)..(131): n is a, c, g, or t
  misc_feature (231)..(231): n is a, c, g, or t
anaaatggaaacttggcatcacttgctataaatagaaggtaaccctacagataaacacaatgaaaaccggagtgttagtaaattccacgtgtagcccattcagactggagatctgcacacaagagggcagntacagccagactagcgcctggctgggactgtcggggatgcggtttgtggtcacaggactgggagaggagtgaggtcctcaccgagtgattccatcttctnttttttttgagacagggtctctgtcacccaggctgggtgcaggggccagtcatagttcactgcagccttgaactgctgggctcacgcaatcctcctgcctcagccttccgggtagccgagactacactatgcctggctaatttttaaattttttatagttgaggacccggtctctacaaaaagtaggaaaaaaaaaatagcgaggtgttgtggtacaacgcccatagtcccagttactcggaaggctcaggcaggaggattg

SEQ ID NO: 498408 - DNA, 321 bp, Homo sapiens
  misc_feature (2)..(2): n is a, c, g, or t
  misc_feature (131)..(131): n is a, c, g, or t
  misc_feature (231)..(231): n is a, c, g, or t
anaaatggaaacttggcatcacttgctataaatagaaggtaaccctacagataaacacaatgaaaaccggagtgttagtaaattccacgtgtagcccattcagactggagatctgcacacaagagggcagntacagccagactagcgcctggctgggactgtcggggatgcggtttgtggtcacaggactgggagaggagtgaggtcctcaccgagtgattccatcttctnttttttttgagacagggtctatttgtgtctattttactgtatgggtgcttccccatctgtctcattatcctttacgattaaatggttaca

SEQ ID NO: 498409 - DNA, 207 bp, Homo sapiens
agcatacggaggtaatgttccagaatatgccagggtatgaaccaacaggcatatgcatatcctgctatggcagctgaactatgattggttatccaatgcaacaggatattcccaataagactttagaaagtatatgtaaatgtctgtttgtcataatggctctttatattgtgtgttatctgacaaggatagttatgtaggaaacat

SEQ ID NO: 498410 - DNA, 99 bp, Homo sapiens
cattggcagaccaaagcctgtgtgtgggcacaggaccccacccagtgcctgcagcacctctcagaaaaggtagctgatactcaccaagaatttagcgcc

SEQ ID NO: 498411 - DNA, 677 bp, Homo sapiens
tggaactctgaacttttaatgggcctccgggctccccaaagggtacccggcttctgcgggcttaaggcctcagaaacttgggggtcatgggtctcaaaacaccacttggccatccactatccgggcgggtgtgggggctctttgggatggttggcatggagtgtgctgctgtccagggcatcaccaagattaaagtcctcgccatcttccagcaggcggcggtagggtggcgactctcagcctccagctgtgaccttgatgttcagcagggcctcatactccgtgggcctgtggcgcgtgtccctcgtgcccgggttcgtggtgccagcttcgtgactcagagggtgcagcaggactcccgtttgagcgtgcctccatcgtggtagggcgtagggggcctccaccttccctcgaggcgtgttcctccaagcggggccttcagaattcctcagggagtccaggtcgatctccagggactgggactggtacgtctcagctctggtgagcgtcgtctcagcagttccaacctcagctagacggtgtggtgcccccgggggtgctctcctcaatcgggctgagaccagtactgtgtctagctcctctgggttcttccgagccagctcgtcatatggggcccggatgtttggcatgatctggggaggtcccgaatttggggc

SEQ ID NO: 498412 - DNA, 545 bp, Homo sapiens
aacctggtggcactgcaggtagctgggaggagatggaagccgggagggctggcgattggagggcaggcggttggagggctggctattggagggcaggcggttggagggctggcggttggagggctggcggttggagggcaggcggttggagggcaggcggttggctttctggtcttagtcactcccagtctgaagacaaggcagaggcctagtgattcccagattcgatatgtgtcagaatcacccagaaggcttggctgttagaggccagagtgctgcgttccccagagttcccgactaggcctgtctggtgtggggcccaagaatgcatttctgaaacagtccaggtctgccaagagcctccggtgcaggtcagaggctttctgggtccacctctcttagaagcagtttgaaaaaccgtatccctgcctggtatagtgcctcacgcctgtaatcccagcactttgggaggtcgaggtgggtggatcacgaggtcaggagttcaagaccagcctggccaacatggtgaaacaccatttatacta

SEQ ID NO: 498413 - DNA, 451 bp, Homo sapiens
  misc_feature (217)..(217): n is a, c, g, or t
tcggctcggcccaagttctcaacgcattctttttcttataccatcttccattatgtactatccaagaggttgcatacagttccctgtacagtaggacctcatttcttatccattttaaatgtaatagtttatatctaacaacccaaactccccgttgagaagcttaagcttctcaacgcttggtcttgtccattcttcacgaatttatttattcttngtctaaaaggtataggatcttctttgtctaaaaggtatagtttagggttttcattctcttgtgaaggctcctatatatatttaaaaatttggcaagatttgaatgctttttttcttggtcttgtccattcttcacgaatttatttattctttgtctaaaaggtataggatcttctttgtctaaaaggtatagttagggttttcattctcttgtgaaggctccgttgagaagctt

SEQ ID NO: 498414 - DNA, 220 bp, Homo sapiens
ccgctacggtccccgcgcagcgctcaatgacggaccattacattaataagaccggggtttcacatgttgcccaggctggtctcaaactcctgagctcaggccatctgcccgcctcggcctcccaaagtgctaggattacagaaggtgcctgcttccccttcaccttccaccatgattagtaagtttcctagaggcctccccagacatgtggaactaacag

SEQ ID NO: 498415 - DNA, 143 bp, Homo sapiens
  misc_feature (41)..(41): n is a, c, g, or t
tggctaacattgcctatcacttacaagctcgtcccgatttnccggcccttctttataatttgtctaaaaggtataggatcttctttgtctaaaaggtatagttagggttttcattctcttgtgaaggctccgttgagaagctt

SEQ ID NO: 498416 - DNA, 177 bp, Homo sapiens
cctcctcctattcttctcctcttcgtttcctattttttctcctcctctcctctttctccactcctttcttttctcctcctccttctcttctcctttcctcctcctctccttcacatcttcatctcctcctccttcttctgctcccgattctcctcctctcccttctgtcgtcttctc

SEQ ID NO: 498417 - DNA, 678 bp, Homo sapiens
  misc_feature (107)..(107): n is a, c, g, or t
  misc_feature (202)..(202): n is a, c, g, or t
  misc_feature (206)..(206): n is a, c, g, or t
  misc_feature (267)..(267): n is a, c, g, or t
  misc_feature (269)..(269): n is a, c, g, or t
  misc_feature (412)..(412): n is a, c, g, or t
  misc_feature (514)..(514): n is a, c, g, or t
  misc_feature (519)..(519): n is a, c, g, or t
  misc_feature (569)..(569): n is a, c, g, or t
  misc_feature (573)..(573): n is a, c, g, or t
  misc_feature (632)..(632): n is a, c, g, or t
  misc_feature (636)..(636): n is a, c, g, or t
ggggaccaccctgttggtgggggctgtccagggccttgtcggggcatcccccaatatcagggggccccgcattagccccactcgcgggggcagccgcctaacatccngcccctgggtatgaccccccgcaggggcctgcactggccaagatccaccaggggcaatgccccccagcaggtttatgccaggacagatgcccccngccnacctctttttagaatccccgattcacattttgttcctccccaccggccagaggagaccaangngttcatgctgtccaggcttttcaatcagttcccgggtttcaaggaggtccgtttggtacccggggggcataacatcccctttgtggagtttcacaataaggtacaggcaggggcagctcccaatcccctgcagggttttaagntcccgcagaacaaccccatgaagttttcctttgccaaaaagaagccccttttccccccaggccggccccttcccctgtttgggggccccccctttccccctngggtnagccccctaaaggtaagtccccccttgggggcctttttggacccgggggngagngaggggtccccccccagcattgtacccaaagtttgtccccaaccattgccccgggggcngttnggccggaattaaaggggctttttggggttgggtttttcccca

SEQ ID NO: 498418 - DNA, 133 bp, Homo sapiens
ggtcagcaggtcgtcgataatcctcagcacaaaacccagctgcaaaccctcatctgaagaggacgaatgaggaggaccactgtggtgcatgctgattggttcccagtgcttgccccaccccctattcactggt

SEQ ID NO: 498419 - DNA, 161 bp, Homo sapiens
tgcggacacgtagtggggcggttacttatttagcttgccgaattttcgttcggtattggaatttaccaaaccaattggttcaaccacttagaacgggcctgtgaacaaccaccaagggaattcaaaaagaagtattcatctggtcattctggtcgttttcg

SEQ ID NO: 498420 - DNA, 743 bp, Homo sapiens
ggcggggagcagcaggcagagcagcggaccgaggcggccggggaccggcccgcgggctccatgggccgcggttacgcctgcccgtcgagggctggaaggcactagaagacgccgccggggactgcccagaggccgggatccccgctccacattgtgcgcaaactatgtttattctgaggtcagcgctgcgagctggactacatcggtcctcgttaaggatggcctggggaagattgcggccgaacctcccctcgccatccggactccggtccgcgcggactactccctgcttcccacctggcgagaggctggagagcggcgaaggagtcggggacgtggacggcgcggagggcatgaggagaggaatgatctcgaccgttaataaaccacatcccacaaggcaggatcgatgaacgatcctgcacggccccgcagaagactgaaacgggccaccatcctacgagaggcgatcggcgactgacagggaccgcgagacggaacccaggatccactaaacgagacgacaccgatgaacgaaaggggtgacaaggacaacacgcgctggctcacgctggggaaccagaacccaggatcgcccaggcagaccagaacacaattccccccgcagcacaagggggacaacacatcctggccggccaggcgccaccaaactacccctcggcaatccagccatacacacacacaacaccaaggccgacaccgggaccacccagcaaggaaat

SEQ ID NO: 498421 - DNA, 792 bp, Homo sapiens
gagggttattcaacacaatgctttggaagaccgatccatatctgataaacagcaatgggatgcagctatttattttatggaagaggctctgcaggctcgtctcaaggatactgaaaatgcaatttgaaaacatggtgggtccagactgaaaaagaggtggttatactggaaggaatcggaccaagaacagtgtgtgtcacaatgagaacaagaatgaatggagaagatgtggaagtgtaatgaggagcacgccaggttatctggcaagtgatgaaataaccacagtccggaagaaccttgaatcccgaggagtagaagtagatccaagctgtgattaaggatactgggcatcgaagtgtatagaagactatttttataaaaacagctctaaacgatgtgtaaccttgtgtcgaagaggttttattagtaccaaaggcattaggtagattgtgagtgtggaatgcaatgatgtggtcttgtatggggtatacaggcatgtttgttatcacggcaagtactttaagggcaacatgcttataaatactgaagttaggcgattagagtaaaaatgttcaagaggtatggaagatttgctgaagatggtgagaagagataaatgttactggtaacgcgttcaactggggaggactcaagaagttgagaatcaggaaaaactggggcttcattgagctctcatcgggaactaactaaatgtatctatagttgttctttgagacaaaataggttggcgcgctttttggggccctttaataaaggggggggaaaaggttg

SEQ ID NO: 498422 - DNA, 211 bp, Homo sapiens
tgacatatacttaactctatagccacgtctttcaacatacgtaaaaacgaatgcaaaattgaagtgggtgcccttctttctagcttatgggtagacttcttttactaagcttgtgagaactatcaaggttgcatccatccaagtgtagatctaccactagctggaccgtacatttgacctggagaactcgctcatgacgctaatggcagta

SEQ ID NO: 498423 - DNA, 905 bp, Homo sapiens
  misc_feature (702)..(702): n is a, c, g, or t
ggttcgtttatacgaatatctgattggcccagacaacagtgcatgggagggcgttttaggtggtctctaagtagaatatgtgagatgaatgaaagggtagtgaggtagtctacttaagaagatgtttctgggaaattcactagaaacaattaaaccagagtaggattgtcggtgagcttagacttctggtattccctactggccgtcccgagagagaaagtgggcgagggtctcgtggcagcgcgccaggacagagcgagcaccccatgcctatacctccctccccgagctaagtcccaggacatctgggccattgcctcggatgactgggctgacgctcttgtacgtgctcagtgagaagccgtggcgtgaagggtgctcgaacacaccaagctgctcagtatggtcgaggagataggcggaacagttgaacccgacttcccacttccgcatgacccctacaggcggggttgccctaaccagtccaggcgtactagctgtcggggaagaacagcagagtgccagggaagtgaagatcggcaatgcacccgcggcttgacgacagtgacggacgaagaagactcgtagtacgggaattgaagcaccagacaggcacatcggtagaaatcgaagggaggcatgagtcacggccatcgcagtgagcatctgaaaggcgtgtccagcaaacgttcagaggtccangaacggtgagagggggtactgaccctagtacacaagcgcttggctctggaactacttttaggcggtcctcggcaggaggtccaatcttcccaatcgggtggagacccccatggtcaaggaaagtactaccttgtggaacatgggcccaggggtcaccggtccacgttcacctctgcaacgggaggacacatttctggatcaaa

SEQ ID NO: 498424 - DNA, 1113 bp, Homo sapiens
tgcggtggcgggcgcctgtagtcccagctactcgggaggctgaggcaggagaatggcgtgaacccgggaagcggagcttgcagtgagccgagattgcgccactgcagtccgcagatccggccggggcgaataggagtcgaggactccgtcccaaaaacaaaaaaaaaaaaaaaacaaaaaaaaaaatgttggtggggcaggcactcggcggccccgcgaaaaagaatttctcagaacaccaatcggagtggggcacgcggcggcggcgcaccacagaaggtaagggagaacagaggcgcaaaaacggggtgtccccaagggagaaacccaggggatcagaaacaagacggccgggagattacccaaccacaaaaataaaaaaaccccggcgggaccaccacaggcggcgggtcgttcgagacacacctccacaaaggtgggggcgacctcgagagacagggcaaatacaggggcgagccacactaaaaacaacaaggcgagagtacaagaggcagaagcctaagataatacagaattagaggcccgccagctaggggggagacaaaacagaaagtagacgaaactcagaagacgcagaagcaagtaggagacgacgacagagaagagtacagataatgagagaaacaagcgaacagacaatacacacgagagcaagagcagactaaccaagacaagaacgagcagcgaccgccgagggagaaagagagcacagggggaagacagacgaagaagagagaggagagaagaggcgaggagcgcgaacagagacaaggaagaagagacgaggcctaggaggagagacgagacagagagcgagagcagacgggcgaggaagagcgaagggaagcagaacaacgaggaagagagaggacggagcgagaagagacaagcgacagggagagccgcagcaagagcgagacagtagcgaagcagcggacgagacaagaatagggcgaagaagggagcacacgacagagaccgcaacagagagagagaaagaccgccagtgacgagatagcaggcgaggcgaagggagagaggaaagacaggaagagaagcaacaacaagagagagagccaatgacaggataag

SEQ ID NO: 498425 - DNA, 116 bp, Homo sapiens
ggacgctggtcagtgatctccgcatgttcaagtgctggatacaggcataagctcggctggcaggttatgtatcttttctagtggttgcaattcttaggttcccagggagacatgtg

SEQ ID NO: 498426 - DNA, 742 bp, Homo sapiens
ggacgcgtgggtccgctactttggcgcaagccagggtggttggatcacttgaggtcagagagttctcgaccagcctgagcaacatgctgaaaccctgtgtctactaaaaaatacaaagagattagaccagggtgtggtggtgcatgcctgtactcccagtctactcgggcatggctgaggacacggagtaactcagttgaacagcaggcaggcacgtaggttgctatgtgagactgcagcattgcactcactgtagctccgaacctggagtcaccccacgcacatgagtagctccatcttcagaacataccaacacacacctgaaaccacggtccaggcgtcagcatggtcctcgagcgccgtgatatatcccatggcacctcttgggcacggccgacggccgcgtacctgcgaatcagccttgaagagctcacggacatctctcgcagacccagccacgacccaaccactggctgtgaaccccctatctcgtagcttacgcccattcaccacatacccacacttttagcccactgcgcgccgcccgggcctgcggcggaggggccgccccgttgcttcgggctaccccgaggccctcacctcccggggacgggccctgcatgcgccacgcgcaaggaactggcgcgttgcaacccccccggggcacacgcccgcgcacgctttggcatgctctgcacgcccggcgccatttggcgcccacttgggggctcccggcagcccc

SEQ ID NO: 498427 - DNA, 444 bp, Homo sapiens
  misc_feature (259)..(259): n is a, c, g, or t
  misc_feature (273)..(273): n is a, c, g, or t
  misc_feature (294)..(294): n is a, c, g, or t
  misc_feature (316)..(316): n is a, c, g, or t
  misc_feature (333)..(333): n is a, c, g, or t
tcaatgcttgatgtgttcggagaatgtaaaataagtgaaaatattgctgctagaacttacctttatgggtcagaatttaagtgtcttcagaacaaatagtggaggctatacgtggtgtacgcgattaatacacattatccttcacagcattgaattacaaggaggtctcatgattgcacacaccaagcagtgtagcgatgcacaatcctttctttaaagataagaacgtttttcaaccccaccagtaacatttcactcngtaagattgctaanaaaataagctgggggcctgcnatacagcgaggtgatagctacnttgatttgggtgcagcnggggttagtttccgcactgctctaagaagatcggcactatgagttaagcattgggagctcactacggccagggcattgccgcacggagctacagacccatgaccctggaag

SEQ ID NO: 498428 - DNA, 114 bp, Homo sapiens
cctaggttaggtgaagaatccaccacctcccgtagccaaacaggttctactcactcaacagtgtcactgccagacaccagcaggctcagtgaggaatctaccaccgtctacagc

SEQ ID NO: 498429 - DNA, 355 bp, Homo sapiens
catgcgcgtcttacgcgaaacgttgccgtcgttcagcaggccggtccaacgcttctcggtgctaccgacgaacgcaatactgttcagcaggcgctcaaccttgtctgcagcagaatcagccttggtgccgctcaggttgatgccgtacagctgcgcctggttcacttcttccaggttccattcccagccggagccgatcatggcgaagtcgtgcgatgcctggtcgtgggtggccgagttgaacggcatatcagtgcccgaacccgacaggaacttggcctcaccagcggtatcgacggtgaagaacgtggtgccgatggcccatggagcgccttcggtgactactggaatgctg

SEQ ID NO: 498430 - DNA, 356 bp, Homo sapiens
taatgggacaagcgccctcctgctccggagcatagcacccaaagcctcaatagaaagacgtcggcaggccctgagggttgctccatggtcatggactgcccgtactcgttcccacggtacagaaacttgatggtccaggctcagtcatcgggcagagacgctgaccacagctctggagcgctaccgaagcgctgtatacgcccctggcgtacttccatctccaggggtccagtctatgggccacatggtctcccgggctagccggatgcgcacgcttgccaattcgcccaacaacttggccctgtccgtccatttagaacgtggacccctacagaactaaaaacatgccttgaatc

SEQ ID NO: 498431 - DNA, 166 bp, Homo sapiens
ccttaaacctcactgtcccagtatctgtcagatgctcactccccatgcatggagatctgggcccagcacactgccgtgaaagcagaatgtcagttagaatgaaaaaaaccgccagaccactcaggatcacccctggcagaaggagggggcaggaggcagacaggga

SEQ ID NO: 498432 - DNA, 997 bp, Homo sapiens
  misc_feature (529)..(529): n is a, c, g, or t
tgacgcgtgtccgagtgcggcactcttgtgggtgagcctgctcccgtatgagtagctgccgccgcccgtctctctgtgtgtgtaataaggaagaggaatgtgtgttcgtgtgcggtgactgcttctggtttatgggagaccctttctgctggttgtgtcgcgcacggctcgttgttgataagtgaaaaatcttgggattttttgccggccccgcactcctttgtcgtgggaagaattggttattaccgcggggcaaaacataccctttactgggggatgtgagaaaataccgtttgtgtatgttcagtgcgggaagcccgctgttttttaatggacacagtgtcaattaaatggtccgactccatgtgagacgtggggcgccccccctgcggggagcagtgattcccggctaatctgtttatggagagacgcaggttgtgtctcgccttcccctcccactggaattgtggacagagtgcagtgtgtgctgtctctgccatgcgcggttcgtatgggatgtgagcagctntctctcttaaagggttgttctcgtccgactgacaggcgtgtgcagattacccctgcgccgaagttcactgcacgagagttctgtctcacccggagcggtgttcccaacacgtaggtgtctccacacagcaggctttgtcgctccgagtcgagaccacaccacgccgtgactctcccgaaaggagacatccatgtgatcactgacacagatacatgatgaaatcagataattgtacttcatgttgtctgtcagtgatgtgggcgcccacatagcctttctctatcttctaacaacatgacccttcacttcagctgtgcgcgtgtgtctctggaacactttgtttattttctctctcagtgtgaggatgaccataggtctctgcatattgttctcgaggagagcgagagagacccaatcaaatcacatcctcttctttataatcaagccacacaattgtccgaaaaatca

SEQ ID NO: 498433 - DNA, 968 bp, Homo sapiens
aggtatgataggtcgaggcctcggtttgtaaattaagtgcaccgagggcgagcacgtggagtttaggagctggaggaaggagaacggaggggagcgctcgtggcgcgagcgagagaaaccgcgagcgccgagcttgtgactcgagccccgtgcaacggctgaggagctacgcacgtcctattacatataccaatgatgggcatgtaagaaaaagcacagtaccaaaggaacagcacacaccacacatgatacaaaaaggccttcgatacgggataatccatatgtattaccgtcaggaagttgattaaactatacagaaggattgtttctagagacacgttatataccgactaccagccatagcgcagctacacccaccgaacactaggagaggccacgtagaggcccccaggagcagagcagagtcgagccacggatagaaacgcgccgtaggagaggataccacaacatacactagaaaaacaatcacgactagtctacatcgcaaatcagagagctaatcaagacagcgtgaggcgtccagacgaaagtacgtagagcagaaacacgaacgaaaaccaaaaaaacaacaagacagagagacaataagcaaccaaagaagagcgaccaccaagcagagacacacgacgcaaaaagagacctacaagaaaaaccgaaagaaaatcaaaccaaacacacaaaaacacgacagaacatgcacaaagaacgaagaaagaaagcacgacaaagagagactccaagagacagtacaacaagccacaatcagccaccaacaccacaacaaacatacatacctccagcaacagaaaaacaagaggaaacaaccaaagacgacaagagagaaacgcgcagaacaacagcgacctaacagcagagaaacaaagaacacgacaagaagacagccacgaaaaagacgacaaacaagacagaccgaacacaacgaaaaa

SEQ ID NO: 498434 - DNA, 986 bp, Homo sapiens
ccctggatggttgttgggagggagggaaagtcctgaaaaggaggccagttcaacatggcctctaccctggtagaaaaaaaaagtgaaaagagaagaaaaaaagaaaataaaaataaaaaggtataggacagtggtgtgtcaggattgaagtcctgcctgtggcggtggggtcatgacaggccgagtttgttgtatgcagggtggccccctgggagacgcttggcattacaacagtcgtagccgtcgaggccggcaacattacacaatcccgaagcttagggtgacaatgcgagaaatcattttcgaggcatctgtgtttcgtcacgtcccgccttgacatcccgtgtagtgtgcggtcatggatttgtccaaaagatccccttctgatcagtagttgatcgtgcactggcgtggcacatatttccaatagagaggataagcggaatacatacggtgtgttcaccaaacatgaggccgtgtaatgggtttgtttcagggaggaagagattaatttacgtgtaagatcgcgggaagcttctaatttgttaaataagtgccatttattgtggcaaggggagggtagttttgacaagaggtaatagtactcggacaataatgtggacaaaatgaatgacatatgagagaggcaaataacagtgataaggaggtaactaaggcacgagagtcagaatcacaagtgtacccccaggaagtttgttcattagagcgcttcatccgtgaaagtcttcctcagatgaagttcagcgtggaaatggtactgaggacgtactagactgcaaggcatttatactcgatgggtatatcccagacttctaccagggtaggaaatacgagaactatacttgaagggcatatccactaggcatgggggtaggttggatcttggttaccgatggtaggattgttcgctttgtaagaaagcgacacaaagtattaagtggcaatgagatcttcagatatcctaa

SEQ ID NO: 498435 - DNA, 484 bp, Homo sapiens
gcacccgaaagctaatagcggctctgaccttatattcaacttttttcttacttttttttttgagacgaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcacccggcctttttaactttaaacatgttttagaattcgcctaaagatcaaaatatcatggattgaacctcatcaattgatagcagtgagtgactgaagcttccaaatcaagaaaagccagcaccaagaacttccattctaatctagagctg

SEQ ID NO: 498436 - DNA, 126 bp, Homo sapiens
tcccaaggactgagaaactggcaggaaaaacagatgcataattgtagctgaagacttgaacatcctacctctcagaaactgagacagcaaggcttgataagtataattaacatatatcaacaattc

SEQ ID NO: 498437 - DNA, 357 bp, Homo sapiens
ctcagcctggaacgaatggactcagaaaaaggagggctgtctgtaggagtgaggcgcagcttaagtttgcagagggtcgaaacgccggatgcttgccaactggagtgcagtatgagctgggtgtcactaggctctcaacatactggctttgctgctgtgcttgggcgttggtatcttcattttacagttgattaacccaagtacgtgtacttattcaagtgacaactttggggctccaccatgaggtaccactgtttaaagctagctgtgtctagttccagaaatcttaagttttacatggtgctgtaatcagcttggagtaatgatgctggcctaatggtgctcaccatgtgagcg

SEQ ID NO: 498438 - DNA, 113 bp, Homo sapiens
acgatgtgctgcggtgattctagaggatcccgacgcctctctgtgggtcgggctcagcagaactgaatcccaactcggagtggtttgagaactactctctctgtcaccgctgt

SEQ ID NO: 498439 - DNA, 375 bp, Homo sapiens
cggatgggggagccgctttttttacattcagccgaagggagcgagttctggagcgccctgttggagaaaggcatacgccaagatcaacggatgctatgaagcgctatcagggggtgcaccactgagggcttcgaagacttcaccggagacattgcttgagtggtatgagttgaggaagccccctccaaacctgttcaagatcatccagaaagctctgaaaaatggctctctccttggcttgctccatcgacatcaccagcgccggggacttcgagggccatcacgtttcagaggctggtgaaggggcacgcgtactcggtcaccggagccgaggaggttgaaagtaaacggaaagccttacagaaactgatccgg

SEQ ID NO: 498440 - DNA, 188 bp, Homo sapiens
aggtgaccgtgcagggaggctgattttgactctgagtctttattgaaataaaataattggctgggtgtggtggcttatacctgtaatcccagcactttggaaggctgaggcaggaggatcactgagcccaggagttccagaccaccctaggcaatatagcaagaccctctctctacaaaaaaaaaaaa

SEQ ID NO: 498441 - DNA, 124 bp, Homo sapiens
tgccggtccttcatctctccacctcagtgagggaccgcagtcgatcaggcccctcccacccacctcctccagtcttggatggcaactgaggggtagcaggcaggcccgagatgtgctgccgttt

SEQ ID NO: 498442 - DNA, 359 bp, Homo sapiens
  misc_feature (297)..(297): n is a, c, g, or t
agaggatcccagcgctgagcaatctagagcagaagaagagcggaccttccgcaagtcacctaccggggggtggacctcgaccagttgttggacttgtcctacgagcagctgatgcagctgtacagtgcgcgccagcggtggcggttgaacgggggcctgcggtggaagcagcactccttgttgaggcgccggcgcagggccaagagggaggcgcggcccatggagaagcgggaagttggtgaagacgcaccttgcgggacattgatcatcttacccgagattggtgggcagcagtgngtgggcgtctacaagtggcaagacctttcaacccagggtggagattcaggccggagcttgat

SEQ ID NO: 498443 - DNA, 336 bp, Homo sapiens
  misc_feature (7)..(7): n is a, c, g, or t
  misc_feature (22)..(22): n is a, c, g, or t
  misc_feature (149)..(149): n is a, c, g, or t
  misc_feature (180)..(180): n is a, c, g, or t
  misc_feature (200)..(200): n is a, c, g, or t
  misc_feature (216)..(216): n is a, c, g, or t
  misc_feature (232)..(232): n is a, c, g, or t
cagtgangcctgcagcagaacngggatttccaaccggcttccctgggccacagtggaataagaattgtctcatggctgggcatggtggctcacgcctgtaatcccagccctttgggaggttgaggcgggccaatcccttgaggtcaggngctcgagaccagcctggccaacatggtgaanccctgtctctactaaaaatncaaaattagctgggtntggtggcacacgcctntaatcccagctacttgggaggctgaggtgggagaattgcttcaacctgggaagcagaggctgcagtgagccgagatcgtgccactgcactccagtctgggcgac

SEQ ID NO: 498444 - DNA, 350 bp, Homo sapiens
  misc_feature (350)..(350): n is a, c, g, or t
aaaatgctaagtggattttcccaacagatcataatgacattacagtacatcataaaaatatccttagccagttgtgttttggactggcctggtgcatttgctggttttgatgagcaggatggggcacaggtagtcccaggggtggctgatgtgtgcatctgcgtactggcttgaacagatggcagaaccacagatagatgtagaagtttctccattttgtgtgttctgggagctcatggatattccaggacacaaaaggtggagaagagctttgttcatcctcttagcagataaacgtcctcaaaactgggttggacttactaaagttggtaacttatgttgttttttgn

SEQ ID NO: 498445 - DNA, 467 bp, Homo sapiens
  misc_feature (341)..(341): n is a, c, g, or t
  misc_feature (359)..(359): n is a, c, g, or t
  misc_feature (413)..(413): n is a, c, g, or t
gcggccgcctactactactactaaattcgcggccgcgtcgacgggaaagtgtacgagtgagggagagtgtactagtgagggaaagtgtacgagtgagtgagagtgtactagtgagggaaagtgtacgagtgagggagagtgtactagtgagggaaagtgtactagtgagggaaagtgtatgagtgagggagagtgtacgagtgagggaaagtgtacgagtgagggaaagtgtactagtgagggaaagtgtacgagtgagggaaagtgtacgagtgagggagagtgtactagtgagggaaagtgtacgagtgagggagagtgtactagtgagggaaagtgtnctagtgagggaaagtgtncgagtgagggagagtgttctagtgggggaaagtgttccagtgtgggtgagtgtncttgtgagggaaagtggtcttgtgtggggaagtggtctggtggggggttgtgtt

SEQ ID NO: 498446 - DNA, 1005 bp, Homo sapiens
tggactgtgtaccaccggcgccacttcccagtgctccctgatgtcagtgaaccctggcatggctcgctggatcaaagagctcttcgtgccataacgagcggtgtgtgtcctgcacggcggtgactgcaaacatggcttcttctcactgacagctgtggagggccaccaacgatgggctccatatcgcatctactatgaccgggcacctgcacacaaacagcccaaggcacagcaatggtgctcctacaatgacttcagcttcgtgacagcagaccaatagagagggctgtccccatgcgtaagtggctgagcacctgggcgagttcaacctgggctccacacatcgtgctcatcttcgaggcccacaaggacttcaataaacccagctgcaaaacagtgacagacaaatcctgcttaaggaggacagccctggtgctcgctcatcagcagtctcatttccttgattcatgtgcctgctacacgggcatctatttccaaagacagcagatgaagggtctttatcaagcagggaggcccatgcaggccatccatggtatgtggcctgactcaggcagtggtactgggacagtctgaccaggataggccttgcaatgacttcgggctagcaccttgtatccagaggtgcaagacaagaaggtggcagagagccacccatcatgccccttcaagctatgccagtaccattcttggctacaaataaacaagtggcaggattggaactgagtctcgagtcagcatttggacatcttggagaacaacaaactgggtaatagaacgggaaaaaaaggccatgcgtaatttcccgtggaaccagaagacgttcaagagtgggatcatcggggatagatacgaaaatctaaacatgtacgagtgatagcgttccaccacaattaacccatgaagagtgataagctggtaggggcaccattagatagaatatggcaccttaaggagtccattgattgcaccagagctgaaggtgtc

SEQ ID NO: 498447 - DNA, 429 bp, Homo sapiens
gcttcgacctgagtagctgagattacaggcatggtgcaacaatggcccgccaaatttcaaaatttgtgtaagagacgaggtttcaccatgttacgcaggctggtctggaactcctgaccataggtgatctgcccacctcagcgtccaaaagcgctgggattcaggcatgagcaccatgcccggctactgtttgcacttaaaataactagttcaaccattgtggaagacagtgtggtgattcctcaaggatctagagctagaaataccatttgacccagccatcccattattgggcatatacccacaggattataaatcatgctactataaagacacatgcacacatatgtttattgcggcactattcatgacagcgaagacttggaaccaaccagatgtccatcaatgatagactggattaagaaatgt

SEQ ID NO: 498448 - DNA, 1047 bp, Homo sapiens
gaggagctctacaggatcagcttgggggggatttgtccagtctaagaagtcccattgccaaagctattctgcaggagtggtgaatgccgagactatgtgcagacccctgaggtcttactcttggacactggtcagtattccccatcgacagtacccaaagtagccttgagttgacgtttaggtccttgcctcctttattagagaagagggcattatagactgcagttatatcctggttgaaagaaggttaaagcaacatgtttatttgcctttatctagtgaactaactcgtagagatgtacgtcagacaggaagacagtcttagacacgtgtacacgttagcagacttggcacttaagtcccttgattgctggccagaatggcgtggcatggtatggccgttaagtatgtcccaggaaccccatgaacagggctgcacttggacctctcccatacgatggtcctcgaagaggcccagtcccatacaactgtggatgtcattgcttgtcaggataaggaaagtcttagtcctagacacgcccttgggatgggtatgaaaccaccagttccaaatggacgtacatcatatccttcgaccataggagatcaaatggatccaattcatatcccaagaaaacgcatgacatagatgcactgagacaaagggacccaaaagcaaatagaagcagaggacccaaaggaaaacatgataccaaagggcacctgacatgcagagaaaccatgagaactagggaaagattcacatgatgaacggacaaggcacttggaaagccgaatttggcaaagcatatgatggctattacccagatggaaagggaacaaaagagggaaaaaacaccagatcagagaggaaaacatggataatgccatattgcacagcatagagtggcacccgtgagacacccgtatatatgacattgcaccgcatatatgtaacagtaataccgttcataggaagtccccaattatgagaagagataaaccacacgattgtagaaccccacatcaattggagtcactggagga

SEQ ID NO: 498449 - DNA, 124 bp, Homo sapiens
aagcctcggtacccttcagccagcacagtggcccacgcctgtatcccagcttttgggagactgaggctggtgaacattgtcaccctaaagaagtgactaatgttgaaagtgattgttccccgct

SEQ ID NO: 498450 - DNA, 670 bp, Homo sapiens
  misc_feature (15)..(15): n is a, c, g, or t
  misc_feature (289)..(290): n is a, c, g, or t
  misc_feature (297)..(297): n is a, c, g, or t
  misc_feature (302)..(302): n is a, c, g, or t
  misc_feature (376)..(376): n is a, c, g, or t
  misc_feature (381)..(381): n is a, c, g, or t
  misc_feature (398)..(398): n is a, c, g, or t
  misc_feature (427)..(427): n is a, c, g, or t
  misc_feature (429)..(430): n is a, c, g, or t
  misc_feature (435)..(436): n is a, c, g, or t
  misc_feature (439)..(439): n is a, c, g, or t
  misc_feature (443)..(443): n is a, c, g, or t
  misc_feature (453)..(453): n is a, c, g, or t
  misc_feature (507)..(507): n is a, c, g, or t
  misc_feature (516)..(516): n is a, c, g, or t
  misc_feature (522)..(522): n is a, c, g, or t
  misc_feature (526)..(526): n is a, c, g, or t
  misc_feature (567)..(567): n is a, c, g, or t
  misc_feature (578)..(578): n is a, c, g, or t
  misc_feature (590)..(590): n is a, c, g, or t
  misc_feature (594)..(594): n is a, c, g, or t
  misc_feature (608)..(608): n is a, c, g, or t
  misc_feature (668)..(668): n is a, c, g, or t
tatctgctgttcgcnggctgggcctccgcagcaggcttggccagccgctgacgggtcggcgggcgggtttgtgtgaacaggcacgcagctgcagattttattctgggagtgcaaccctctcaaaggttgaaggaactgatgtaacagggattgaagaagtagtaattccaaaaaagaaaacttgggataaagtagccgtacttcaggcacttgcatccacagtaaacagggataccacagctgtgccttatgtgtttcaagatgatccttaccttatgccagcatcatnnttggaancccgntcattttttactggcaaagaaatccggggagaatgtggccaagtttattattaattcataccccaaatattttnagatngacatatcttatcctcntataccgtgtttaatgcctgagtactttntnnctcanntcnaagncataagtgangccgccctgaaggaacgaattgagctcagaaaagtcaaagcctctgtggacatnttttttcancttttncaancaggaaccactgtgtctcttgaaacaacaaatagtctcttngattttttgtnttactatggtgnccangagccctcaactgnttaccattttcaacaaactggacagtcagaagcattggaagaggaaaatgatgagacatnta

SEQ ID NO: 498451 - DNA, 132 bp, Homo sapiens
  misc_feature (86)..(86): n is a, c, g, or t
gggccccgcgcgtcgcctgtcctccgagccagtcgctgacagccgcggcgccgcgagcttctcctctcctcacgaccgagagctgnctttttggcgaggttttggctgctggatgctggttctctttgtggc

SEQ ID NO: 498452 - DNA, 151 bp, Homo sapiens
tgcatgcttgctcatgcaggcaggcctcagtcagtggggtgcaggcttggcattcagcgtttcagcaagggctcatttgtttgtgggtctccatgtagttggcagtgtcaggcatcaacatcgtgctcaaggagcagggcatgaacacgca

SEQ ID NO: 498453 - DNA, 215 bp, Homo sapiens
atccaggtagatgaattaccacaccatttccaatgaatgcagtgacatttggattaattattgcactgggtaagagatgaaaatcgatatgtcgcacagaatccacaacgactgtgtggccagcattattgcgtcggtggcagcggcacacgatgtcggcggtcctgcgccagcagggccagcgccttccctttgccgtggtcgggccactgcgc

SEQ ID NO: 498454 - DNA, 158 bp, Homo sapiens
ctgtgctttgggacggcggattcgggaactgactgctgtagttcagaagaggttggctttccagagggcagtgtagagctttatgctgaaaaggtggccactagaggtccaatcttccggccggaagattggacctctctcgccgtcccaaagcacag

SEQ ID NO: 498455 - DNA, 945 bp, Homo sapiens
  misc_feature (451)..(453): n is a, c, g, or t
  misc_feature (455)..(455): n is a, c, g, or t
  misc_feature (457)..(459): n is a, c, g, or t
  misc_feature (465)..(465): n is a, c, g, or t
ggctcatgttaaagacccattgaatagtttgtgaccccagagcccatgcttcttgccagagtgtggtctttgtgggccttgtggcactctgtagagcagggatcagcaaacaatgtcctaaggcctgttttgtatgacccttgagctgaggatggtttttacacccctaaatgattaaaagcaaaagcaggccaggcgtggtggctcacgcctgtaatcccagcactttgggaggccgaggtgggtggatcacaagatcaggagatcgaaactatcctggctaacacggtgaaaccctgtctctactaaaaatacaaaaattagccgggcgtggtggcgggtgcctatagtcccagctacttgggaggctgaggcaggagaatggcgtgaacccgggaggcggagcttgcagtgagccgagacaacgccactgcactccagcctggcaacnnngngnnnctctgnctcagaaaaaaacaaacaaaaaaaaaaaaaaaaaagcagaactgtgtgacagagagtggatttgaccctcagagtccaaggtctcttaattggcattctgtggccttgtgggggccagaaagattctctagtgaggatgcagctgttcgcagtgctccctgcctctccgtggggtaagatgccagtagcagccttcactgtgtgaacacgcagatgtttaatccagaacattggctaaggggcccctggggaacccacaatttgtccctgggcaaaaaccagtgggtaaaatattcctggtctggggccaggatgcgggggtcaaagcttgtaatccccagccacttgtgggagccggaggggggcagaaacacggaagcccagggagtttgaaaccaggctgaaccgaacggggtgaaacaccggctcttactaaaaaacttaaataagtgggcatgggggggcatgcctggaatccaa

SEQ ID NO: 498456 - DNA, 306 bp, Homo sapiens
  misc_feature (144)..(144): n is a, c, g, or t
  misc_feature (208)..(208): n is a, c, g, or t
  misc_feature (229)..(229): n is a, c, g, or t
  misc_feature (244)..(244): n is a, c, g, or t
  misc_feature (278)..(278): n is a, c, g, or t
  misc_feature (289)..(289): n is a, c, g, or t
aaaaaaaatcagccggaccttcaggcttgattgaggcacatacttcctattctacaccctagtaggccccttcccctactcatcgcactaatttacactctacaacaccctatggctcactataacattcctactatctcacgntctcactgcccatagaactatacaaactctctagagccaacaacttaatatagactatgcttancacaatagcttttatagtaanagatacctctttacnggactccactatattgactccctaaagcccatgntcgaagccccncatcgctgtggtcatat

SEQ ID NO: 498457 - DNA, 457 bp, Homo sapiens
tcgatcggttcaaggcgggattgggacccagaagaatctcggtggtggttctaattctgccactagcaaggcaaacttaggtaattcatttaacgtctctaaacatgatggccagcggcaaactagggaccatattggacgggctataaaaactaaaaaatagtggccgggcacagaggttcacacctgtaatcccagcacttggggaggctagggcaggtggatggcttgaacccaggagtttgagaccagcctgggcaacatggtaaagccccatctctagaaaaaaaaatataaaaattagcggggcatggtggcatgcacctggtagtcccagctacttgggaggctgagacacaagaattgcttgaacctgggatgtggaggtcgcagtgagccaagatggcgccactgtactccatctagtctgggtgacagagcgagggtccatctaaaa

SEQ ID NO: 498458 - DNA, 133 bp, Homo sapiens
gaggcgttagatactaggctactaaccaacacactaaccatataccaatgatggcgcgatgtaacacgagaaagcacatggctaggccggaggtcattaggggggctgagagggcccctgttaggggtcatgg

SEQ ID NO: 498459 - DNA, 946 bp, Homo sapiens
  misc_feature (740)..(740): n is a, c, g, or t
gctattccccacccatccccccatctccaacggacggacgaacctcggggaccatatttgctcttgaaacgagaacaccgtctcacactgaaagtttcctatcgtgaggttcagcgtcatctagagtcaacggatgaagcataagcgttcactgtggaatttatacaacacacaaagaagaggctcggccaaacaacatccactgaatattgaacctcgccccttccccattaaaaaatcccacgcaccaacaaccaaaaacggccctccttttttctcaacgagaggacctctgcaggcccacaacctttactcgcgggctacgtccaccatcctacatcccctgcctactatccacctccgcccaaccccccctctcctcaacgctccccccccactctgtgcgcccgctctcccgcacccgcccctccccccccttcccctcagaccatcatgacacgctcccagaatcgctccccgcccaatccccccaccaccccaccagtcatgtactgtcctcgcaccaccccgccccaccccccctcctcagctaccccagaacccacgtacacaacactcctacaaaacccaccctccccccccccccacctccccccactcccaccgcctcactccccgctcgccacacacccacagagtccgcgcccccagccacccgcccccccccgtccctcccctctctctctccctctctcctctctcaccgcccaccataccgntccgtcccccttaaccaatcactgcgcccgactctcccggtctgccctcgctgccacgcacaccaccccccttccccaccccccgcgtccgtccacccacatctcgtcccctctcacacccgccgcaccgacccgactcacgtcgtcgcctctcctccacccactacagtacaccgcgcaccctcccccagcccccccgcacctgc

SEQ ID NO: 498460 - DNA, 129 bp, Homo sapiens
tgatgtcacaaaacatcttatttttgtgctgtgcccacaatttagtataatgatttttcatcagtacataccatagctgctcgattttgttgtcaatagctaccacacttgcacccatgatgagctcag

SEQ ID NO: 498461 - DNA, 174 bp, Homo sapiens
gttgactgcttacctgtaaagaaagaattatgcagaggagttcccgtcgtggctcagtggttaacgaatctgactaggaaccatgaggttgcgggttcaatccctggccttgcttccagtgggttaaggatctggcgttgctatgagctgtggtataggtcgcagacgtggctc

SEQ ID NO: 498462 - DNA, 402 bp, Homo sapiens
gactaaccccgtataccttctgcatatgaattaactagaaattactttgcaaggagagctagacagctaagactccccgataccagacgagccacctatgaacagctataagagcacacccgtctatgtagcataatattgggaagatttatagtgtgaggcgacaaacctaccgagcctggcttatacctggttgttctctgtagtaatcttagttcaactttaaatttgcccacagaaccctctaaatccccttgtaaatttaactgttagtccaaagaggaacagctctttggacactaggaaaaaaccttgtagagagagtaagaaatttaacacccatagtaggcctaaaagcagccaccaattaagaaagcgttcaagctcaacacccactaccta

SEQ ID NO: 498463 - DNA, 507 bp, Homo sapiens
aaaactgtttacaaagctacatattttagggtgatcccccttcacttttcagatctaggtagggttatagccagtttccattgcgtggagaatctgcaagggtggtgttcctgtacgggtccagagtgaactacatcaaaagtcgcttttgatatcgaggatgcaggtcactactattaagtgtaatgtgttattattcaaaggaagtactgtttactgtaaaagtttgatgaattcagtaatgattttactaaaataacatacttgttcaggggcaaaaatacggttttagggctactttaagatagaatacttaagaatttacttattttggggaccaagggaattggttaaaaagcagaatcctgggccccacttcaaggggggggggtggcggctttatattttataagatacctagtggaggtgaaaaaccacgctttattttttttttttaaaagaacagggtttaattgctttccggttggggggcggggggcaatttag

SEQ ID NO: 498464 - DNA, 428 bp, Homo sapiens
  misc_feature (1)..(1): n is a, c, g, or t
  misc_feature (19)..(19): n is a, c, g, or t
  misc_feature (41)..(41): n is a, c, g, or t
  misc_feature (58)..(58): n is a, c, g, or t
  misc_feature (109)..(109): n is a, c, g, or t
  misc_feature (112)..(112): n is a, c, g, or t
  misc_feature (137)..(137): n is a, c, g, or t
  misc_feature (194)..(194): n is a, c, g, or t
  misc_feature (393)..(393): n is a, c, g, or t
ntacattagaaaaacaggnacttaggaccaaacaaacaatnactggatactgcaatancaaaacagtatgatttatattaaaggtttccaaaggttgacctgcaaaggnagnaatattactactagatcagacaggnaaaaaaatgcattcaggaacccaagacaggaaactgccaaatgtaattaggttaagnaaaagttacccttgggccagtgtattagttttctattgctgtgtgacaaattaccccaaatttaggcagtttaaaaaacaatacccataggcagttctgtaggctcatgagtctgggcacagtgtggctggattctctgctcagggtcttaaaggctgaaataagggttggcaggacaacattcttcatggaggctctngggaagaatctgcttctaagttcattcaggttgtt

SEQ ID NO: 498465 - DNA, 172 bp, Homo sapiens
gtgtaggccctcggccgtcgtgacttgggtactcttggcgagccggtcggtatcaggacacactgtcccctgcctcaacatgtcctgcccagagggaggtcacagatataggctcgcttctcaagcatctgctgggacactttcctaatctgctcatctaggttttctggag

SEQ ID NO: 498466 - DNA, 201 bp, Homo sapiens
tcaagcttctaacgatgtacggggacatggtgaaacctcatccatacaaaaattagcagtgtgtagtggcgggcacctgtaatcccagctactcgggaggctgaggcgggatcatcagttgaacttgggaggcggaggttgcgttgagccaagattgcaccactgcactccagcctgggcacagagcaagactccatctca

SEQ ID NO: 498467 - DNA, 339 bp, Homo sapiens
  misc_feature (301)..(301): n is a, c, g, or t
acgataaattgaatgaaacttactataaattcggctgggtttttttgtttgttttgttttgtttttgagacagagtcttgctctgttacccaggctggagtgcagtggctcaatctcagctcactgcaacctctgccacccggattcaagcgattctcctgcctcagcctcccgagtagctaggactacaagcaccccccaccatgcctggctaatttttatatttttccatgttggccaggctggtctcgaactcctgacctcaggtgatccaccatccttgcctcccaaagtgctgggnttacagcatgatccaccactccgtccctatgcagtctc

SEQ ID NO: 498468 - DNA, 295 bp, Homo sapiens
tcagcgcgcgagttatacttgtgaccttgtgctcattcgagtactagcgggcgatgtagtcgcgcggacaggctgctggatgcctgggagtacgtgggggcgtcaggtgaatgtgctgcgcgcttgggtcaagcttctacaactggacagacaacgctgagctcatgaatctgccctgaggtcatctacccctgttcctgcgaagtcgagggggaagaggacaacagcgcttctgtgaggaagggtgtgctgcgagggcccctggtaataaagacccagagtggcaactacccgt

SEQ ID NO: 498469 - DNA, 391 bp, Homo sapiens
  misc_feature (3)..(3): n is a, c, g, or t
  misc_feature (266)..(266): n is a, c, g, or t
  misc_feature (391)..(391): n is a, c, g, or t
ctnacccaagctttcagatgagattgatacacaccgcctgacagcacccctggctctgactgcagcacactccatcgtcatcacacccacggagcctcaggtcacccttgatgtggcagttctaggaactggccttaggaaatctaactatgaaaccaaggttatggagtatcccacctcaggaaggaacactgaacaactgattgacagtcttcttgccgccagccagaccaccaagtggcccattaaccaagagaaccagcgcnaccagatacgctgacccgcatctcctacctctcatgtgctttgcccagcccagcctgcataccttactcatgatgtcaattcccaagtttcgctaataaaaacatctctgcaagcctcttcaggn

SEQ ID NO: 498470 - DNA, 151 bp, Homo sapiens
tctcatcatgactttatatatgttgctacctcactgtagttacttttctttttgtggtgcgaacttttttttttggccgcatctgaggaagttcccaggccagggactgaccctgtgccacagcacaaaaaccacacagcacaaaaccaaa

SEQ ID NO: 498471 - DNA, 109 bp, Homo sapiens
tcatggatttgctggtgcagtacaactaggcttaatagggacatgtgaaagtgaccctgaaaccggcaataccatttaacccagcaatccccttactgggtatataccc

SEQ ID NO: 498472 - DNA, 283 bp, Homo sapiens
acgagtacatgaactttgatttttggtgtagatgcagcagggcacatgcatgggtcacaatttccatcaggtttcatgtgcaatttcagggtggtgtcatgccattttgcaaaccaatctcactcaaccagcatggtgcgtgcaacatctcattcacctcaccatgattttcgtcagattggttccagccattcatgcttcaatgcacagcctcccatcataaaggcagtgtatacctcatgtgccaccaagttggtcaagattgcacttgctcacactttcc

SEQ ID NO: 498473 - DNA, 105 bp, Homo sapiens
cgtgtctgtccgtcattggggcacgagtcttagccgttctagattctatgtcttcttgcactggatgtccattgttcaggtgaccgcgcttgtataggtaaccat

SEQ ID NO: 498474 - DNA, 287 bp, Homo sapiens
ccggctcccgggtttaagccattccccttaagcgattctcctgagtagctgggagtacaggtgcacaccaccacacccagttaatttttcaccatgtcagtcaggagatcgagaccatcctggctaacacagtgaaatcccgtctctactaaaaatacaaaaaattagccaggtatggtggtgggcacctctagtcccagctaatttggaggctgaggcaagagaatggcgtgaacccggaggcagacttgcagtagcgagatctcacactgcactcagctggcgac

SEQ ID NO: 498475 - DNA, 351 bp, Homo sapiens
cgcatgagagtgcacacggctggagtgcacacgctcacttaggcgtcttcccttacagatctagcattcctggaggaagggcatgtaccattaaactccgccattttgcctcttggtgcataagcttgagcccatttacccaacttctgagatcttatcgagaagctgctgatcatcagtttcaagtgttttccatctatttggagactgcctttccctggtgctggctgcaaccaattactattttagagacaagtttaacaaccacctgaccatcacctgatggttgcctaacattcctggtggtggggttggggcagcactcctgccccaacaatgggaatgttgtct

SEQ ID NO: 498476 - DNA, 1225 bp, Homo sapiens
  misc_feature (168)..(168): n is a, c, g, or t
  misc_feature (720)..(720): n is a, c, g, or t
  misc_feature (858)..(858): n is a, c, g, or t
cggttatatttcccagcgagacctcaagactcgccctcaaaacaccggccgttggtgtggataatacaaaccccggtaatttcttctgatatataccgccgccgctgttgttttccaacaccgagagagaactttcttttcccgcggggtgtatttcctcggtgttcntccgcgcaagggcgcgaagactttttctaggggacgccggactcctgctgtgaaggcgcccctgttctttggttggtgggggccaaccccccctgctatataggcccctggtggggccggcggagcaaataacatttttctctggggccagaaatagttgtaaagtgccccgccccctggggaccacacatgggggacatttggggccttcttggagacgccccacaccatggggttctccccctttctaagcaccccaggggtgtccaacaccccttctttctcctgacagacacatttctccgaaacccccccggggttatattctgccccctggtccccctctagaggtacatggtctctcccgcccgggctctccggaggggcgccacagggagcttgcgccccccgagagcggggggagacatgacacactttttgtggtgaaaagaggcttctggggacacatctcctacgcactcttccgggcgccaggatctccccctggagacacatttacacggcaccaaaggcttctcgtgtcgtcgcgcntggagtgacacaaacccgggcgccaaacaccgcccagcggtatcaaaagggtttgttttcgaacacaccacaaccctccagccccgggggttccaaacaaaaacccatggggtacacgaaggcctttgggcgcctctngacacctgcgagcccagagcgttgtttcaccgagcatcttcccctcttgggacccaaggggccccctggcccaacccgcccagactgggagggccacaccaccgccctccacacgctgggcaccggcaacagctatgggccgcaggtgccccggatggagttcccacaaactgaggagagaacaactgtggcaacacctcctgagacaacccgtgcgagtgggtggaaggcccttcttacacccctccagaacacaaccctggcgccccccggaacgtagcccccccacagacctttttttttggaccccccttttcagggcccgcccttgggtcaaaatccaataaaggtttttttttaggagcca

SEQ ID NO: 498477 - DNA, 212 bp, Homo sapiens
gtcttgggagccagctgagcccgaaagctggcgaattcctcagagctgatcatgtcaggagccttctactggcagctggcgggccagggatgcgtgccgcaccacaaagcctctggaaggtgccttggactcttcgtgtgctgagggttccatgtatacctgcagcgcctcactgtccaccacgtcagctaggtattcctcctccagattga

SEQ ID NO: 498478 - DNA, 154 bp, Homo sapiens
aatgaattagcacggaaatgtgaacagtcctcattgaaaaacacttggaagttttccacacagaatttcagaattaattggatgctgacaaaaatgaagatttgggacacatgtatcatcttgtatctagaatccaggatggcctaggagaatt

SEQ ID NO: 498479 - DNA, 526 bp, Homo sapiens
  misc_feature (19)..(20): n is a, c, g, or t
  misc_feature (75)..(75): n is a, c, g, or t
  misc_feature (90)..(91): n is a, c, g, or t
catgaaaccaaacaagggnnccagactgaacacgatgagggtatgcttgaactatttacgaagatactacattcnggtctggtggaccgnngctaacagggagagccctattaacagctcttggtgtcggagcagttgaacatattaaactgaacaccagaggacgagaagttaaacagggtaacagatggtggaacaacgcgcacacaggactcgccccttacggaaccgcgacgcacgacacaacaaaccacttatcgcccttcaaccttcccgggaacaacttatatcccttcttaacgccaccatttgggggaaaaaacaacacaacttggggaaagatgaatttaaatttttttcaacgggaacaacaaacacacgaggggaaaagttcgactgggtttctgtggttcaataagtaactttcattaatcttactggagttggccagtaaacggaactttggctgcaacatggacacaacttcgaaacaaagggaaaacaaaattgcaatggaaaggaatta

SEQ ID NO: 498480 - DNA, 791 bp, Homo sapiens
  misc_feature (1)..(1): n is a, c, g, or t
  misc_feature (202)..(202): n is a, c, g, or t
  misc_feature (205)..(206): n is a, c, g, or t
  misc_feature (211)..(211): n is a, c, g, or t
  misc_feature (214)..(216): n is a, c, g, or t
  misc_feature (220)..(222): n is a, c, g, or t
  misc_feature (228)..(228): n is a, c, g, or t
  misc_feature (270)..(270): n is a, c, g, or t
  misc_feature (284)..(284): n is a, c, g, or t
  misc_feature (360)..(360): n is a, c, g, or t
  misc_feature (496)..(496): n is a, c, g, or t
  misc_feature (505)..(505): n is a, c, g, or t
  misc_feature (542)..(542): n is a, c, g, or t
  misc_feature (545)..(545): n is a, c, g, or t
  misc_feature (547)..(551): n is a, c, g, or t
  misc_feature (553)..(555): n is a, c, g, or t
  misc_feature (557)..(560): n is a, c, g, or t
  misc_feature (564)..(566): n is a, c, g, or t
  misc_feature (570)..(573): n is a, c, g, or t
  misc_feature (579)..(579): n is a, c, g, or t
  misc_feature (581)..(581): n is a, c, g, or t
  misc_feature (583)..(584): n is a, c, g, or t
  misc_feature (587)..(588): n is a, c, g, or t
  misc_feature (596)..(598): n is a, c, g, or t
  misc_feature (604)..(604): n is a, c, g, or t
  misc_feature (615)..(616): n is a, c, g, or t
  misc_feature (626)..(627): n is a, c, g, or t
  misc_feature (669)..(669): n is a, c, g, or t
  misc_feature (674)..(675): n is a, c, g, or t
  misc_feature (691)..(691): n is a, c, g, or t
  misc_feature (761)..(761): n is a, c, g, or t
ntgcccttctgtggcccatctgcgcaggccgcccaggagcccaccaggggatgggtgtgacccccaagggacaagggcagcaggggcacccgcccgcttctttacaatataaatagcattttcaaacaacataagaatacagtgtcagcgccacgccgggcgagggctgcgtgcagagggacacctccacgttttggctganacnncccanccnnnccgnnnccggcnctctccagggcaaccgcccccctcccccaccaaggaaatganaggcttgctcctgngtaacactctctctgttttccttagtcctctctagcccggggactgttaggacactcttttataatataaacattnctttttttttttttggagacagggtctcgctctgttgcccaggctggagtgcagtggtgcaatctgagctgactgcagcctcaacctcctggactcaagcaatcctcccaccacagcttcccgagtagctgggacnacaggtgcnaaccacaacacctagctaatttgtaaaaaatttgtanccncnnnnncnnncnnnngggnnngggnnnnttttanantnntgnntcagcaannntttgtntttaatataannaaattatctnntccatccctccctggggcaggagacagctaaggtggggaagnctccnnagaaggatgcagaacnggtgagggagaggcacctggagaaggcgcttccagcctgggctgaaggcgttttttctctatcagctcanccactcctaagagcagattccctcaggtga

SEQ ID NO: 498481 - DNA, 141 bp, Homo sapiens
ctaggtgactctgaggatcttacgcgctgatagctcagctccatagatttattacaactgtgattatatgttagtagtgattggcgggcgcgtggctcacgcctgtaatcccagcacttttgggaggccgaggtggcggat

SEQ ID NO: 498482 - DNA, 307 bp, Homo sapiens
gacgacatatacctgtatgctaggatttcaaatatttggtgtctgggcaggatggatctgatgtgacagatatcaaatgcactggtgcgatcccacagtagcaaaggtgatatgctgttgccgagttacttatgtaaagtccatttgtgtcagtatccctggtccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttat

SEQ ID NO: 498483 - DNA, 662 bp, Homo sapiens
tctgaaagcctgtcctgccaagaagttactgatgatgaggtcttagatgcaagctgcttgtagtgatgtcttaagaatgtacatgatggcatgatctcatcatttgaagaacatgtgatgctcacgaattattccatgtcattacctacgtcattgtgaatgatgatgctgagacctgccagcctctgggtcacacattatgttttgatgtgcattccctggatgcagcatgtcatgaaataactcccaaacaaattacctgcctgcacaagagtggtcacctcaccccacatccaatcactggaagtctcaacatccttttcatggaatgactcactagtaatatggtcttgcaaacacttgtgaacaccagagtcctgttcgattttgatacctttgatagcctttcactaagtattccagccgccacatgtgtggtcacccattgaccctgtgaccacttgccttcaccacttcatctcatcagaatcagtgcgggatgttgtgtgtgacaactgtacaaatgattgaatgccaatggaacgttgaacgggtaacatggttggaccaccagaggaacacttttgtaaaacagttaaaactagggcatgctcctcagtgtctctgcatccactacagcggctgactggccagccacggaa

SEQ ID NO: 498484 - DNA, 139 bp, Homo sapiens
tttcatgctttcagtcgatcggataaagacgcactgaagccctgcagtccttcaaagaagcgaactgcgagcaggaaaggacgacacagaagatgtgccacgggcagtgatgatgaacgaaccaccatcaaaaaaggca

SEQ ID NO: 498485 - DNA, 536 bp, Homo sapiens
tccacctgccttggctctcaaagtgctaggattacagacacgagccacggcctgacctgaactgtggggaaaagaaagagagatcagtttgttactgtgtctgtgtaggaagaagtagacataagagactccattttgttctgtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtacccagaggcacactacactgcggaagactgcagggtcctctgcctaggaaagccaggtattgtccaaggtttctccccatgtgatagtctgaaatacagcctcgtgggaagggaaagacctgactgtcccccagccagacacccgtaaagggtctgtgctgaggaggattagtaaaagaggaaggaaggcctctttgcag

SEQ ID NO: 498486 - DNA, 226 bp, Homo sapiens
acggctagcggcattatgtgaacgccatagctgcagcatgccagatccgagtcacagctcatggcaacaccggatccttaacccactgagtggggccaggattgaacccatgtccccttggatactagttgggttcgttactgctaagccatgacagaactcctgaaaagcctattctaccttgtcgccgacaaagggcaagagtgcgttcacttaatgccgctag

SEQ ID NO: 498487 - DNA, 238 bp, Homo sapiens
gctgaatcgctctggtcgtaggggatgaggccatgaagattcttcttggacgagtacagtgagcatgagcacgcgcacctcacagtggcgctgtgtggtgtggaatgtgcacgcagccctgcgaagctctgttgcccattgatgctggtagatggccatttgaagagactccatgtgtccttgtttggttgaaattggaacttggacctatctcttgctggatttcagggggagatcc

SEQ ID NO: 498488 - DNA, 428 bp, Homo sapiens
tccagggtacggaaatgggcaaagaggtaaaagagagaaaggataggaaaacagatcaagataaaacagagggagcaaggaggaaagtagaacaaattcaattagtgaaaataaagccattgtagagcaaagaataacagttggtgaccaaagaagacttccagcaacaaccacagggagagcaaaggacaaaaaaatatcgggcccaacaaaaaacaagtagaaggagactgcaaacagaactgcgaaaaacacaagcataaccggagaccaaaggggaaacctgggaaggcaaagaaagaaagaaaaaaaacaagagcgcctacatcatacaaactggaagagtgcctgaaggctggagaagccctgcaacggtaacaaaaaagagacaccaaggggccagtaacaagacagaaaaagaaggcaaa

SEQ ID NO: 498489 - DNA, 403 bp, Homo sapiens
tctctctctctctctctctctctctctctctctctctctctctagatctatcaacacccaaaaaaaaaaacaaaaaaaaaaaaaaaaaaaacaaaaaaaaagaaaaaaataaaaaaaactatagaaaaatacaaaaatatcaaaaaaaaaaagacaatcatacagataacaaaaacacccaatccatacaaaacactacagacatataaataaatacatagagacagaaacaacaaaagagatagagaaagaaaaaacacacaacagacaaatacacacacccgaccacacacacgacaacacaacaaaagcataaatccacaaaaaaaactagatacaagcaaacaccaaagacaaagagacacaaccatagaaaaaacccacacaatgcacccacagacac

SEQ ID NO: 498490 - DNA, 402 bp, Homo sapiens
gagctattgctacttttttgtactgctcaggcttagtgagaggaaagtctgaattcgaacttgaaactagcacgattctgctttaatgtacttctcactattaagaggatattaaatttgtactcaatagtatgtgtactttataatgtgccaatttctgtgtgtaggtcagaggcttaagatcaaaagcatgtcttgctcatcagaatgaatagagctacatgtggtacgctgcgtactgctcattggaattcgaaacctcagagtgttaggctggctgcctctcttgaactcccttgctctcacctttaactctcagaatgaattcataccaacgtaagagagcaaacctgcacataatcatcatctactctggtttgtgtgttactaaaacaatgaggc

SEQ ID NO: 498491 - DNA, 208 bp, Homo sapiens
acgggtacaaagccctgtctcctgtccttcagcctacccagtagcttggactatggcacgcgccaccatcattccagctagagttctgtatgtttagtttgagacatgggtttcaccatgcttggccaggctggttctcaacactcctgtacctcactgatccacctgtcctcagtcctcccaagggggatcctactagagtacgacc

SEQ ID NO: 498492 - DNA, 284 bp, Homo sapiens
  misc_feature (8)..(8): n is a, c, g, or t
  misc_feature (10)..(10): n is a, c, g, or t
  misc_feature (18)..(18): n is a, c, g, or t
  misc_feature (29)..(29): n is a, c, g, or t
  misc_feature (33)..(33): n is a, c, g, or t
  misc_feature (44)..(44): n is a, c, g, or t
  misc_feature (70)..(70): n is a, c, g, or t
  misc_feature (100)..(100): n is a, c, g, or t
  misc_feature (108)..(108): n is a, c, g, or t
  misc_feature (113)..(113): n is a, c, g, or t
  misc_feature (120)..(120): n is a, c, g, or t
  misc_feature (136)..(136): n is a, c, g, or t
  misc_feature (140)..(140): n is a, c, g, or t
  misc_feature (153)..(153): n is a, c, g, or t
  misc_feature (158)..(158): n is a, c, g, or t
  misc_feature (162)..(162): n is a, c, g, or t
  misc_feature (171)..(171): n is a, c, g, or t
  misc_feature (187)..(187): n is a, c, g, or t
  misc_feature (214)..(214): n is a, c, g, or t
  misc_feature (267)..(267): n is a, c, g, or t
tgaacttntncagaaaantttattaccanaaanatatgaatacncatgaatagtttcccaattctggggnactaagaaagagagtaaaagcaaatttttnaatttttntttanaaaagtntactttaccaattgcncaanaaaaaaagttcanaaatntggngaataaaanattcaaagaatcagcncattttcaaatagaaaattatgaaaanattatgcttttgattttttagtccaataacatggggtttttttcttctttgtntagaatttcatgaaggt

SEQ ID NO: 498493 - DNA, 297 bp, Homo sapiens
aggaaagacgagcaagggggagaggatccctatctaatacagggcccggggaggacgggctagccacaggcagaaaacagaaatgggacccctttcttacacctgaacaaaaattaactcaagagggaataaagacttaaacataaaaccataaaaccataaaccataaaaaccctagaagaaaacctaggcaataccattcaggacataggcatgggcaaagacttcatgactaaagcaccaaaagcaatggcaacaaaagccaaaatggacaaaggggatctaattaaactaaag

SEQ ID NO: 498494 - DNA, 286 bp, Homo sapiens
aggtatatcacggaacatcgtctagatatagtgctaagccgcaaatataagaacatggctatctatatacttggaaaggaagtcacataaataagtcacatgattcaagagtcaaaaagtatgatagaatatgcagtattaatctcccaccctttgtgtcctttgcttatcctgtactctatgagtaggaattttttacatgcttcgcattgatttatcatagctgacagtcttatctctctacttatcctcttagaacttacaatccaatattggctggggtacc

SEQ ID NO: 498495 - DNA, 464 bp, Homo sapiens
agtagtaaacgcctaggtggtagcctaaatagagtagcagctaacttcacatataatatagcgtaagacgctacactagacccagctattcccagtacggggacaaacctagtcgtagaccagactaggttataaaagtggaatacggcccaaccggcggcgggggaagcagggcgggtttggcagtaatatgggcgcgccacattaccgctaaccgacagcaccacctgcaacaagacaagagactaagaatacacaacaagagaagaacagagagaagcggacaatacagaataccactacaaaagggcagcaacaaaaacgagaaaataaccaccaaggaaagtcagggggactcaccggcacgggaaaaaaaaaaaggccgcggcaaaacacgggacaaccccaaaggaacaaaaacaacaggaaaccacaagggaacaaccagagaccacacggataga

SEQ ID NO: 498496 - DNA, 200 bp, Homo sapiens
ttcgggaaaatccctttccagggaggggaggataagtgggatctccccattgattctggcaaaacaatttctaaaatttttttgctttatgtgggaaccagatctaaatccccttttatgctggattttatatcttagttgggtttgaaaacgtttttatttttggaacccccccaaaataaataatggcgtttgttgta

SEQ ID NO: 498497 - DNA, 262 bp, Homo sapiens
  misc_feature (181)..(181): n is a, c, g, or t
ataccatgaaaataactgtgtaggcttcattcaggactggtgatagcgaaacaacaacgacgaaacagcaaaaaacccttgggtagtcaacaacaattgggggagaagaacaattagaggcaagaggttatttttaacgatgtggccacagttcagtctgagtttcccagtagacttttangggcatttcgccataatctattgacgtcatcccatgcagttctgcagatcagcttataagtgaaagtttaacaaggaagat

SEQ ID NO: 498498 - DNA, 424 bp, Homo sapiens
caggaggtctcgtcaggtgcggtgcgtcgggctaaagcacttcgataggtgtacgcgcgctggcggaaaagttcccggtcatctccgtgccccactggccgagaaacagggcaaccggccggttcgaggaagacttcatctctaagcgcaggaagggcctgatctggtggattaaccaacatgggcagccacccagtgctggcgcagtgcgaagtcttccaaacaactttcttgacgtggcccaagcagcaccgaacgaaaaaagcctggaaagcaggggcaaagaagggaagggcccgagaaggaacgaagatgggtggggcgccaaactttctttccctgaccccttaagacaacgcccccccggccggctgcccctttgaccttgccctgccggggggtaccgaaggcttcagaattcggt

SEQ ID NO: 498499 - DNA, 147 bp, Homo sapiens
aagtcttcggaaacatggcttagaagtgatctataatattgagcccattgatgacgtactgtgtccaacagctgaaggaatatgaggggaagactttaggtgtcagtcaccaaatgaaggcctggactttctgggtaccgatgctcg

SEQ ID NO: 498500 - DNA, 249 bp, Homo sapiens
gactcatagaggatcgtggatgaggaacgtactctagacaaaatacatttcttaagagtatacttgaatgattttctcgagaagagaaggaaaagtgagttgttactctgatccttgtaccactactgagcctgccagatgtacctttccaggctagcagcgccagcgcagggctaaaagggctagccttatgctccactggcgctatagggctagcagcttctgacccctaacactcacttaacgcac

SEQ ID NO: 498501 - DNA, 213 bp, Homo sapiens
tgctaggatcacaggtgtaagccaccacacctggccagtctttggaactttgcgtggatctgcccaggtgatgtggtattgattcttaatgttttgggatgcactttgtgggtcaggatttcagaagctggttataggcttttcaagatctttgttccttaatgctagacttacttctatctcagaagccatcgtctctaagggttgcggaac

SEQ ID NO: 498502 - DNA, 1231 bp, Homo sapiens
  misc_feature (1)..(1): n is a, c, g, or t
  misc_feature (648)..(648): n is a, c, g, or t
  misc_feature (726)..(726): n is a, c, g, or t
nccccttttcagtgatgagcgatcaaggaggacagaagaaacgtcgtgagtcgacgatctggtatgtgtgtctcttgacgtctatgacggtgtgatcgtctctctcgagctgattgtttgtctctgctttgcaagttagtcgacgtcgtttttgcctcatgagccgttttgcccgcctccctgtttagtgtgtgtgaccgctctctgtgtgtacaacgtgtttccacaactttacggggggccccgcgttgttcccccccacagggttccccggtcttccaagagtggcccgccctacttctccggggggcccgcgccggccacactggttttccggggggcccctccgcccccccccttcggggcttttgaccctttttcagggcttttggacacacaggaggctgcggccacaagttgctggggtccgggttccctccgccaacccagatttgcttcctggagaaagtcccttgctgggaaatcgaagatttgaggactactttcccgaatttgctcgctacactactcctggaggatgcttactcccgagccccgtagaggacccaccgcgtgaccccgggcccaagtacttcaattcgaagatgagtttttctcgaggattcacgaccctgccacgctggagantggggccgtccacactactggctataccctccacttgtcaccctcggcgcctcgtggagcacctcgaggagaccactnccgcccgctgtgtgttcacaacgagctgtccgctgagaactcccatttcacggcgcacatgcaccctcttcgtcacgtaacgaggctgcttctaaagaaaggggaccccccacaatgttagattataagcctttataggcacccacttatattataaagtgaaaaacgttaattgtacccaagcacgtttatcaccccccctagggcaatgattaaccaagccaccctttctcccttctccccgagtgattttgccgaaaccccccttttccccttcacgcttgtcttagaatgttctccaaatttatgaaagccttaaggccggcctaccagaaaaaggaaaaaaggcccaccaaaagttccctctccactttccagttaaaattaattaaaccaccagccagccacaccaaattaaatgaaattaaagaacaccacaatgaaattaatattgtgttgtgcaagccatttaaaaaaatccaaattaaaatttaatgtgagccca

SEQ ID NO: 498503 - DNA, 163 bp, Homo sapiens
gtagccggaggggcttcatttctgtgggagggcagagaggtaggtggcacagaagatggggctttatgctagtaaatatggatagcactgggcttcctccaacagtcccaattactcgtagccccgctctacttccccgtctttctggtccccccattttcca

SEQ ID NO: 498504 - DNA, 435 bp, Homo sapiens
tgtgatccactgcttggcttccaaagtgcgggattgagacttgagccacataccgtgctgaacactcttttaatggttagccaggccatttacaactctgccttagcccttgcttcctgcttgtgctgagcctaaagatctgggcagaggtgaaagtttagactcttcctaggccgtttcttagcatgtctcctgtccagttgtgcctttctaaatcccaggcgcatgccaggtgcttttcatgtgctccagttcaccacatttagccttggtgcctagttcttcttcccagggcattcaagctgtgtattgtactgtttatgtttctgagataagagtccggcttctgtcacccagccttgagttcaagtggcatgaacactgctcactgcagcttcagtctcttgaggtcaggtgatactcccacttcaggct

SEQ ID NO: 498505 - DNA, 688 bp, Homo sapiens
cgtcaattggcaagttcagtgttctactctagcgcagagcttatacgaagcacaatgtttgcatgagactcatacgagcataaagttcttcaatagcgtgacacattggtgcatctaggtgtaagaagttcagctacatgtttggcatttattagctagtggctggtaagcctgaccgcagacataattgctgcaagctgttaggcccagtatgggtgttactcacagtgctcaccaacataggtcatatcctagtgacataaaacctgttcatcttcgatctatcggttatgtattcaacgggatctacaggctctgcgagacacattcaaaggtgacctaagacaccatcttggacacacaccgatctccaggcacggtagcgtttgtcgccacaccgtacaattcgcgccactactgtgcaacatagacgggtgtgctctttaagctgctcgtaggtagctcgcctgatggctgaggttctagcattagctcaccttacaaagtcgctccaagttaactcgttatgcacatgatatcgaggctagccctcgtcatagcatgagtcgttatcatttcggatcagtcacatcaggtcccatatctactggttcaggtctcactctctaacgccgacacgaaatgcgggtatatggtctggttacagttgccatgtagtaacgttcag

SEQ ID NO: 498506 - DNA, 190 bp, Homo sapiens
atctgaagcattgggtgttggagctggtgactgctcccgctgaattgtgttatcctgcctggagtggtcagacagagtctactggacattgctcagacctgggtgtgagttcctgggtggtggatgctgcactgatcaccagtgaatgcatgttgcttgcgtgtgccctgtgagtgagtggcctgctgtg

SEQ ID NO: 498507 - DNA, 293 bp, Homo sapiens
atttccactggtatacatgccacaacattgattatccttgaaaacattatgctaaatgagaggaaccacattttgttttattcaatttatatataatgtccataatatgctaattacaaaatcaagaaaaatttgtggtggccttaggatggtgagggagtcccttggttttgggggaattagggagtcacatcttatgttttactgtggtttctctctggggttgatgaaaatgaccttcaatggattgtgttgacatgacagtgcgtgaatattctataaactatttaaat

SEQ ID NO: 498508 - DNA, 177 bp, Homo sapiens
tattgtgtgggttttcatgttggcagatgatgaacatggttcctgtttttaaaaactgttcgtaaatgatttcttaggtcgtaatcaatttaaccccagtaaaatgtcttgaattttattttggggtgcaagaatgttcgttttctgtttctttcctgtccttcagttgatttatta

SEQ ID NO: 498509 - DNA, 391 bp, Homo sapiens
tgttttaaaggccgcaggtttctctttttctgtagcagctaaacaagcactagcctcaagataagcagcattgaaacaaccgcagctcctccccctgccgaccctggccccacacccgtgctccaccagccgtaactagagctttccttggacaagagactcgtttcagtaacttttccctgataagagaccctgaccatagacgggttctggctggtttacagagattgcaccctcatgtgccttcatgtcctgaaagtactttttgaggtataccacctaattgtaatacgcttacatgctgccttcaccccaaggtgaacatgggtcatatgtaacatgcatgtttatccagcacacgtgtccgaataaacatgcatgtatattcgca

SEQ ID NO: 498510 - DNA, 272 bp, Homo sapiens
  misc_feature (206)..(206): n is a, c, g, or t
  misc_feature (250)..(250): n is a, c, g, or t
ggaggatcccggtcgcgagaacagtgctagcgagatagttctatccagtactttcgttatttcattggtaacaataggttatagatgaccagacaaagaagtgggtcttaacgtgtaatctgggtacagaatcagataagtttattgacgctagatagaagaacacgagaaaattatttacacttaagtccccattcgtttcacangcagacagcacccaagaagccagtgttaatataacgttatccanagctcacacaggtcaggtggca

SEQ ID NO: 498511 - DNA, 151 bp, Homo sapiens
ctcaagtgaggagcactgatggtgctgtgctggtgggcgccccacaaccctctcccccgacgtcacctgtgatccacatatgttcatgctgtctgactggggatcgtctagatgtctgaccgtgcatgtgcatgcaatgcttgtgcacttg

SEQ ID NO: 498512 - DNA, 355 bp, Homo sapiens
  misc_feature (85)..(85): n is a, c, g, or t
  misc_feature (221)..(221): n is a, c, g, or t
tgccaaaaccgaaacacaacccattcctgagcctggtgccagaacaaggtgtgaaactgacgccgcgtcattatgcctatctganaatttctgaaggctgtaatcaccgctgcaccttctgcattattccgtctatgcgcggcgacctggtgagccgtccgattggcgaagtgttaagtgaagcgaaacgtctggtagatgcgggcgttaaagagattctngtgatctcgcaggatacttccgcctatgggttgatgttaaacatcgtactggcttccacaacggcgagccggtaaaaccagcatggtcagcctgtgcgaacagttatcgaaactggggatctggacacgtctga

SEQ ID NO: 498513 - DNA, 347 bp, Homo sapiens
tcccccccctttgggggctttttcgcagtttttttttttttttttttttttttttttgggaaattaacttttttaacctttcgggggaatttttggaggttagccgggaaaactggggtaaacttgtccaaaaatggggtgggaaggggttttttttttttgggttaaaggaaaagttcctgggggggtttccttttttccttagggggggttttatccctgggcaggggttccggaattggcggttccttttttttggtttccgccggggccctgggaaaagtgagttcctggggggcctaatgggaaaacttatgggcccttttgggggtttttttgaaaccgta

SEQ ID NO: 498514 - DNA, 1028 bp, Homo sapiens
  misc_feature (779)..(779): n is a, c, g, or t
gacctcgcgttaatcggaaccatatggcgaggatgacgagagtggctggtggacgcccgagtctgatctccggggacgagtgaagaggacggggcccattgtgctggtcagactactgaaagctttggggaagaaccgcagtgttgatttcaacccctgatttcgttttcagtgcgaaggaggggacgtacgatggcagctgggccctggctgatgtcatgagccaactcatgaagaagagggccaagccgcgtacgattgagaatgaggaagattgagaaagttctgaaagaaagaggaagaacagaggatacaagaatgccaagtctgtcgaagtttgcgaacacggataacagaagcaaaggaaggctctgaaccaaaggagcatggaagaccttcataggagcaatgatgaggtaaggtctcatcacagcatgacacgcctctgagaactgactactcatcagctgatgagaacatcctcaccaagagcgagatacagctctaaccgtaaagaggatcggaagaaccaacgaagaagaacggccatggaagcagggacggattttttgaaggatgcgtctcagtacgatgaaagacctctcgtaccaggagaatgaacctttcccgcctcttctgaaggccattacaagccatgggcttcaagcgagcccacccgaatccagaaggcggtgcatacctgtgggtctatgggggaatggcatctgtgcctttgcagcactgggaaaggtaaaactgctggcgtttgcctgctgttntgagcgctggtttttaacccggaaggtcagtcaccaggattttggtgtagtgccaccgaaactgggtcggtgtcgctggcccagaggtgtgcgttgacacaccccctctgttgtggggttttttaaacagaagaccctttggaggggacacattaccaggggttatacaaagtactcactacgaaggttataaagggagtgtattcaaaagacatttcacgcccccagaggattagtatatacagcgcg

SEQ ID NO: 498515 - DNA, 149 bp, Homo sapiens
cactgattttctatcctgaaactctactgacttcatttatcagatctaggatctctttggatgaatcttgagggctttctcggtatatgatcatatcatcgatgaaaagtgacagtctgcctttctctttactgatttggatacccttt

SEQ ID NO: 498516 - DNA, 931 bp, Homo sapiens
  misc_feature (55)..(55): n is a, c, g, or t
  misc_feature (83)..(83): n is a, c, g, or t
  misc_feature (109)..(110): n is a, c, g, or t
  misc_feature (113)..(113): n is a, c, g, or t
  misc_feature (117)..(117): n is a, c, g, or t
  misc_feature (155)..(155): n is a, c, g, or t
  misc_feature (169)..(169): n is a, c, g, or t
  misc_feature (172)..(173): n is a, c, g, or t
  misc_feature (188)..(188): n is a, c, g, or t
gtgggatggccgcggcgccctctttctaagtcggcttcgagcacccttcagttcnatggccaagagcccactcgagggcgttncctcctccagaggcctgcacgcgggnncgncccnaaaggctctccatcgaaggcaaattggcctgcatgccnaaagtcttggaaanttnntggatatatgtacgngagccagcacgatggtcctacacattcagacattttcttttgtgagccgctgaaaagtacagtgtggagcctttccgtgaggaaatctcttcctataaacagttcggtcttcagggaagggatggtaaccaaactagacgggacaattatgttaggtattttataacggtattaaaacttctttaaaggtagctagggtatcggtgcaagggcttagcctagttagaaatgggggaaaaagcattggtgtggaccattgtgtaaagtgacaggagttgtaggggtttaccccttttgacaagcttccatagtcttcagacgacggcacattggatggatcccctacagttcttcttcactttgaacttggtaaaaagatgattattggacgctgtaaatcaaagttgtgatattgtctctaataaaggggggttggaagaacccaaaaaagaaaacaacagtatataccaaaaaaaagacttttttggggcgcgcgttgggcgagagaaaattttctaacacacatctgctgtggtgggggccggggggccgaagtattgtacttagaactttggcatataggttgtgcccaaaggggagaagtcttgggggctcagagaatggggtgtgtggtgttctcaaccaaataataaacgccgtcggaaccgagctggttttaaacaatgcagagggggttcgggggttacaggggtatcacacggggccagcggtgttaaccggcg

SEQ ID NO: 498517 - DNA, 298 bp, Homo sapiens
gcctgcctaattttctaatttctgtagagacaacgtctccctatgttgcccaggctggtctcggactcctgggctcaaggaatcttcccactttgggaggccaaggcaggcagatcacctgaagtcaggagttgagaccagcctgctaacatggtgaactccgtctctactaaagcacaaggattgccaggcatcgtggtgggcgcctcaaaaccagatctcggaggcaagcagagcttgcttagcctggagcgaggtgcgtagcaagtctcgcactacctatgcctggtcaagtagc

SEQ ID NO: 498518 - DNA, 290 bp, Homo sapiens
  misc_feature (55)..(55): n is a, c, g, or t
  misc_feature (83)..(83): n is a, c, g, or t
  misc_feature (109)..(110): n is a, c, g, or t
  misc_feature (113)..(113): n is a, c, g, or t
  misc_feature (117)..(117): n is a, c, g, or t
  misc_feature (155)..(155): n is a, c, g, or t
  misc_feature (169)..(169): n is a, c, g, or t
  misc_feature (172)..(173): n is a, c, g, or t
  misc_feature (188)..(188): n is a, c, g, or t
gtgggatggccgcggcgccctctttctaagtcggcttcgagcacccttcagttcnatggccaagagcccactcgagggcgttncctcctccagaggcctgcacgcgggnncgncccnaaaggctctccatcgaaggcaaattggcctgcatgccnaaagtcttggaaanttnntggatatatgtacgngagccagcacgatggtcctacacattcagacattttcttttgagcgctaagtacactgagcctcctgagaactctacaggcaggagcagtcagtcttgagag

SEQ ID NO: 498519 - DNA, 258 bp, Homo sapiens
cccggctgcccccgcaaaggccccagcgcccgaggtttacgcgggccgccccctgctgccattgcttggcggccccttccctttgctcgcgcccccagttcttccgggtttttccccgggcctttccccccgcccccagggcggggccccagggcccgggtgggccctggagcccgtggctgccctgaggctgtggccctgagactgcatcggaggcggcgcccccttttagggccgtggcctttgccaaaactgtaa

SEQ ID NO: 498520 - DNA, 161 bp, Homo sapiens
caggctcagtgtgatcagtattgggtcacatgtcattatctatcaaagtgtcagtattcatattcacacggtgcgcacatttatagacgtgtcaacatgtaagggatcatttatctacagtgagctatgtgtgtttcagtcactgatgataagtcatttcc

SEQ ID NO: 498521 - DNA, 1394 bp, Homo sapiens
tccattaaaagtaaatttatggttggtttaaaaaaaaacaacaagcgggtgcaatatgtggtgcgtgtccaagacatgtgtttggaattcgcttgggtggtcacatctctttctgccgggcttacagtgtgggcaaggctgaacagtgttcctcccaagcccttcagcattcccctttcgtggggctttccattttatatctccttctcctccttatttcttcatattcttattcttctcttttctctatattctccagtatttatatctccttttttctctatatctcgagttcttatatcacctttctctctcttgtggttttcacattacatgtgtgctcttctctccagaagaagtgtggaagaggcttgactccacgggccgtggtggaataagagaacactcctctctccacgtgaatatgtagagaacattttcatcacgtggtgactcattaccttacacaaagggtccatcacagtgcacacatatgccaggccaacatccactacaacaccatcacccggagcggttaaaaactacaacaagaggaaaataagggccaagatagagagaaaacgacctcagagaagcgcacccacacaggtggggaaaaacacccagggtgacacaatacagaagcagtaataaatcccgagagcgcacggggagaaaaagagaaagagagcaaagagcgagacaacaaattcccagcgaaagtaccaggaagcaataacagcagcgggagaaaaacaaggcaagagaaaagtgcgacgaaaactaccaccgcaaacatgaaggacagagaaactatagaaaacaagcaaccaaaagggggacaaaagaaaaaccaaaaaagaaaacggagacatcgggagaacaacccgacgctgtcgacgcagtggcacaacaaaccgaccagggacatcacgaagactcacaccaacaacacacccacacagcaaaccaacaccacacagagcaaaaagagcacacacacagcagagcaaaaggaaccaaacgcaaaatgagaaggggaaacagagacaaaaagaagaaaccggaaccgcagccgcaaaaaaaacaacagtaatacaggagaaaagaaacatctcggatgaaaaaggggcagacaacgagacaacaaacacagacaacgatcgaagaaggagaccgcgagacgaatgacgggatgccggagacggctcgagagccaagggaccagcgcgagacaaaacacaaccgaaagaggaagagagaaacggaaaaaagagagacaaaagggcaacagagacaaagcaggaggaaacaatccgaagtctcgcgaaatagagcgtacaaaggagggagagggacaggaaccggcagagcaacagcagccgacaacaagg

SEQ ID NO: 498522 - DNA, 414 bp, Homo sapiens
  misc_feature (369)..(369): n is a, c, g, or t
cgatagctaccaaccactcgctttccctgtggccttggacactgcatgctggctaggacctctacccgacgcctgctgcctctcgtggcccccaagccaagccgcctgctaccttcatcaccaaattgcactcgctccttcctggaatcctttttcctagcttcaccaccaaatcgttagcgctccttccttcttcctagcttccttcaccaaatcgcactggctcctggactcttttcctatcttcaccacgaactgctgcttgctcgcttgctcctcagtcctagcttcatcaaacactggttcctggaatcctgtctgctgctgtcttcctagattcactgaatccacttctgtgtagcacctggngcagctgccaattaatgctaggcctcaggatttaaaaaatatctt

SEQ ID NO: 498523 - DNA, 649 bp, Homo sapiens
  misc_feature (302)..(302): n is a, c, g, or t
ggccggggcgcggtggctcacgctgtaatcccagctctcagggaggctaagaggcgggaggatagcttgagcccaggagttcgagacctgcctgggcaatatagcgagaccccgttctccagaaaacggaacgaaacaaaaaaaacaccaaaggccacaacaaaaaaaaaaaaaaaaaaaaaaaatgtgtggggggcgcgcctgcggcccggagaaaagttttcaaaaacccttgttgtggggggcggcggggcccccagagaggtgtaagagggaacagagggggcaccacaagcgggtgnccccagaagacaaacaccgcggcgcgacaacgcggaccagagggcggcgtgtgcattttctacaacccaaaatatacaaaaatgagcgcggcggggcgaagcaaccgaggaggctgtttggcgcacagcaacaacctccacggagaggaggacgctgcggagagggacagaaccgcggcgggccttatcaacaccaggcggcggctctaaccaggggagacggcgcggattatataaaaatataaacgccccggccgcggcggggagatcagggaaccacacagaccgagacgcagcactgctacagaatgcatagctactcgagactaagcgcatgactagacgct

SEQ ID NO: 498524 - DNA, 101 bp, Homo sapiens
cccacgcgtccgagctgttgtacgtaatacggaggaactcatcatttttatacaggaccctaatgggaagacccaaattactaatcaattgacataaccca

SEQ ID NO: 498525 - DNA, 127 bp, Homo sapiens
gggctcgagtccgatggagttgggccgtccatgagctgcgccggggacgcgggttttcctgtacgccacatttccgcgccctcgccgtggggcggtgcttcggcgctggggtcttcccttttcactt

SEQ ID NO: 498526 - DNA, 884 bp, Homo sapiens
  misc_feature (303)..(303): n is a, c, g, or t
  misc_feature (305)..(305): n is a, c, g, or t
ccgccgcgagacttctcagtggttgccttggtacagtcgtcagcgccaagaaaatcatttatattttgggcgcgcgcctacctgatgaattcttatataaaatatggacgtcggtgtacctatctagtgggtgtataatattcaaatagaggtcccccttccgtttgtgtggaggtttatgtaaaattgaatgccccgccgctctccgacggttaaaagcgtcgaactcacgcggaggctgtgccgcccctggatgtatataaaacataatcgatgtatgttagccacgccccgttgttgcgngnacaagttcggcctccagcgcttaggttgctccgacacaaagagggtggcaggggggccgactctctcctagggaaaactcttaactctgagagagagagtggtgtgcttctacaaagattaactgagtctatacaaaaaagtctatcgcgtgtctgactctgccagagaatagattgtctcaatatagactccgtgggcgacagatactgttcttcgccctcggtatgtatgtaagtgacccacagcaggcacacagagatctctcctccgctctgtgtctgtctgcctgagtactgtaagatctctagtcacgtgatgaactcttgtctacaggtcaacggtgcgttgtgaagtaccaatatatatgggtctgctcacagctcttactatagggtatccagcgcgtccacttaacgaagtcactcacgtcgtagaccattttcagtctcccgtcatctatcaataaatgtgagttcttctttaacaatgtcgaaagagcagcaatctgaaactggctggctgaatctcgagaaaaggataggaagagcactcatccacccccgcccacaatgacaagc

SEQ ID NO: 498527 - DNA, 220 bp, Homo sapiens
gtgggaagggcagagggagaggcgccagacactaagagccagggctgtacacagggacccttcaggtcaacagctctttattaaacacctgctgcctgctctaggccagatcctagagacgcagggtgagcaagacccgtctctgtccctgagctcttggttggttgggaggtggcccttaaccagatcatcagcacacatggtaaggagtgtgtgacgg

SEQ ID NO: 498528 - DNA, 1426 bp, Homo sapiens
gctattctgatcccatcgatgacacggtgggagctgctacttctattacgtagccttacactcaaatccttcgtctatgtgtgcaccggctaaatctactgtgacctaggcagccatcgatgccatatggctgtgagtgagcctagcatttcactgaaggcttaagctcgtgggtctatggcctatatcaatattcgtctgttctttccctacatacgcccttacttccttgtactcgctgacgtgtagcttgaacgtacgtattcgtcgatagcataccttgtcttgtcaccgctgtatatagcgacagatgtgcccacgtgatgaggggccttggttggctctcttgccatactctcacccttcccctcgttctcacgtcacctacgctcggctcgtccattgctgcgtgataggctgctacgggccgtgcttcccggatcccgtgtcgcaacctggagtctatccttctcacgcttaggccgtgcgcccctatcttacaatcaacgttgaacgcccttctgcatcatcatgctactaccagtcattcattcctttaacttcccctacgctatggtagctcatccgtgctagtgcatatacccgagagcacactacgaaatcttacagtcctacattacatctataatgctcgcttcttaaagaaggccgcctttgcacatacataccctaaagtatccacaaccgtgcccctttcgtcgtcgtactagtacaaatcctcgttttcttaaaatttaaccaaggccggcctcaccgtcaccttgcatcacctggattacttcttcttaccccgttccggtagtcatgacatgggcctgtcagcgttattaaccctaggttaacctgggaacccggcacaaccctgccacattcaccctgccggtgcctgtcgaaacttccgcgctgggaacggctatgggactgaccttcccattctataattacctggactgcaccggtatttcctgtacatttccaaccgggggtcacacccctgaaaaggtctcattataatccccttattactccgtaaaccatagagtttgtgctgaacactacatgtctccccactacttggcatactcctcttccctatatactcccgtcggcagaacacactaacaaacgcacttcttcgacattacctcaagcgtcactcgcttctgggaacttctcttgattcattcccacataagacttttccactcacaatgtccccatatcatttcgctcagaactaccaacccatcattgcatcttaactcccccacttacactcggcgccttgcacaacccactcaatcccactacatccccattctcctacacttggacacccatactccctcccgcccatatccaccaaacactttctaaaaccttcttctccgtcttctccctcctc

SEQ ID NO: 498529 - DNA, 216 bp, Homo sapiens
cgaagtcggcacatgttagctgttttctggggacgctttttatctcattagcacagtgctcctatcctttgctttcacctatagatacagagactccaggaatgaaggcctaactgcactggtaactattcacatactatctttgccaatttcctgtttcctctctttttaaagacctactggaacagaagggaatagaaaaagagagattctaca

SEQ ID NO: 498530 - DNA, 315 bp, Homo sapiens
  misc_feature (15)..(15): n is a, c, g, or t
  misc_feature (106)..(106): n is a, c, g, or t
  misc_feature (149)..(150): n is a, c, g, or t
  misc_feature (155)..(155): n is a, c, g, or t
ccccccccccccgtnaataaaatccccaaaaaaattatgtctcttccccccccggggcccctttcttcccccctagaaagaccattttttagtataagtaccatgnaaaacatttttcccccggataagcctgggtcagattaaaaccnngtganctgccaattaacagcccaatatttccaatcaaccaacaagtcattattaccctcactgtcaacccaacacaggcaggttcataaggaaaggttaaaaaaagtaaaaggaactgggcaatttttaccccgcctgtttaccaaaaacatcccctttggcata

SEQ ID NO: 498531 - DNA, 233 bp, Homo sapiens
  misc_feature (10)..(10): n is a, c, g, or t
  misc_feature (54)..(54): n is a, c, g, or t
  misc_feature (61)..(61): n is a, c, g, or t
  misc_feature (90)..(90): n is a, c, g, or t
  misc_feature (104)..(104): n is a, c, g, or t
  misc_feature (138)..(139): n is a, c, g, or t
  misc_feature (213)..(214): n is a, c, g, or t
tgctggcgangtgaccttcgcagatggaggtaggcagcgggagcgggagctatncctgcgncctcccgcagcggggcccaacagctcgangaggaaggcccatngcggaggaggaggccagccaatggcggcgccagnnaggaaacggagccttgctaacgggcccaacgctggggagcagccaggccaggtggcgggcgcaacttcgagagnnggacgagggcgaggaattt

SEQ ID NO: 498532 - DNA, 387 bp, Homo sapiens
ctgttaggctgcagtgcagttgtcccagccttactgaactgaaaaatgaggtcaataaggtacgcctttgagagtcagcattaacaatcagaggccagatatgtggagttgtctgagatgggaaaaacaaacgcccaggcctgcttgagggtgcaggacgggaggagggtgaggattgaaaaactacctataaggtactatgcttattatatgagttattacaccaaaccctgtgacatgcaatttacctatataaaacacctgtacatgtacccctgaacctaaaattaaaaagtttttttttgttttttggggttttttgagacggagtctcgctctgtcacccaggctggagtgcactgcagcctcctaaaggtacaggctgat

SEQ ID NO: 498533 - DNA, 1035 bp, Homo sapiens
ggaagtggaaactcacagtgtgcagacgcctagaagtgagatatcagcagcagctgtaggcagctcaattccatgggcttcatcaatcgtgagggctaagcctgcagggcctgcattgccacaggatggggagccatcagcgcagctatcgagagactgctggggtcccagactctcctaatccctgggatccagtgccatccatgctcgttcttccccgtccctacgagagtcgcgctattcaggtgttctatctcgtcaaataccctttaactccatcttgctagcgttgtgctcccctacctgtcttctcccttcatccgtttccaaaacgagcagggtgacttgtagaagtgccatgggatcgaaccacccttcagcttctgtctcgaagaaataattggtttaattgattacgtctgctaaatagtactgctttctctccatggtctccttgtgcagctagtggctacttaaaacagtttatacaccaggcaccgttgcattgaactctaaccctccttgaccccaacatgcagcattttgccagtgctattaaagcttagccgttggactgtgccagagatcgagggaggaaccaggctctctgggtttaatgtggatacttagtcttccactctagtagccactaggggatctggtcttatgtttaacttttcggttaactctcttccttgctttttcttccctacccccctaatcccctaagcaccgaaacaaatgctagaatatcttggctctgaacgaggagccagtgaaaccacgtggtaagtgttccttcctcgggccctattccgggtcatcaggcactatcggtgggccactgttgggaacttccggcacgagggagatggccttttcccgttgacacggggattacacacgctcgggcaggaaattacaacagctggggacccaaagaacatgcgtaaagggcgaacagataccacggagaggtggggccccgcatcacaggagaggacacagggaaaccaccttgaacaacgcccggaa

SEQ ID NO: 498534 - DNA, 237 bp, Homo sapiens
tgagatgctagagtcttcatctcttcatgaaggtgcctaacacgaggcatacagtatgctcagtacactgcctcggcgtgctcgattgtaaacaaagcatctatctctgaaagctgattggctatcacggagattcttcgtgctgtggtcaaagattagcccctctcccttgtccagaaaaatgccacttgtatcaacttatctgcctttgtcggcagaattggtacttaaccttat

SEQ ID NO: 498535 - DNA, 265 bp, Homo sapiens
  misc_feature (225)..(225): n is a, c, g, or t
agatcttatgcgtgtgcttagtcgcgccgctcataagagagagctgcacagtcaactgggccgggcaggactgggctccctctgatcgatgaggtggtgagccagagcccgagccctcacacgtctgacttctctgactggtctagttttaatgccaagcagtaccccttggaccaagaggaaggtaagacatgctgccctcttgctggcccagccttctacagncaggcccccggccccagcttcccagggcggccgagcagca

SEQ ID NO: 498536 - DNA, 102 bp, Homo sapiens
gtgagtggacacatccccattccatgactgccggaggaaaagaggagacattcctgtactccccacccattaccgtactccccacgcattcctgtactcccc

SEQ ID NO: 498537 - DNA, 296 bp, Homo sapiens
  misc_feature (241)..(241): n is a, c, g, or t
cgatccacgtagtatgtacaacagaaaacgaagagaaagtttcagatggcataaaatgtggcagtgttctgttcatgcatacatttctgctcccagcaatattaccattattctcctctctgggattacagcctctttcatcaaacacaattcttacccatcctttattataaatccagcttctccattaagcctttcctgtcatagaaaagtaataacacatgccaccattttcatattngttccctttctctttaatatcttacagcacttatttactacataatcccaatcct

SEQ ID NO: 498538 - DNA, 349 bp, Homo sapiens
acctgacgagttgtccgagttatgaatatggaatgaaaggataaattcctgatgtctccattaagctcctgtgtgtaaaatactacatggctaagccgctgctatctaaagtagtgaattcgatcttgaattatatctaacaattttattctgcaaataaagatacatttcttgtatatacatggcgattactacatgaaataaaaaattgagctccaaatagaaaagggctgacccttgataaagacatcttaaattgccaaactgatgtgattacccactgtcagaactagaaacagaaggattaaaagattaagttaaaggaaggataaaagtttagtcaactgct

SEQ ID NO: 498539 - DNA, 542 bp, Homo sapiens
  misc_feature (362)..(362): n is a, c, g, or t
actgctggaccgagcgacgcatgaccccgctcaacctctacctcgacaacgccaaccccgcccaggtgcgcgaagcattggaggattacagcctggcgatcaagcaactggcggcggcgaatatcttccccggcgacatgttgctgaagaactttggcgtcacccgccacggccgcgtggtgttctacgactacgacgaaatctgctttctcaccgaagccaacttccgccatattcccgcgccgcgcacccccgaggatgaaatggcctccgagccctggtattccatcggcccgctggatgtgttccccgaagagttcccgccgttcctgtttgccgacgccgggcagcgccggttgttngatgagctgcatggcgagttgtacaacgctgactactggaagggcctgcaggacgcgattcgtgccggcaaggtgatcgacgtgttcccttataagaggaaagagcagctgctagcggcaagcttcaacagcaagtaaggcagacctgctttcacctgccccttcagcctcggcggtccg

SEQ ID NO: 498540 - DNA, 532 bp, Homo sapiens
  misc_feature (12)..(12): n is a, c, g, or t
acagaattggtnatatatattatataatgtatatatatatattaattttaattcatggagtgctatgtctttgagatcatgtaacagaatttaaaatattagggataaaagatccctggtggatcagtggctgctccaaggaagtgagagtctagattctgagtacagtttgtaagtactgcctggcttattagagccccccatggcagttttgtcatttccataagtctccctatgctgcctctgcttttacttgcatcctctggaatggtttgggagactgacgtgccagagcagtggcaagtgaatggagagttgctgagaaacgtagctcttccttgaacgaactgttccagagttaatggtgatacacaccagtgcaatatttggcttaccccacgaaagaaactgagatctatagagatgtctgaactcacagtagaaacacgggtaatttaacccacctgccacagaggactaaagaatttgtaagtagtttgtcattaggagttccagtgaaataaatgcttaa

SEQ ID NO: 498541 - DNA, 394 bp, Homo sapiens
ttaatatgggaacaccagtttctagctgtcctggaggaaccacaccatatgaaaagttggactcgagcaaggacaacataattagcccaatttagcacctggtttacatggtgtcataattgcaggcccggtggacatgctggacatatgcttagttggttcagggaccatgcagagtgccctgtgtctgcatgcacgtgtaaatgtacgcagttggatacaacggggaatgtggtaccttcagagactgtccagccatagaatgttaccaccttaaaagaacccttcaagtgtggagctttgtagtaggtgtctttcatagctcacaaacatacctcagaacaagccattcatgagttacctgtaatgggaaaataaatcattgtatcagatc

SEQ ID NO: 498542 - DNA, 2003 bp, Homo sapiens
ggaatttataaccaaaattttaaaactatttttatatttttttaaatctttaaaaattttaattactgtgatattgattatacaccttttttatagatgatttgtttaaattatatctggaaaatagagttgatttactttcagacatgaactatacaaacaggatatatttatatggcttgaggtatgttttgtaatagcgttgttctttaagtgtacatcgtaatttgacctaatttaaaaataatatattttcgaagtagtagattctcagatctttattctaacaattacatgatttgaaaacagtactcaatgagactggaaataccttttgtacctaaatgttttttaaattaatcaaaatacattctgtgagatactattaaaagtctcagtaaagtcctattttaaaggttagacactttcagagatcaaggtgctccctatactcccttgttccatcagaagctgcagtgactcttttaggtgattctaattctttcatgccttgaaattaaactatgaaattaaaggcagaaaaactggaaaacctactgcaggtccagagacttctgttttacaactgggaaacagcttgtgtactaaagtaatgagaataaaaatgttggcccaaaattacttttataaataaataattccaaaataatttcttaatttaaaatgatagcacttctcttgcacttaagaatggcatccataagattctgtatttggcatttagactaacttctagatgtatattttaataatagattcataatgttacatttaattgaaaacaaacctttatatccaatgaaaatagtataaacagaatgatttttataccaccttgttaagattggtgcttttggtaacttgtactgacacaacagacatgtgctagtatctgataacattaagtacattttatgtcgtttaatataattatttactttaaaaattgtacttcagaacatcagattttattcacattttttaactcactgaactttaataatcaggtcacctgtactctagtcagcactgtatatattcttggagtttgtacatgggacttagcaaccacactgagtgaggtaaaagcatttgatttcagatctaaaattcgtaacaacctaaatttgagaggtggctgaaatgtgatgaaaagcaatacgaaaagacaatgtaaactttgaaaaggattttagagggaaaattgcatagctttttgtaacatttacttaattttaaaactaaactcatacttttgctatctttttaatatttatctcgtttgggagtatacgtgtttttaaaatttgtgttttctatctgtttactatagtgtagctactggcttcatttaataaaaataaatgattttgaaattaaatataatatagaattcacattttatatagctctctcaaaaattaatttttattccttaagcattttaaaaacattttaaaaaatgttttgtaaatccaggtgtattttaacaattaaatgcctattttgttatatgttatacttttattcttaattctgaattttgacattttcacacaataaaaataatttatatcaatattctgtttctcttttcaattggtagatttaaatgatttcctttgggtaataaaataggtaaagattttaaaatatgattattgaaaaacagtttaaatcagtagattaaaataatgcatttttttgatactttacacacaaaacttttttctctctgcaagtttttatgtatgtgggaaagaatttgtgattttaaatgcagctacaaatagcatttcaccatatgatgttagaggatttgatgtctgtcttgcgttaaagctgttggtcaacagatatgtttttatgtatttaaaagaggctcttgtgtgcctttatgtgtaaaatgcatattacgtagtatacatgatattgtatgtaactgacttcaaatataaaactatgcatagaaacaacaaaaa

SEQ ID NO: 498543 - DNA, 107 bp, Homo sapiens
ggatttgctggtgcagtacaactaggcttactagggacatgcctcagggatactcctcaagtagccatcgctggtagtatatccaaagacaaccatcattcccccta

SEQ ID NO: 498544 - DNA, 1326 bp, Homo sapiens
agagagagagagagagagagagagagagagagagagagagagagagagagagagagagagagagagagagcttctcttgcacttaagaatggcatccataagattctgtatttggcatttagactaacttctagatgtatattttaataatagattcataatgttacatttaattgaaaacaaacctttatatccaatgaaaatagtataaacagaatgatttttataccaccttgttaagattggtgcttttggtaacttgtactgacacaacagacatgtgctagtatctgataacattaagtacattttatgtcgtttaatataattatttactttattaataatcaggtcacctgtactctagtcagcactgtatatattcttggagtttgtacatgggacttagcaaccacactgagtgaggtaaaagcatttgatttcagatctaaaattcgtaacaacctaaatttgagaggtggctgaaatgtgatgaaaagcaatacgaaaagacaatgtaaactttgaaaaggattttagagggaaaattgcatagctttttgtaacatttacttaattttaaaactaaactcatacttttgctatctttttaatatttatctcgtttgggagtatacgtgtttttaaaatttgtgttttctatctgtttactatagtgtagctactggcttcatttaataaaaataaatgattttgaaattaaatataatatagaattcacattttatatagctctctcaaaaattaatttttattccttaagcattttaaaaacattttaaaaaatgttttgtaaatccaggtgtattttaacaattaaatgcctattttgttatatgttatacttttattcttaattctgaattttgacattttcacacaataaaaataatttatatcaatattctgtttctcttttcaattggtagatttaaatgatttcctttgggtaataaaataggtaaagattttaaaatatgattattgaaaaacagtttaaatcagtagattaaaataatgcatttttttgatactttacacacaaaacttttttctctctgcaagtttttatgtatgtgggaaagaatttgtgattttaaatgcagctacaaatagcatttcaccatatgatgttagaggatttgatgtctgtcttgcgttaaagctgttggtcaacagatatgtttttatgtatttaaaagaggctcttgtgtgcctttatgtgtaaaatgcatattacgtagtatacatgatattgtatgtaactgacttcaaatataaaactatgcatagaaacaacaaaaa

SEQ ID NO: 498545 - DNA, 955 bp, Homo sapiens
agcggggatgcgttgctgttgctgtatggtgagccgtgtggcgcggcttctgtgggccggaaccttaaagatagccgacaatggctgaacatactggtgactaactgaagagagatggctgcccgtggaggccaaacactcagtcgagtacagacagaaaggaacatatgaaataacacggaccaacgaaagaatgcactgatgacaatttagtgcaaaaagagaacatcaagagacagcgaagatagaatgacgaagatgaaccgagaagtgatacatagaatatgacaatatacagatcgaatatcagagaatccgtggcaatgcagataatagcaagtaaggatatggagagaataatgcaatatattcgagacgatcaaaatcgaaaagcatatgagatgatagacatggaatgtggaatgataattgagtatatacataaagaatagcaccaaatcaagagccccaatccaataaagaaacaagagaataggaataatatacaagataagtgagacaaaacaaaactacattgatagaaaagagcaagcagcagatgccccaaagcggataagcaaacgaacaagaccagtaacaatgcagagaggaaaaactggaggagaaaatactcggaagaacactaaaggttgaccgaaaaaacaaatactccttggaaattcatgaaagacaacccaggataacacgaaaaagaaacgaaaagggaacattgagggacacgacgtgcttatgaattgaaatcaaaacctgaaaagaaaggcccgcaaggcagaaaccaaatggaaagcaaaaggaattataaccaaagacccccctaaagccccggatattgaatcaaaagaacagaacaaaaacgcaagctaaagaagccgagatcaattgggaccataaaacgagaaacccaaaacaagcaaataaagattacgctggaaac

SEQ ID NO: 498546 - DNA, 362 bp, Homo sapiens
ggataccagtgctactccacaaacaggatcaaaccagagatgaagggatgaaggtgaaaggtgataccaatgatggcggctatgcccaggctggagcaggccagaaggccataatgagcaacttcttcaataagatgaaattgacaaggccaggcacagtggctcgcgcctgtaatcccaactactcgggagggtgaggcaagagaattgcttgaatccgggaggcggaggctgcggtgagccgagatcgtgccactgcactccagcctgggcgacacagtgatgactctgtccaaaagaaaaagaaaaggaatggagttcagaaaggaaaggggcgaagtcttgtttgtggaggtagcact

SEQ ID NO: 498547 - DNA, 109 bp, Homo sapiens
ttttttggagaagtataaagcgttgaggaagtataaagcgttgagagtcatggaatcaatacaggaagcacacagagccagccacactgcagattccgaggagggtcaa

SEQ ID NO: 498548 - DNA, 105 bp, Homo sapiens
tggattccactgaggcaggctgctgcggaagaggcatgaggcacgtgggagagacccccacgggctgaatggccaggcctcagagctaggggctcgttaatgacg

SEQ ID NO: 498549 - DNA, 434 bp, Homo sapiens
tgtggaacccctatcttttactaaaaacacaaaaattagctggctgtgggggcacacacctgcctttccagctacttgagcggctgacgcatgcgaatcatttgataccagcagcggggcctgcagtgcgccgagactgggccattgtaccacagtctggccggcacagcgagaacctgtctcagataaaaacaaggccgggtgcggggtggctcacatctgtaatcccagcactttgggattgccaaggcgagtagatcacctgaggtcagggagtcgagaccagcctggccaacatggtgaaaccccgtctctactaccaatacaaaaattagccgggtgtggtggcacacgcctgtaatcccagctactagagaggctgagggaggagaactgctttgaccctggagatggaggctgaagtgcagtggcac

SEQ ID NO: 498550 - DNA, 289 bp, Homo sapiens
aggacatttagaaagatataggagagatgaaatattccactagtccaggagaaggccataaaactcatatactatacataattttagtatcctatgaaataccaataccgtactgaaataccaagtgttctagatttaaaacttgctttttaagaaatattggcatttgcggctgggtgcggtggctcatgcctgtaatcccagcactttgggaggccgaggcccgcggatcacgaggtcaggagatcgagaccatcctggccaacatggtgagaccccgtctcccaca

SEQ ID NO: 498551 - DNA, 142 bp, Homo sapiens
  misc_feature (113)..(113): n is a, c, g, or t
ggcagcagcgatttctaggatactcagtagaattagaattgtgaagatcatcagtgtagagtgaaggttaatggttgatattgctatggtggtcgcttccaattcggtgcatnagtaggttgcctgaaatcgagccctgcaa

SEQ ID NO: 498552 - DNA, 309 bp, Homo sapiens
atacggatataatactgatctccttttctgagctctccacgttagtatcagacaggtcctccggcctaagattaaggagataaatattccttctccatcttctcctcctacgatgttgacagcaaggtccgttgagccacgatgaagaacatcttatctaggttcccttgtaatttcatcatctccaagtactgctttagaaactggggagtatctggctggagatgcatggtgtctggcccaagacggaagatgggctaacatggttatcaacggaagcaacaaacttacaataaaatccccactatg

SEQ ID NO: 498553 - DNA, 330 bp, Homo sapiens
tcagctcggccctgtgtttgcacaacctagggtcagttttgcaggtggtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcatttttgttctcaacttggggctctccccaacctggggacccttcctta

SEQ ID NO: 498554 - DNA, 170 bp, Homo sapiens
atagcctgaaaatcaaatttacagtaggaaaaaatgcctgggattttgtccacttggtattattgactcacaatgtccaacaagaataatgtggtcacataaacttgatctaatgcatgatggcactgagatattttattatggcttctcaattaattaaatagagaata

SEQ ID NO: 498555 - DNA, 263 bp, Homo sapiens
gctcgaccccactggtcatggcctaatggagactctgtgtgggggttccaacctcacatttcccttctgcactgccgtagcagaggttctccatgaggggtccgcccctgcagcagacttctgcctggacatccaggcgtttccatacattctctgaaatctaggcaaagattctcaaagctcaactcttgtgttctgtgcacccacaagcccaacaccacatggaagctcccaaggcttggggcttgtgtcctctgtcgacg

SEQ ID NO: 498556 - DNA, 343 bp, Homo sapiens
  misc_feature (288)..(288): n is a, c, g, or t
ggaaccaccatatgtttttcagcagctgtaccatccttgcttgcttttctgttttgctcaactaggtaggtctgctgttctcactcatatcaagttaggtcaaatacaattgtttgacactgtggagttcccataatcctctcgaatctcatccaccctgcctctatcaacagtttttttttgactgttctctatctgaacaaacctgttaccgttttggtgggaaaagtgacctaaatgtgaacctgttcttataaaacatccatccctggggttcggtgttgggcnttctatatttatgtggccccggtcttcctgggtccgtgttcttggcctataaaac

SEQ ID NO: 498557 - DNA, 289 bp, Homo sapiens
gagaggtcgatgaagcatcaaatctcttcaggaccaactctactccacatagcttttgagattcagcagctcgtaactcgcttaacccccaataataaaccaactgagagaactctctgtgctagtaaccacgttctcctgatcaaatatcactctcctacttacaggactcaacatactagtcacagccctatactccctctacatatttaccacaaaacaatggggctcactcaaccaccaaattaacaacataaaaccctcattcacacgagaaaacaccctcatg

SEQ ID NO: 498558 - DNA, 260 bp, Homo sapiens
atgaagagatctgcacaagtgcggcatgcccagtgaagccgtatgttacgatcctggtgggatggtccttcacagtcatccttcacagtcatcagtgtgagcagacatcaaactcagaacagccagtgtattgagcaagatgagcaacatgtgggactcctacacacacatacttggctcacgacagtgtcacacatacttggctcacgcacaggtggtgtgctccatcttagactgtcgaccctgcagtgcactgcaat

SEQ ID NO: 498559 - DNA, 660 bp, Homo sapiens
cagctaacggaatataccttggcgactggctggtagaatagatcgtgcccgttcggcttagcgatcgacttatatgatgtcgacggtgtcgcgtcaactcgtaacccgtgttttcccggcgctgggtatttgcctcgaaccatggcgcccaagggcaaagtggcacgagagggaagaagcagatatttgaagcagaacagagagactctgaagtatctacctgcggatcatactggtgggccaatgccatttactgccttgtgacgaaggtcttgcttttactcatctgccatcattttgggcctggttggtcctgggctttagtaactggcagtgtatggggccagctaccactctatagagctcgatggcacgagcagcgtactctgaggatggggacctgatggcatggtggccatggaacctcaacatggagcacggcattggcacgaacaccttaacggatgttgaatcctaactgacaggcatcgtgcagggtgctcaaggctggcttctactacttactatggtctggtccttactggctttgtgggtcccatggcgggtccttttacactacttgtggggtgaactgtgctggggcccatgggttcactagtaaacagtgggaacacaaggaaccagatgacaatgatgaaa

SEQ ID NO: 498560 - DNA, 178 bp, Homo sapiens
gctcgactgcgcacctgtagtcccagctactcgagaggctgaggcagaagaatcgttggacccggaagcagaggttgcagtgagccgagattggaacactggacttcagcctgggtgacagaacgagactccatctcaaaattaattaattaattaattaattaattaattaattaat

SEQ ID NO: 498561 - DNA, 238 bp, Homo sapiens
ccactagcctcatgagtagcttggattacaggcgcccgccaccacgtccagctaatttttgtatttttagtacagacggggtttcaccatgttggtcaggctggtctcaaactcctgacctcaggtgactcaccccgcctcggcctcccaaaggattacaggtgtgagccactgtgcccagccaaatgtgtctgtttctatgtgagcatttgtaggtaatgatgagggtagtggcgtg

SEQ ID NO: 498562 - DNA, 415 bp, Homo sapiens
  misc_feature (309)..(309): n is a, c, g, or t
  misc_feature (318)..(318): n is a, c, g, or t
  misc_feature (329)..(329): n is a, c, g, or t
  misc_feature (355)..(355): n is a, c, g, or t
  misc_feature (373)..(373): n is a, c, g, or t
  misc_feature (387)..(387): n is a, c, g, or t
  misc_feature (406)..(406): n is a, c, g, or t
tgagtcagagtcttactttgtcatccaggctttcccaggctcaagtgatcctcccacctcaggctcccaaatagctgggaccactggctaattttttatagagatgggggtctcgctgtgttgctgaggctggtcccagactcatagggctcaagcccttcaccctcctcaggcctcccaaagtgctagggattacagggtgtgaggccaccacacccaggcctttaatggcacattttaaaaacttggaatttgtccattaaagtgtataggaaaaggtactgggaggcactatttcatccaaggcanttttattanttttggcacanttttttttttttcaggctcttctggnggtaaaggggtggggggngttaaatcagggcnggcacccggcattgggggntttggggcc

SEQ ID NO: 498563 - DNA, 854 bp, Homo sapiens
ggcgccgccgccgcccgcctcagcccaacatggcgatgcacaacaaggcggcgccgccgaagatcccggcacacccggcggagctggcggagctccgtgaagggggaagcaggagctgccggaaacttgtggcaaattgtggagcgacagatctatgcttttggagggaagctaccctggaaagacacctcagatgtttggcaatattattcgtggtgggatccggtatctgaccaaccaaaaaaaattccaatagcaaaagtgatcgagggaacccggaagttaaaggaagctgagggggtcttcagtaaatcctgcggttacctcagcagctgcagtaagtgcatgtgccaggagtccaggaccagctcatggaaacagagggagccagcgaaagtgggacggaaagtgactctttctccagatttccacaattcaggaaatatgagcccagccagggaggaccctgaggatctggatggctctgtgcagggagtgaacctcagaggctgttcttctacttcctcagggagtcaccaccagcagcataaaagcgaaagaataaaacccgccacagggattgctctgagttaacaaaaaaccacgaggtggctattagaagacccttagtggcgaagctccaggtgtgagcctgttccttttttgactcaaaggttaattctcactgagtggtggctccccttgtttccagacagtgtcgtgattggtttgtctccctggtgccacccccttggggccggcgtcctttgcttgacgagcggggggactggtccccggtggggggccctaagggtcccagggggtgccccatctgttggcccaccggcggtttc

SEQ ID NO: 498564 - DNA, 382 bp, Homo sapiens
ctgacatctataggatccccgcatagcttcatagtgaggatgagctctatcttcaaaagtactaaaagaccaatgttaccttaccataggccttaattccaacttagatccatctccctccaatcacggtagtccatgctacctgggacactagtttatgtgaattctgatttaccttattgtagacttgctgcctacttcgtcatgactgttagaaccctggccttcttcgtggctttccttcctttggcttaggtttgctaaagctagaagattcaattgctctttacagacttatgaggaagatagactttgtaacgcagatgtcacttctcatgccagccctgccctggttagctcttctggaggaatactgctgctg

SEQ ID NO: 498565 - DNA, 409 bp, Homo sapiens
gcaagaccctgccaaggagagtctgagctcagacacgctagctccacccccacctgatggtccttccctatgcaccctggcaggaagacaaagggcaaataaatcttgggagttctagggccccgcccactgctggttcctccccatataaccacagatgatgctttctggaaaggaccacctcctggcaggaggccaaccagcaaaaaaaatagaccattaacccaccaaaagctccattgtaccctctgccacctcacacgaacaggcactggtagccatggctgagagacccatagatgtttcacattacaggactctgcagataacctccagtaccagcctgaaactgggaagatcgctgggtggctagacccaggcatgtggactgacccaggatgtgggactg

SEQ ID NO: 498566 - DNA, 744 bp, Homo sapiens
  misc_feature (285)..(286): n is a, c, g, or t
tggcgctagtgcagcttcagccggagcgggtaggggtctcgctcgctagcttgctgtttctcggagaagctcccgagtgtccggcctaaggccatgagaaggcagtgggggtctgccatgagggcggcgagcaggcgggctgcatggtgagcgcctcccgggccggacagcccgaggcgggcccgtggagctgcagcggggtaatcctgagccgtagcccgggcctggtgctttgccacgggggcatcttcgtccccttcctgcgagctggcagcgaagtcctgnncgcggcggcgccgtcttcctgcctggcgacagttgcatgggactgacctgcgcctgcactgtgcatgtgtgtgccccaactggccgctgggtccctgtggggcgtgcgctggagctggggccgcccatgtggctgtgcactgccccagtgcgccatgcctctgagccctggcccatcctgcccctgtccctgctgggctgtccccgtgcagcccctggcttcctgtctgagcttgctgctgcatgctgagcttgcctggcttcttgggcccacattcgcgcgcctcttcgcgggactgatggcatgcggaacatgtggctgcttctcgatgcgctggctgctgggattgactgaagtgtcggatgtgacgaggatggtggatcaattgagagctgctggtgatggtttggcgctgctgggcagtgcggctaggccaaggaggagtgtgggatgtgaag

SEQ ID NO: 498567 - DNA, 898 bp, Homo sapiens
gtctaccatttaggtctcagtaaacacgtgtagttaggcctgtagtagtctgagccaacaagcgtctgagacataaaacccgtgctgctgtatagagtgaaatagattggacgtcctagaaaggaattcaaactgtcctattagcagtggaaagtccacatgggctaatactaactacttgatgcgttgaaggttggtcaacactgtggagacacccagtatctttggtaatctcttaatgtggattcccctttttcacaggttggccaggtgactcttcgttggagttgacttgacaattacttggtttccctaaaacgaccggagatttacatggcacgtatgtggccacgggggctcatgaggtaggcgtccggaatgtcacctcttgcttgggggacatttccatggaccgccacattggtccttgtccactttaaaataacgctgtggagaattgtctgttcactgctatctccaaatggaaactaagaactcaggatttggaaagttaagttctttgttcggtagctgcacgaggcttgtacaccagcttctatgtttccccttccaatataattccttttaccgacgcaagggaataactacttaccataagggcccgccccaagggtgatacaatcggtttgaaaaaccctttaaaagagtagttacccaaggagccattaaaattgcgacctggtgtccttgtccaataattcttattctatcctaattgattcccaagaacttgactgggctaatagaaatctagctgcagtttgcgcaatgggaagtaattgaaggcaacatacacgttgtttgccacagagacccaaatggagtgacccttaaggtaaacactgagacaggttactggtcagattcgcgggagaag

SEQ ID NO: 498568 - DNA, 114 bp, Homo sapiens
tgacattctgaatgcttctagtaaataccaattttttttattaggattggtggccctttcaatgggcttaaattttctctgaggggaagctagcttttgctttgccaatttgaa

SEQ ID NO: 498569 - DNA, 262 bp, Homo sapiens
cttgtaaccgcacgctagttacatccgttgttctatgtatacaccattccaaatttaaaaaggcacccggcccacaccccgaagtctcctcaccccggaaatattcttcctttcccacaggaccaacctcgctgtgcctaacaagaattccagaagtcacccatccgaaaggcactggcccatgacactctccacttccaatcttaaatcttttactctcataccttgtctcagatctctcctggtaccccttccccacgcc

SEQ ID NO: 498570 - DNA, 144 bp, Homo sapiens
gggccagatttctatggaccagcaataaaaatgagagttccaggctgaaaaacttagtacacacaagatctggttattgtatgtggaactgactggaaacaaagtagaagcctactaagatttgaagaataacattggcaaaga

SEQ ID NO: 498571 - DNA, 103 bp, Homo sapiens
tctatcagtgactcttccttttcgtgtccgagtgtacaaaacgtttccgcctcacagagaagcctgaaagcccacgggctgcagcacattgggaagcggtcag

SEQ ID NO: 498572 - DNA, 448 bp, Homo sapiens
  misc_feature (4)..(4): n is a, c, g, or t
  misc_feature (6)..(6): n is a, c, g, or t
  misc_feature (49)..(50): n is a, c, g, or t
  misc_feature (399)..(399): n is a, c, g, or t
tcgncntctaactttattagcctgaactcctccctgccagccccagggnngtcaccatgggcacagtgagcaggactgaggttagacaggtttggcccctggctctggcagcttgggacagccaagccaagggaacaacaggtgcaaaagtccaaatgttggcacttcaggtgtggccggtacccagccaggccacaaggtggatcggcgcaccatggtcctcttctggcaaagggtccactatggcaacattccttcccggacagctgctaggaacagttggtgattttagccagaaactgctgtgcccaccactcatcgaggtcaataggtacaaagttctgtagccggggatcaggagtgctctccacatactgcagcagcgtgggccactctcantcgcagggccgccatccagttgtcgctctacctgctgccaggcttcgga

SEQ ID NO: 498573 - DNA, 644 bp, Homo sapiens
actatgatgtttatggattatttaaaattcttaaaactgacttaactctttaaaaattatcttcttggctgggattataggcacgagccacctcgcccggcctgacaaatagttttttaaatcagtaaaactgtgtttatgattttgataaatatgccttctattaaataacaaggcagaattgctaagtttcctaactaaaatgacccctgataatcagtttttttcagccatagatcttcattcactggtcttttcaaaaataaatgatgatttttaaaaatcaggtttctgaactacgctagtttgcatggtcttttgttttccagaaactgccaaaatccttctattgtgcttattttcaaataattgtctctaaaattctagaaatattccctttaaacaacagaacacatttgaacagaatgaacaagtaagcaaactaaaaaaccaagaactaaaaacatggagtccatgaccagcctgggcaacacagtgaaacacgaaaccctgtctctacaaaaaaatacaaaaaactggctgggcaccgtggctcacgcctgaagtcccagcattttgggaggctgaggcgagtggatcacctgaggtcaggagttcgaggccagcctgaaaaacttggagaa

SEQ ID NO: 498574 - DNA, 353 bp, Homo sapiens
  misc_feature (32)..(32): n is a, c, g, or t
  misc_feature (65)..(65): n is a, c, g, or t
  misc_feature (74)..(74): n is a, c, g, or t
  misc_feature (339)..(339): n is a, c, g, or t
accaaggttaaatgaagttaggactgggattngggtatctggtattaagatgtatgttggttttngcccatggnttctgcttcagaactcccatagcccttgctacagtcctttgttataatgttgggtgtattaagcctcaggaaacagaatctctctcctttcctttcatctaccccaaagcaggactctaatcttcccttgcctttctaattgtgggtcttaagaccctccccagagaggatcccatcctatacactggaggaaagaatgctgacatcatgaagcttccataaaaaccaagaggactggatttggagagcttcatgagacgtgaanacacggaagttccc

SEQ ID NO: 498575 - DNA, 416 bp, Homo sapiens
  misc_feature (22)..(22): n is a, c, g, or t
  misc_feature (146)..(146): n is a, c, g, or t
  misc_feature (401)..(401): n is a, c, g, or t
gctgttgaaaatttgggggccnagaaagtccttggttgtgggggtccttgctgtgccacggtggggatgtgtagcaagcatcccttgccctctgcccattcattccctgccccatgacagtgacaacccaagactgtctcccaganatttcccacatgtattgtcccgtaggggttaaagctaccttctacttcccatgagaatgactgatccatagtacagtcccacctagggagttgtgccatgatttgcaaagttatttacccttactaaaggtactgctaagctaggtctctaatctaaaatatggaacaaaatttcacaagaggcagctgaaaaaagttttatattatcctgtttgcaatagggaatgcagttacctttaaaaaacctgaagtacntatcatagctgacag

SEQ ID NO: 498576 - DNA, 135 bp, Homo sapiens
ccatttggcggaagcgactcgtcgctgcgtcgaacgccagaattctcaacactttgcgatatgccgatcggtatcggaattggcggatggctgcaaatctgtcggcctcaaggaccgcaagcagatgcgcgtgcg

SEQ ID NO: 498577 - DNA, 200 bp, Homo sapiens
gatctgcatgctgatcttgtagaggacataaaagccagtcagattcagtgaggattcaaaagctggtacaacaaaattcttttacaaaatattaatttattattgaaaacctggaaagattatccaagggaaggtaaacgaaagagaaaaggaggccagggttcttcgtgtgcctctcacagcgggtatccgagctcgaa

SEQ ID NO: 498578 - DNA, 344 bp, Homo sapiens
gggcgtggtggctcacacctgtaatcccaacattttggagaccatcctgggcaacttggtgaagccccgtctctactaaaaaaaaacacacacaaaaagcatctgtactagaaataatgccttctgtggattgaagtgaacaataatttattctatatttcaaaatagctagaagagaagatatgaaatggtcccaacacacaaaaaaagataaatgtttgagttgatgggtatcctaattaccctgacttgattgttagaaattgtatacatgtatacatatgtacaaacctgcactttgtgcacatgtaccctaaaacttacagtataataaaaaaaaaaga

SEQ ID NO: 498579 - DNA, 1125 bp, Homo sapiens
ggaacgccggagagtcggtctctccccttctactgcctccaacacggcggctggctgtgctggctggcacatccatgggaccctgggcctggttttaaaccatccctgtccagctgccgtcactgcaccccaccgtgagcccagagagctcctgtgagtgcctgctgtgcgtgagtgcatgcctgttctggaggattattacgtcttctccccgattcctgctgcctgccgcatgccaggcctctgcgctgctgaggacgacagcaggcccagtcgcctcgcacaccatccagtcagcctgcctgcatgcagcccattaccacggctagcggtcccagatgccaacgcggccggcagcagcgcaggtggcatcacgctaccgccaagtccacgagcccatttcccatcctgcacgaagcaagcccctgccaccatgcagcttctgccatctactctcctcgcttcttcttcagcgcacagcgctcccacgacatgcacagccatcatcaacagcgatccgtctacccgaacacacacacgcgcacgactacctcacgaaggacctgcgcactccgacctctcacaacctcgcacctactacttcccgccacacaccactcatctgcctacttggcgcactccccctgacccacacgcacctcgcacacggccgtactcccacccacaccacacccactagaactcactctccatccaccgcctcccccacccacaccacccccatacccaccccaccctccacatcacacaccactccacacacccccccacaccaccccccctcacccccccccacactcccaccaccacccaccccccccccacccttcctctctccacccactactcccgcaccctccccccatcaccatatcccaccacccacccacctccccacacttcccgccccccatacccacctcacccccccctcccctcccctccacacacaccactcacccaccaccaccctccccacaccctccaccactacccactcgcaacccactcacaccttcctacaccaccctcccctccctacccaccctacatatcccaccaaccctccctcccccacccctcatctcacacaaccccaacctc

SEQ ID NO: 498580 - DNA, 1012 bp, Homo sapiens
cacttttaagacaatgaagcattatcaaaacaagaatgtataattgtcttaatatgaataataagattaagcgtttaaatgctatttgtagtcttgatcatacagcaagatcaacatataattcagggttggtcttttgttattttaggttgttttcatgttgcaatgttctatatcgttcattagttaatttgtgatattttattagtattttggaaatagcatatctgagacgtgaagcagaacattgcacaattcacttagtttgtggtttttttcgtcagctattctgagcttatttatttatttgtatgttctaatggctaaacattagccttaacaggatttttgttcccaagaaagaaaaaaacaaaaagagaaaacaaaaacaaaggaaaaacaaagacaaaagaacaagagagagaagaaagaaaaaaaagaagggcgaggggggggcgataaaaaacacataactactcaagaagcacaacacagaaaaaagcagacaataaacaaaggacatacaaatggaagcaaacaacaaagagcgaagaacaccaacatataaacaaacgaaacaacaaagaaaacacgaaaacaaagaaaccaccagcacacagcaaatcgaacaaacaaaacagcagaaacaaacaagagcgacacaaaaacaaagcagagaaaaacagaagcagaagaacaaatgacaaaaggaagaaaacgcacaaaataaatagaaaatgtaaacacacaacacagaaaaaacgaaagagaacaaaggaacacaaaaaccacgcaaaaaacaaaacagaccaaaaaaaaaaaagaaagggagcacaggagaaagcacctagactcgcgaccgcaccagagacgacaacgaagcaaagagagagcgaagaaaacgacacaggaaaacgcaaaaaaatgcgaaaggaggagaggacgataaggaaaaggactaacagcaataaaacaaacagaagaaaagaccaagcagagatcaccgaacata

SEQ ID NO: 498581 - DNA, 105 bp, Homo sapiens
  misc_feature (1)..(1): n is a, c, g, or t
nctaatgagcttacctaaataaggagataataatgaatatgaagagctagccgccacagagagaaggctccagcactgctcaatgtcagagcgcagctcactcgt

SEQ ID NO: 498582 - DNA, 482 bp, Homo sapiens
  misc_feature (137)..(138): n is a, c, g, or t
  misc_feature (140)..(140): n is a, c, g, or t
  misc_feature (166)..(166): n is a, c, g, or t
  misc_feature (228)..(228): n is a, c, g, or t
  misc_feature (238)..(238): n is a, c, g, or t
  misc_feature (300)..(301): n is a, c, g, or t
  misc_feature (323)..(323): n is a, c, g, or t
  misc_feature (359)..(359): n is a, c, g, or t
  misc_feature (471)..(471): n is a, c, g, or t
tccttcccccacccccggggcccatcccggtggcggctccggagctcgggactgctaatttcagcgaaacgattaaaagacgcccctacagctgacggcactttctctcctccggcaggaaggacgtccagcgtacnncngcccgcgcttccccgccggcgcaganaggcctcacagaatcgcacgccgctggacgcacgccgccccgcccccacggcccagcgccancgcgccccgnttctgcacgcaatcccggcctcacttgcccctcgactcctgttccgttggaggggcctgagnnaagccttgaagccgcgttgttnggccggaaggaaagccggagaagaccgggtcgactngggcaagagcggcagaatggttcgaaggaagcctgctcttgcacgcccagggagtagaagttggggcagggagcaagggtcacgtgaaggaagcgcgccgaacttgaacttngggtccgactt

SEQ ID NO: 498583 - DNA, 132 bp, Homo sapiens
ctggacatatgaaagtgccttcctacccccaggtgagtacctggtgtgttgtgactgccggggctcatgtgctagctattcccctccagaccaggtctggtcaaggaccctggggtgggaggcaaggatcgg

SEQ ID NO: 498584 - DNA, 753 bp, Homo sapiens
gcatgagggttgagtggggctaaggactgccgcatagtgtaccgagtctgagggggggagcccctcttttttagtgggggcgtacagtgacgccccaagggttgcccacgcggcgctgaaaataatggttcgaatagaaattgcctcccgcggttgatgaaaattaagctaacgacgaggaatgattgcctgccatgaacgcttaagggcctcataggtgttgccgtttcgtggcatggacagtccttggtgtgcacctctgaataatccctccggtcatacaatacatggtgtcaagatgagtattgttcactaccacactctcgtttgggcgattctactttaacgtgtctgacgccatctcacgacgcttcggtcattacgcgctgagcgctaacctccctcctcactgtttcagtacccctcggggggaggacactctgtctactctatggtacgtgtgctaccccctctcttcccgcctggagtctacaacagcacgggcttacgactacgtactggctactacggacactatttttgcgcccccgaagagatctcgttatttaaatggttttcccgccgacgtcacccgggggtgcaccacgcgcctcccacccaggtccgcatactaggcaatcgtccggtgaagcaccagtgagaacctccccgatattcttaacaactccttcgccctcgatttgcctcatgctcctaccccaaatttacgagggtttcccgcaaacatggacg

SEQ ID NO: 498585 - DNA, 100 bp, Homo sapiens
ctctactcaataaatcacagtcacactacataaagagccacaggatgacatcagtcccataagtcttaagtcctggtgtagtgtaggatgacaagcagaa

SEQ ID NO: 498586 - DNA, 161 bp, Homo sapiens
actctgaggatcccttctgatgtcctgctaggggtctggggttcttactgggatgatgaaagtattctagaaatagataatggtgatgcttgcccaaccttgtgaatctactgaaaaccactgaagtgtacacttcagagagggtgaattttagtggcata

SEQ ID NO: 498587 - DNA, 413 bp, Homo sapiens
gcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcataggaacattaaaaatttactgaaagaaatctcttggggtggcccggtacccaattagcactattttgaccctgattacgcgcgctctctgtccgtcgttttacaacgcctcgactgggaaaactcatgtgatacccaacttaatcgcg

SEQ ID NO: 498588 - DNA, 3164 bp, Homo sapiens
  misc_feature (3038)..(3038): n is a, c, g, or t
  misc_feature (3041)..(3042): n is a, c, g, or t
  misc_feature (3044)..(3044): n is a, c, g, or t
  misc_feature (3047)..(3047): n is a, c, g, or t
  misc_feature (3050)..(3050): n is a, c, g, or t
  misc_feature (3052)..(3053): n is a, c, g, or t
  misc_feature (3061)..(3061): n is a, c, g, or t
  misc_feature (3073)..(3073): n is a, c, g, or t
  misc_feature (3078)..(3078): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498589 - DNA, 3164 bp, Homo sapiens
  misc_feature (3038)..(3038): n is a, c, g, or t
  misc_feature (3041)..(3042): n is a, c, g, or t
  misc_feature (3044)..(3044): n is a, c, g, or t
  misc_feature (3047)..(3047): n is a, c, g, or t
  misc_feature (3050)..(3050): n is a, c, g, or t
  misc_feature (3052)..(3053): n is a, c, g, or t
  misc_feature (3061)..(3061): n is a, c, g, or t
  misc_feature (3073)..(3073): n is a, c, g, or t
  misc_feature (3078)..(3078): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498590 - DNA, 1370 bp, Homo sapiens
tggtcaaatgatcctttattgaatgtgttttctccttgtgtggtgcgttaacgtggcgtgggcattctccacagcaccactgtggtggagtgtcactcgaatgagtatcatgaggagtgggggccatcaagcatttacagcccatgtgacgtgggacaggtccccaggaatcttctttatcaagtggttctccagaagaagtttctgcgtggctagaggatatcgtgttgccgactatcttggtcgaagaccaagtggttgcacaaatcttcagtcaagagaggtgaattatctcccgaacgtgtgtgtttagagtggtttttccgtgtgtgtctccttctctcgtaggtctctcgtgtgagaggagatctctctgtgtgagaggggctgttgttgcgatgatactcccggggcgagagatggccaagaagaggggccacccacctctcaaactcgtgggggcccgtggctggtgactccgtgacaagtggctcggattcttcatcggtgggtaaattcgcgttcaagggcccctctttcacaggtatccacccctgtgtgtgctcctttgtggagcaaaaagtgttcatctcaaacgccagatgcttatcttttgtggggggacagacgaagaacccccaagggggcgcccagaatctttgtggagggccaaaggggcacaaacagggggacccccgaagatttcaccactctcgcgcgggttggcacccctcacaggattattcaaccgaatctttggggatccctgcgtgagggcggctcccgcacaccttcgcgagccgcgccccattgtgatggcaacacgcgcggacttagagttgtccgcgtatatagaaacccgcggaaattccgggggaaccagaacccagaaagcagaacagttttgccccccgtgtgaggccttccctcccagaagccccagggactatacctttaatcaaccttcggggcccaaatctcccaagcgcgtttctccctttaaaatccccctacgagaactctcttctttaatgaccctgacatggttagactccgatatcgccggggaggttccagcaaaacaccaacgtcactgtacaaaggggaacaacgaaagacccttgggagcaaaaccaagcgagcgcacaacgcaagccaggagcccgggttccacccgagagacaaccaatcggaggcgctaccaccccatacaggagccgggacaaaaccccccaaggagacgcccaaaggcccaacaacggcataagcgagaacaaaaagagcgccaacacacaccactcaaccgagccaacagccccacgagcacaccaacacaaccacaccacgtccatgagcgagaagaaccacat

SEQ ID NO: 498591 - DNA, 3548 bp, Homo sapiens
  misc_feature (3422)..(3422): n is a, c, g, or t
  misc_feature (3425)..(3426): n is a, c, g, or t
  misc_feature (3428)..(3428): n is a, c, g, or t
  misc_feature (3431)..(3431): n is a, c, g, or t
  misc_feature (3434)..(3434): n is a, c, g, or t
  misc_feature (3436)..(3437): n is a, c, g, or t
  misc_feature (3445)..(3445): n is a, c, g, or t
  misc_feature (3457)..(3457): n is a, c, g, or t
  misc_feature (3462)..(3462): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtaagtgtgtgttttcaaatattggctttggcaagcttacttaactttcattaaaacatccactaagcttagatatttgcatattttatttgttattatatagaatgatacagatttaggcatgaaattctcaaaaatgctgatatccataacttaatgtaacgcaaaggaaaagcaagtagtagcagttacaaccaaacaaatatgaacattcgtaacattggatggttgatatgcgttctgcaatatccccactacagagaatctgtgatgtagaattgagccaggtgacattgactgctaaggtcacagtttcttttctcgctccaggtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498592 - DNA, 227 bp, Homo sapiens
  misc_feature (128)..(128): n is a, c, g, or t
ttcaccaggaccagatcgatgacatcatcatcatgtttttttcaacaaggggttgtggaacagagtgatgatgatagtcatcggtcaggctcctgctgaagactcccctcctcccatagctccaaaanctgtgacaattccagctagtcaggtatgcacacaaaatctgaagactttgtaaaccttttggtggcccacgtagcatactcgagtctggtcctgagtga

SEQ ID NO: 498593 - DNA, 105 bp, Homo sapiens
gtgatctagaggatcccgactgatctgtgctctgttcaaagggagacaggcaggttacgagatgtcaaacagtaaacgagatttctccctgagataactagaaag

SEQ ID NO: 498594 - DNA, 3517 bp, Homo sapiens
  misc_feature (3391)..(3391): n is a, c, g, or t
  misc_feature (3394)..(3395): n is a, c, g, or t
  misc_feature (3397)..(3397): n is a, c, g, or t
  misc_feature (3400)..(3400): n is a, c, g, or t
  misc_feature (3403)..(3403): n is a, c, g, or t
  misc_feature (3405)..(3406): n is a, c, g, or t
  misc_feature (3414)..(3414): n is a, c, g, or t
  misc_feature (3426)..(3426): n is a, c, g, or t
  misc_feature (3431)..(3431): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggtacgcggccggctgggataggggtcgcgggcgggctttggtcgcgcagcagccggtcctccccggaggtaggcgggcgcgggccctgttgggtctttgggacgcgggtcccgctggggccggggatgctgctcgctgtgagcgcgggtcccgtccgccgctggccccgggcgggcgcacgggggtctaaccttggggggcggcgctgccgcctggcccgggtgccggggttcgcgtcccgcggggccttcctcgctctttgtctcttctgagtgaacttgatgacccccttcttccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498595 - DNA, 126 bp, Homo sapiens
ccagaatacagtgaaaaagaaagaacaaagaaatggaacagactgaagaatagaaagagagactcaagaattcctatttctaaaaatgttcataatattgaatgtacattacaccgtcatatctct

SEQ ID NO: 498596 - DNA, 3287 bp, Homo sapiens
  misc_feature (3161)..(3161): n is a, c, g, or t
  misc_feature (3164)..(3165): n is a, c, g, or t
  misc_feature (3167)..(3167): n is a, c, g, or t
  misc_feature (3170)..(3170): n is a, c, g, or t
  misc_feature (3173)..(3173): n is a, c, g, or t
  misc_feature (3175)..(3176): n is a, c, g, or t
  misc_feature (3184)..(3184): n is a, c, g, or t
  misc_feature (3196)..(3196): n is a, c, g, or t
  misc_feature (3201)..(3201): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggtacgcggccggctgggataggggtcgcgggcgggctttggtcgcgcagcagccggtcctccccggagggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498597 - DNA, 164 bp, Homo sapiens
tgattaaggttgactaagttaatctcattgatggctcatcagagaatgagaatagccagccagtgctgttttacaaatgcactggagggaaaaacgaaatacatctactattccctaatatatatggcttggcacccatgagaaaagcctctagccccccgaaa

SEQ ID NO: 498598 - DNA, 430 bp, Homo sapiens
agtattcaagctttcatatagtagattctgtataccacgagcaggatggagtgaatggcccttggtatagcctagtaacagtgctaaaaatcccagagctaggtaacggttcatagagccttacataaggctattcttcagggactgacatgtgtcaggtgcgcttagcgtcagtacgcagcatgagagaatagcgcctagggattctgtaggatgtagagaatctcatgttgctttaccaggtgtagactctatacacttgtcgatcgaataagggaaagtgctcccattcgcagttaatgcagcatattgggtctcaaggcacttaggttatcatgtgagcatccctgagggaataatatgccacttaagaggaaatacaggccactccagtctcaatctcacaaggactgctactccttgggtcata

SEQ ID NO: 498599 - DNA, 3855 bp, Homo sapiens
  misc_feature (564)..(564): n is a, c, g, or t
  misc_feature (710)..(711): n is a, c, g, or t
  misc_feature (758)..(759): n is a, c, g, or t
  misc_feature (771)..(771): n is a, c, g, or t
  misc_feature (3729)..(3729): n is a, c, g, or t
  misc_feature (3732)..(3733): n is a, c, g, or t
  misc_feature (3735)..(3735): n is a, c, g, or t
  misc_feature (3738)..(3738): n is a, c, g, or t
  misc_feature (3741)..(3741): n is a, c, g, or t
  misc_feature (3743)..(3744): n is a, c, g, or t
  misc_feature (3752)..(3752): n is a, c, g, or t
  misc_feature (3764)..(3764): n is a, c, g, or t
  misc_feature (3769)..(3769): n is a, c, g, or t
aagacaacgatcccagaggaggaggcgagcatactgctacaaaatacccaagcagggcggggcctttgccaaaagagtctccgtggcccctagagcgggccccagggtagttgctaacggttcagcaagaaattgaccttttctgcagccacctacctaagtggcagaggaaccccaacctctggcagacggtccgcatcccccatgtatggcaggagtgtacaggcgcgtcgggtcaccggggggccatgcctcggagaacccgattgcagctctccctgcacatcggtccaatgtcagcttccagacctggagctccagacgcgggcctgggggtcatctgaatgtaaccttcactttagagtcaccatactctcataatctgcactgttttaataaaatcttagtaattctctgtaaggagacggcgagtgaccatggaaatatttcatctcgtgcagggtctcattgtttatctcatggcgaaaatatacttttttaatggttggatgtaaacatgaactcaaacacgttttatttattaagatacaacctgaaccacanaaacaaggagatcaaagatgaagtggcttagacagaagtttcagtctctctccccagactgtctggaggtgagtggatggcgcttcatgaggttgctggggacccctgtctgctgggtctcttgctctgttgtcctgttacgacanncggtgcatggcatggcacatggtcggcatggtagatgctgggttgcnnccacacccacantcccttggggggcggcgctgccgcctggcccgggtgccggggttcgcgtcccgcggggccttcctcgctctttgtctcttctgagtgaacttgatgacccccttcttccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498600 - DNA, 131 bp, Homo sapiens
tgctgcgattacaggcatgagccaccgagcctgaacagtcacactttgaaaaagcagtgacagctcctatgcgtgtctgtgcttacgtgtgtatgttgaacgccgagaaattcagtggagatacatgcaac

SEQ ID NO: 498601 - DNA, 616 bp, Homo sapiens
gggccggtgtccgcctctacggtctggaacctgctcaccccttgctctacagccgcttggctcctccagcaccacctgctgcggacccgggaacccctcaccttctcagcaagaccccaccgggagcccttttgggggcaccacctccgcttgtgcccgccccccggcccagttccccagactaggggcccgtgggcgcagctcgggactgacatggtgaggggaacagggggggggtcaggggcagaaggtgccatctcccctgaccgtgttagccaggtcctaggggctgagcgtgtgaagcgcaggactgggagaggcagaggtcagtaagcctcaccagccacctctgaggtcatggaacctgggaacagaagcctcaacccccacaagaccaagcatcacatggagtgtagggtcactgggagagcagaggtcacagcctctagagaagggagaggggcgtgtgcatgggactgtggctcatctcgggggccatggggcctcctgaggtacacctatgcccctgtaacgggcctctaggccctgggcctgcctacccaagggctcactaagccagaggccaaagtgcccactcccgttacacctaccagcc

SEQ ID NO: 498602 - DNA, 2214 bp, Homo sapiens
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaccatctgaccttgtatctcttgatatttatttttttaacgtgtgagcgcttgggagatcctctaga

SEQ ID NO: 498603 - DNA, 121 bp, Homo sapiens
ggctgccttgaggacccgcgcagaggaggtgtgccccctttgctgtcagtgctgtccagctgtccacctcctctgtgctgtccacctcctctgtgctgtccagcctcctctgtgctgtcca

SEQ ID NO: 498604 - DNA, 3248 bp, Homo sapiens
  misc_feature (3122)..(3122): n is a, c, g, or t
  misc_feature (3125)..(3126): n is a, c, g, or t
  misc_feature (3128)..(3128): n is a, c, g, or t
  misc_feature (3131)..(3131): n is a, c, g, or t
  misc_feature (3134)..(3134): n is a, c, g, or t
  misc_feature (3136)..(3137): n is a, c, g, or t
  misc_feature (3145)..(3145): n is a, c, g, or t
  misc_feature (3157)..(3157): n is a, c, g, or t
  misc_feature (3162)..(3162): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctgtatccttaattttctgtgctacgtccagaaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498605 - DNA, 2195 bp, Homo sapiens
  misc_feature (2032)..(2032): n is a, c, g, or t
  misc_feature (2063)..(2063): n is a, c, g, or t
  misc_feature (2090)..(2091): n is a, c, g, or t
  misc_feature (2124)..(2124): n is a, c, g, or t
  misc_feature (2171)..(2171): n is a, c, g, or t
  misc_feature (2195)..(2195): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtcacatgatcattaatgcatagccatacagactaatngaagattggtctaactcaagtcatgatatanaccatctgagctgatcctaatataatnnttaacgggaatgtcagaaggtctcatcatcagnctgctgaggactcgcatgatctttcagtggaagtcttcggtacactnactgaccctactcgaaactcagtn

SEQ ID NO: 498606 - DNA, 325 bp, Homo sapiens
tttccgattaagagtgcttgagttaaatgcatctgttgaacgtggaatacaagtcgttcgagagaaagtgaaaaattctgctcactcaactgtctccagcagtcgctcagatgggcaagccgcgtccgccttttaagattgtgattctgtatgaagcacattctatgacctcccctgctcacgctaccttcaagacctaccatgtacccagcgatcgaaaaccacccgattctgtcttatctgtaactatttcactccccttaatcgaccccctgacctctccatgttcaaaattccgcttccagcctctgtcagcacctctcat

SEQ ID NO: 498607 - DNA, 3617 bp, Homo sapiens
  misc_feature (3491)..(3491): n is a, c, g, or t
  misc_feature (3494)..(3495): n is a, c, g, or t
  misc_feature (3497)..(3497): n is a, c, g, or t
  misc_feature (3500)..(3500): n is a, c, g, or t
  misc_feature (3503)..(3503): n is a, c, g, or t
  misc_feature (3505)..(3506): n is a, c, g, or t
  misc_feature (3514)..(3514): n is a, c, g, or t
  misc_feature (3526)..(3526): n is a, c, g, or t
  misc_feature (3531)..(3531): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggtacgcggccggctgggataggggtcgcgggcgggctttggtcgcgcagcagccggtcctccccggagggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtaagtgtgtgttttcaaatattggctttggcaagcttacttaactttcattaaaacatccactaagcttagatatttgcatattttatttgttattatatagaatgatacagatttaggcatgaaattctcaaaaatgctgatatccataacttaatgtaacgcaaaggaaaagcaagtagtagcagttacaaccaaacaaatatgaacattcgtaacattggatggttgatatgcgttctgcaatatccccactacagagaatctgtgatgtagaattgagccaggtgacattgactgctaaggtcacagtttcttttctcgctccaggtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498608 - DNA, 321 bp, Homo sapiens
aagcacatggaatgaggtctcatgactaccaacccaacaccacactcatattgtatgaacgtatatctggagcttagaggacagcacttaataaggacccaagggagtgtgacctccaccagctgcaaaacgaggctggggcttttacaagctccattaacaatatccaggcttttaaaaaaaaatctcatttcactctgttttccaacataattcctaaaatgatcctttttaatatctaacactttccaaatgttcgctctgtacttacaaaccccgccccattccaacccaatctactttctttggattgagtgattg

SEQ ID NO: 498609 - DNA, 211 bp, Homo sapiens
  misc_feature (12)..(12): n is a, c, g, or t
  misc_feature (63)..(63): n is a, c, g, or t
  misc_feature (77)..(77): n is a, c, g, or t
  misc_feature (161)..(161): n is a, c, g, or t
  misc_feature (170)..(170): n is a, c, g, or t
ccagcagcggcnaggcgccacacctaagaggggggccatgggttgctggtgcgcttccactgngcagggttatgcgntcccggggagaggccccccacgcgcgcctgcggcgtttcgcgtgcctgcgcggctttcgcctaaccgcgttctgcggcgggggncatctacgncctcggtcctcggccctccgtccgtccgtcggaactccccg

SEQ ID NO: 498610 - DNA, 476 bp, Homo sapiens
  misc_feature (36)..(36): n is a, c, g, or t
  misc_feature (92)..(92): n is a, c, g, or t
  misc_feature (127)..(127): n is a, c, g, or t
  misc_feature (248)..(248): n is a, c, g, or t
  misc_feature (464)..(464): n is a, c, g, or t
tagttccacgggcccctatgcggacatttgcaagtnccggctcggagtcgggtagccccagggggtggttgggccccggtggagcaataacnattcactgcagtgtggcttgctggaagccccccancctaacggggagtgcatcacatcaaggggaccaccaacgtggtacaaaagaatctgaacaacagcccttgagttccagatttttccactgaaatagtctacccaaatgagaaggaatcagnaaagtaattctggtaatatgacaaggtaataaaacaaggttctataacatccccaaaagaccacactagctccccagcaatgggtaataaaacaaggttctataacatccccaaaagaccacactagctccccagcaatgggtccaaatcaagaagtctctgaattgcgaaataaataactcagaaggttgattattaagctactcagggagatanccagggaaaggt

SEQ ID NO: 498611 - DNA, 685 bp, Homo sapiens
ggtcaaaatggctgcgcccagcgtgcgcgggtatcctctgaagttggggttcaagattcttgcccgtgagagcgaacgagcctgccgtacttcgtgattttgaaacacctgggtctgggcttcccgggcgagcggtggaacctgtgagaacgtttctacaatggtgggctcagctctcaggagaggtgcccatgcgatatgtctagctggtgagtaaggccagtcacatctccagaggcatcagcagccgaggcctgggcgatcgaggcctcctgacagtgagagatgtgccacccaaagagctccaggcagtcgtgggtggagcgggctgggcaaatcctacccttcaggacgaccacaggaacatcacccggaaggtcctcagcagagtaggcaggaaccgtgcacaagcaggagcatcaccctctgtggctgatcaaggagagggtgaatggagcagccttctacacagtcagttactgtgggcctgcttttgggagcccgttgttctcggtgctacagagatagctattctaccaagatgagtcgacgagtctggcagaactttgatcagcctgctcatcccagctgatcaccccagtcacggaagaagggggacaactattacctgaatcggactcgcatgctgagagcgcacacgtctgcacaccagtgggacttggta

SEQ ID NO: 498612 - DNA, 274 bp, Homo sapiens
tggaaaaaaaaatgtctcagcaggcatgcttgggagatcagatgtggtaggcaggcctcggggtcctttccttgaagcagagcactggccaaatcatggcagagcagcaagggtaaaaatgccctcttggccaagtgcctcatgtatgtgcctcctctgctttgtcacttggcagccgggctgacacaggcaccacattggtttggtggaccttggacgaccccagtgatgctggacacgtgaccgtgcgggtactagaacgtcacgcaggggc

SEQ ID NO: 498613 - DNA, 200 bp, Homo sapiens
gctagactaaaaaaaaacttgtttacacacaactgaaaatagaatcttacttgataatacaaaagctaccatcagaagaaatcccttcaggatcattaacgccacttcctattgctctgacattttctaatagtacgttttaaagttattcattaagatcaccgtgaaaacaaattccaaacagagaaccacacacgtac

SEQ ID NO: 498614 - DNA, 335 bp, Homo sapiens
ttcatggtggctcatgcctgtataccccagcatgaggctgagatgggtggatcaccgaaggtcaggagttcaagaccagcctagccaacatggtgaaaccccatctctgctaaaaacacaaaaattagccaggtgtggtggtgggtgcccgtaagcccagctacttgggaggctgaggcaggagaattgcttgaacccgggaggtggaggttgcaatgagctgagatcatgccactgcactccagcctgggtgacagaacgagactctgtctcacaaaaataagtaaagctagacccagtggtgtagaggtggaacgtacttctcatcagccttt

SEQ ID NO: 498615 - DNA, 224 bp, Homo sapiens
gaagcgcacgatggttcccacccgatgagcacagccgaacgcctgaacgcagacatacttcctaatttctacaccctaagtaggctcctttcccctaatcattcgcattaattttacattcaaaacaccttaggctcattaaaacattctaattaattcactcttcattggcccaagaaattatcaaattccttgagcccaaaaacttaataatgacctagctt

SEQ ID NO: 498616 - DNA, 611 bp, Homo sapiens
  misc_feature (91)..(91): n is a, c, g, or t
  misc_feature (202)..(202): n is a, c, g, or t
cgggtctcatcactcccctggggaagaggtgccacgcgccagtgtgggcgcccagtcacttgggttcagcaccacaaggattaggatgganatgacctgctccttcccccccacggctcccatgcagcaaggtcgggggaccccgctgagtaccccctgggctcgggccccgtttgttgggggacctgcgggcagccccccnacaaggcatttgccaagggctcaggagcccaggtggggggacccatttccttggggttttttgcccccagggtcccggtcccttgcagctcccccagggtggggggcaggggggggggcagcttcggggacaatttggtcccccgctcctcccttttggggaaatccagcccccgaacccaaagcccccaaaattgcagcatcatgtattttggggcccccccgggcggggggggggggggaggcttccggggtcccccccccctcaagccccccccccgccccgcccgtcatggggggggggttgaagccaaaaaaaaaaaaccccttgggtttttttttttggatttttttttttaaaaaaaggtattttttccagggggtttaaattgaaggaaaaacccaagcca

SEQ ID NO: 498617 - DNA, 344 bp, Homo sapiens
taactaaaggtggaaaaactctaccattagatcatttaaggaccaagctttatcaaacgcccacttcttattggatgttctgaatggtatcgcgccgggctatgttgattatgatctagtcacccctggtaacaccgaggaagaaaggtacgcaaacgcaagattggctatttctattgctagaaagttgggtgctttgatttggttggtgccagaagatatcaacgaagttcgtgcaagattaattattacttttatcgcttcgttaatgactttgaacaaatgagccaacatacaactttcgtaacctgttttctactcagctttcttgttccaatgctccg

SEQ ID NO: 498618 - DNA, 151 bp, Homo sapiens
gaggaggctgaggaggaggtggctagagcttcagtcactggggaaagcagggaacagtgtgactcttattcatccagctgtctgtggctgtccactgtgtgcacttgctgttttccctgtccacatccatgctgtacagacaccaccatta

SEQ ID NO: 498619 - DNA, 383 bp, Homo sapiens
  misc_feature (1)..(1): n is a, c, g, or t
  misc_feature (355)..(355): n is a, c, g, or t
  misc_feature (367)..(367): n is a, c, g, or t
nattcggcatgaggtgtttggaagacagtgctgccagtgtttttctggtaattcctctttagatgctgtcattttcagaagaagctgatgtaaatgcctctacaacctaaagcccaggtgagctatgttgccttggtttgattatctaacgattccttaatctaacattgcaataagactgtgaagtagaagacagaaacttttttgtctatggtattagaagacagaagccctgggtgctgcttttaggggcagcatgtatcttttccttctccaagctggctggaggaagtgttctcaaagtgctgtggggaaaagaaaccatcatgattcatttatgtggaatatcagatangtaaattattanggactttgagcaaacc

SEQ ID NO: 498620 - DNA, 185 bp, Homo sapiens
ttgctatctttatcagaaagatcagaatcagaatctgaaaggtcataaaaacgtttcaagtactctgcagtgctatggttaatgtggtaccctcttatccacagcatagttcaacttgaacttttttttttgagatggaatcttgcactccagcctgggggacacgacgggatccgtctcaaaaa

SEQ ID NO: 498621 - DNA, 1012 bp, Homo sapiens
  misc_feature (332)..(332): n is a, c, g, or t
gggcaggcatctgattgtcttacacagtcatttgcagtccccagctgccctatatagcagcatggcctgatgtgcacatagatcagttagcctatgtgagataacagaaagacttgaatgttggtgcccagcgactggtccatacgctgaccgctagagatattgtgtccgccagaggtcttgaccaatcagattgcgctagcagttaccagtgagtgagaatgagatcttgtgaggcctgaatagcccagtggagcgattcactaggtaggaacgctaggtcaagcccgtaaggaaaatagcaagccctgatagcacacaataatttcttnctatgcaagggcagtggtacgagcctggactattttgccctctggatagtgcaaatctgtcgggactcgtccgtgacttctgattaccaacatgtttatacttatcctaagtgttgtcttttctcattgtgatatttcgtgctacgttctgtctctcctcatatctacctgggagcccacagccgtgaattacggtatgaatcatgatgaatactgttaccatttcctggtagcacttgcagtttcaggtaagtgcttgcggggccattactcaggttatgtgacgtgatttgcacaagcagagcacctatgggaagtcctatcaggtatatgatgctgtgggtctggtaataacctttgtgttggctaaactggtgtactgtctgtcgtgtgtcgtgtgtctggtggccactgtgttgtgacgacgacgacgacgaggagacgacgacctttggaaccaaatcagaattggtgtccgggaatgtgttgcaggccttagggatacggggattcatggacctgttttggttaccagcaataggaaagtcgactcagggattgccttcctcttggaccaggctttggcaccttagcaggtttcaccctccaggtactgactattacgcaaaacggatttggggcccactgtcggaagtcggcttaccagatgccggcaaaaa

SEQ ID NO: 498622 - DNA, 636 bp, Homo sapiens
cacacggggatatgagtgcagcatgacacatttctgtccgatctgccacggtgatgatatactagtagtgtcagatgttcgaggacgacggtgatgacacatctctaggatagtgacctggatccagaggagctggcaggagtcagggagacatcagggtctaagggaccaaaagcgtatgcgacttactagaatgtgcaagatagatacagagtgaggaggaggaggagaatccactagctggataccactaggacaggaaaaggcagaaactagcagagaagaacaagccaacctagtgagttctacaaagaggcagacttatgactagaggatacaggaggacgatgccgatgagagccactggcagatacaagtacaggacccagctgttatatctgagaaccgggcggacagggacggaatgcaatacacagcaagaaagacagcgagctgccaacaagacaccacacacttatcctgttttgacacagaccaagaagactaactgtactaccccatggtaccagagagtgacaagccccctaaggggaacgagacggatatctacagagggaaaagaaagcatggccacttggcacttgaaaggaggaagaaaaagagataggcatctaa

SEQ ID NO: 498623 - DNA, 135 bp, Homo sapiens
gttaacgggcacctttggcgtaacacccacaaccgcgcgcttatgcggccctacaagggcgtcctgtgccggattttctcttccccttggggggggttttcaccccaagaccgtcactccgttgcagcatttacg

SEQ ID NO: 498624 - DNA, 873 bp, Homo sapiens
agcggcgctcgcctgcggcgctgctggctccagaccgccctccggtatcgcgaccctgtcggaatggtattaggctatatcttcatgctgggcttcatcaccaggccgttcctcacagattcctgtcccttcttgtgttccatggtatgtccggtataccgtctagacatcatctagctaccttgggtgcctccagccctaggctcccagagcctcatggcgttatctccttcattccatccatgctcggaacatgcaccctggctggcattgtgtgctcagggtaactatcggtagcagccgagtagcaagcaactagtaacttataacaactagtgatgcttgagcgtggattccgagaacggctgcgcagacctgggggtgccttgcctaggcattatcccatgccgtgatggccattcttcgactctcattgtgcgaccgggagactccctgacatgaccactgcatacgaccccgaggtctagaaacctacttggtgctggggaacaacattgttcgcgacatgacaggtacaaccccgagacatttgcctgcggggacattggttgggatctcgtggggcttgtcgccttttgcggttggctttcgcaatgatgccattgggccaaaagactgggtgatgccaggatcctccgggaataaaattctgtagcatatattggtggcacaatgaactagcctagaaatacaagtctaaagaggagaccatgttcacgttcggggcgcaccttaaccagcgaacacgaagccaccatcctcgcagttgcacggttaagaagaattccccactggccacggtgcggacctaaatgttgttggacctgccactctccttgccaatggccttgg

SEQ ID NO: 498625 - DNA, 621 bp, Homo sapiens
atcagtgaagaagccctaagagcagatggctttggagacaatccttctattccctgtttggtagcagagaatctttcagcgcccgggaagcttctggggccctgcgtggtgggctatgggatatactatttcatctacagtacatggaagggacgcaccctttatctggaggatatctatgtgatgccggaatatcggggtcaagggattggttcccaaataatcaaaaaggtggcttaggtggccttggataagggctgctcccaattccgcctggccgtcctggactggaaccagagggccatggacttgttcaaggccctaggagcccaagattttacggaaacttagggctggccctttttttgctttcaaggaaaggcaaccagaaagttggcaggaaagtgacgccctccctaggaggatttctgtttttagtttttccttccccatcagctgaagcccttttcaaagactacgtccccagacccttatgcttaggcctccctggaggaaggagggttaggggtgcctatcctccagtattggaaaagcaaaatttagggagagaccttttttccttgtttagggtgaaaaataaataaaaatttcatgtcctta

SEQ ID NO: 498626 - DNA, 163 bp, Homo sapiens
cctgatatcaaagaactaggttctccagggatattttaaatttcccactggacattcacgagtggatatcacaggtgtataatgatcagtgtcttttgttcaaaatgttagcaagggttgttaactgatatagtaaatttcatcaccaatggcaatcaagctt

SEQ ID NO: 498627 - DNA, 325 bp, Homo sapiens
caagactttcaggattaagcgattcctggccaaaaaacaaaagcaaaattgtccccttcccccgggggttgggatgaaaactggaaataaaatcggggccccctcccaaaggggcccttggagaaaaacccagctgggtttttaaggaattgcccatgaaagggcccccatttttttgctgtttgaaggtcccggtcatgttcccaaatcaagctgaaaatgtcccccccatttggggattttgaggggttttcctctttgaatttgttatgaacccgttggtgggggggattcagtaataaaaatgtaaggcctttttttttta

SEQ ID NO: 498628 - DNA, 2926 bp, Homo sapiens
  misc_feature (2800)..(2800): n is a, c, g, or t
  misc_feature (2803)..(2804): n is a, c, g, or t
  misc_feature (2806)..(2806): n is a, c, g, or t
  misc_feature (2809)..(2809): n is a, c, g, or t
  misc_feature (2812)..(2812): n is a, c, g, or t
  misc_feature (2814)..(2815): n is a, c, g, or t
  misc_feature (2823)..(2823): n is a, c, g, or t
  misc_feature (2835)..(2835): n is a, c, g, or t
  misc_feature (2840)..(2840): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctggtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498629 - DNA, 212 bp, Homo sapiens
aggtaattgaatcactgaatcatcattatcgtgagaaaagcaggtctttcacatgcttttctcctgatagtgaataaggctcaagagatctgatggttttataagtgggagtttccctgcacaacctctctctctctctttgcctcctgccattcatgtaagacatgacttactcctctttgccttccaccatgattgtgaggcctccctag

SEQ ID NO: 498630 - DNA, 2603 bp, Homo sapiens
  misc_feature (2477)..(2477): n is a, c, g, or t
  misc_feature (2480)..(2481): n is a, c, g, or t
  misc_feature (2483)..(2483): n is a, c, g, or t
  misc_feature (2486)..(2486): n is a, c, g, or t
  misc_feature (2489)..(2489): n is a, c, g, or t
  misc_feature (2491)..(2492): n is a, c, g, or t
  misc_feature (2500)..(2500): n is a, c, g, or t
  misc_feature (2512)..(2512): n is a, c, g, or t
  misc_feature (2517)..(2517): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagaagtggccttgggctggggatcaccatagcttttctagctacgctgatcacgcagtttctcgtgtataatggtgtctatcagtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498631 - DNA, 3225 bp, Homo sapiens
  misc_feature (3099)..(3099): n is a, c, g, or t
  misc_feature (3102)..(3103): n is a, c, g, or t
  misc_feature (3105)..(3105): n is a, c, g, or t
  misc_feature (3108)..(3108): n is a, c, g, or t
  misc_feature (3111)..(3111): n is a, c, g, or t
  misc_feature (3113)..(3114): n is a, c, g, or t
  misc_feature (3122)..(3122): n is a, c, g, or t
  misc_feature (3134)..(3134): n is a, c, g, or t
  misc_feature (3139)..(3139): n is a, c, g, or t
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggtacgcggccggctgggataggggtcgcgggcgggctttggtcgcgcagcagccggtcctccccggaggtaggcgggcgcgggccctgttgggtctttgggacgcgggtcccgctggggccggggatgctgctcgctgtgagcgcgggtcccgtccgccgctggccccgggcgggcgcacgggggtctaaccttggggggcggcgctgccgcctggcccgggtgccggggttcgcgtcccgcggggccttcctcgctctttgtctcttctgagtgaacttgatgacccccttcttccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctggtatacatccccagatttcctctatattcgttcttggctcccttgtatatttttctcaggaggcgtcacggtggggaacataggacgacagttagctatgggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498632 - DNA, 2449 bp, Homo sapiens
  misc_feature (80)..(80): n is a, c, g, or t
  misc_feature (123)..(123): n is a, c, g, or t
  misc_feature (262)..(262): n is a, c, g, or t
  misc_feature (2323)..(2323): n is a, c, g, or t
  misc_feature (2326)..(2327): n is a, c, g, or t
  misc_feature (2329)..(2329): n is a, c, g, or t
  misc_feature (2332)..(2332): n is a, c, g, or t
  misc_feature (2335)..(2335): n is a, c, g, or t
  misc_feature (2337)..(2338): n is a, c, g, or t
  misc_feature (2346)..(2346): n is a, c, g, or t
  misc_feature (2358)..(2358): n is a, c, g, or t
  misc_feature (2363)..(2363): n is a, c, g, or t
cacttacataacgggctttatataagggcctcagcagcgtaatttcacctgaggcagagaattatcctaattttgcaggngagagctgtggctcacggggccagagccatgaagacggcgcangggagctgggagagctggcctcggtctccagttctctgcacatgtcccacctctcaatcttgttgcttcagtcaaagaaagtgtcaatatttcccatgttaggacctacttaattggtaattaaaatatttatacattnagtgctaattttctctttccttttttttttcctttctacacatagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtcaactgcttgtcattcctcccgtggcagtttgtgtagacaatcttactgagcaaaaggcaatgaaaagtcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498633 - DNA, 1591 bp, Homo sapiens
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctgctgttgttggcctactgtacccctgtatcgacagtcacctcggagaaccccacaaatttaagagagaatgggccagtgtcatgcgctgcatagcagtttttgttggcattaaccacgccagtgctaaattggattttgccaataatgtccagctgtccttgactttagcagccctatctttgggcctttggtggacatttgatcgttccagaagtggccttgggctggggatcaccatagcttttctagctacgctgatcacgcagtttctcgtgtataatggtgtctatcagtaagtgtgtgttttcaaatattggctttggcaagcttacttaactttcattaaaacatccactaagcttagatatttgcatattttatttgttattatatagaatgatacagatttaggcatgaaattctcaaaaatgctgatatccataacttaatgtaacgcaaaggaaaagcaagtagtagcagttacaaccaaacaaatatgaacattcgtaacattggatggttgatatgcgttctgcaatatccccactacagagaatctgtgatgtagaattgagccaggtgacattgactgctaaggtcacagtttcttttctcgctccaggtatacatccccagatttcctctatattcgttcttggctcccttgtatatttttctcaggaggcgtcacggtggggaacataggacgacagttagctatggtaagtgacatgcatccatttaatcttctacacattcgccgtcatctttacccttgatccgactgacttgtccttgattcccttccacttggcgtacatatattctggttcagaattccagtgacagtacctgtgaaaagctatatgaaacactacgtctgagtacccgcaatccttgaaactaa

SEQ ID NO: 498634 - DNA, 187 bp, Homo sapiens
cagaaaatcactcacagacatccccctgcctcagaaaatcactcacagtcatccccctgcctcagaaaatcactcacagtcatccccctgcctcagaaaatcactcactctcatcctcctgcctcagaaaatcactcacaatcatccccctgcgtcagaaaatcactcactgtcatcccgtcgacgc

SEQ ID NO: 498635 - DNA, 1104 bp, Homo sapiens
  misc_feature (978)..(978): n is a, c, g, or t
  misc_feature (981)..(982): n is a, c, g, or t
  misc_feature (984)..(984): n is a, c, g, or t
  misc_feature (987)..(987): n is a, c, g, or t
  misc_feature (990)..(990): n is a, c, g, or t
  misc_feature (992)..(993): n is a, c, g, or t
  misc_feature (1001)..(1001): n is a, c, g, or t
  misc_feature (1013)..(1013): n is a, c, g, or t
  misc_feature (1018)..(1018): n is a, c, g, or t
ccccgggctgcaggaattcgggcacgagatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaaaaaaaaaaaaaaaaaaaaaanatnntntgnggngnntcgggccngaaaaagttttnaaccnttcgttggggcggggccccagtggttgtgcacccgggccaaggtgttcccaaggaaaaccccggccgaaaatggggtggggttccc

SEQ ID NO: 498636 - DNA, 833 bp, Homo sapiens
gcggccgcctcaccagaccgcgtgcggacgggctcgcgggcggggcggggcaagctcaggccacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgcacagcgcgaggcgccgaggccccccgcgagccagcgccgcggggctggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctggtgagtacccctcctggttcttctggaagtaaaaagggtgtcttttcggttgaaagtacttttcagcctataagaaacatgcatttgaaactggaactatccacagattgaaagtgtgcatctccagtcttgggatttagagaaatgaa

SEQ ID NO: 498637 - DNA, 220 bp, Homo sapiens
ctccgtgagactggtccagcttctcagcctggcattcaagttcctcctgaccgtctctgtgctcccctccatttccccatccagcctcggctgcttggagcagttcctgggcacacctcctatctgccctgtcctagatgccccaggggggtggcatggctccctccccacgatctccaaggctctcagcccctgggggcagacaaatcccaccctctgg

SEQ ID NO: 498638 - DNA, 247 bp, Homo sapiens
  misc_feature (65)..(65): n is a, c, g, or t
atatatatagtgtgtatatatattgtggatatatatatagcgggtatatgtagtggatatatatngtatatatatattgtggatatacacacacacacaatagctgggcattgtagtgcatgcttgtagtcccagttactcaggaggctgaggtagaaggataacctgagcccagggagattgaggctgcagtgagccgtgatcagtcgctccattgccctccagcctgggcgacagagaccctgtc

SEQ ID NO: 498639 - DNA, 956 bp, Homo sapiens
gacctgggacgggtctgggcggtctcggtggtaggcatggggttcgctacacccattcacagcggcaggacgcacttgtcttagcagttctcgctgagcgcgctagttgccgttctacgctccggcactctgtgttcatcagcaagcgccctggcgtctgggtcctcagcatgcctagccttgggagcgtactcgtcgtcgtccacctcctcttcgccctcgtccttgcaccgaactcgccatcccagatcggcgcgccgtgctcaagcctgggggtcggcgaccccgggaaggaggggtttgagcgctccaggaggcctggagagctcggatctgcgagtccctggagcagcagcacacagtggcttctgggccggagggaggacacggtgtcacccgtggactggggtgtcgtatgcccgagttcgagctgctcagtgaccctgaggatgaacacttgtgttgccaacctgatgcaagctgttgcaaggagaagcctgggcccaggcgctggttgggtctccgagccctgcgcggcctgtggttgcctacgcctgttggtaaatgccggggtgggcaaaggcaatattggggcctggctacagcgagcgtgtggcctgtggggggcgcctggttggacggtctgccttggaggcagtggcagaagaccttgaccacactggggttggggcccagcttgtgaacttcgacccccaggccttggtggtccaaccttaccaaggttgagccctctgttgtctgggcttgggttcaaggactctttggccccaggacccggggtctggtttaggtctccgcaatattccctatccccccggggttacgcatatcctgggcgtggtagacccgggttccggtctcacagagaagctgcctcctcttgtgaatccctagcggggtgtgagacaccctggggggcgcgccgcccacagaga

SEQ ID NO: 498640 - DNA, 170 bp, Homo sapiens
  misc_feature (4)..(4): n is a, c, g, or t
gttnatcccctatgcttcacaacgcagagcagcaaagtcttctattttaaaataaaggagattactaccgctacttgtgctgaggttgccgctcgtcataccaagaaagggattgtcgatcagtcacaacatgcataccatgaagcttttgaaatcagcaaataatcgtg

SEQ ID NO: 498641 - DNA, 1065 bp, Homo sapiens
  misc_feature (16)..(16): n is a, c, g, or t
  misc_feature (197)..(197): n is a, c, g, or t
  misc_feature (237)..(237): n is a, c, g, or t
  misc_feature (239)..(239): n is a, c, g, or t
  misc_feature (247)..(247): n is a, c, g, or t
  misc_feature (273)..(273): n is a, c, g, or t
  misc_feature (275)..(275): n is a, c, g, or t
  misc_feature (841)..(841): n is a, c, g, or t
  misc_feature (849)..(849): n is a, c, g, or t
  misc_feature (877)..(877): n is a, c, g, or t
  misc_feature (903)..(903): n is a, c, g, or t
  misc_feature (945)..(945): n is a, c, g, or t
  misc_feature (949)..(949): n is a, c, g, or t
  misc_feature (980)..(980): n is a, c, g, or t
  misc_feature (1033)..(1033): n is a, c, g, or t
gccgcggcgcccgccncacccgcgcgccgccgccgcgccggcccgcgccgcgcgcgccgcgccgcgccacccacgccaccccacccccactagctcgcgcgcgccctctcacgctcgccctcgctcacgcacccccacgctcccacgcccacccccacgccctcgcgcgcgcgcccgcacacgcgctcgcacgcgcncgcgcgctcgcacacgcgcacgcgcgcgtgctgtcgcgcncncgcgcgcncgcgcgctcgcgcgcgcgcgcgcgcncnctctctccacacccactctcacccgcacacgcgctcactctccccgcgtacgcaccccccccacacgcgcgcacccacacccccactccccctcaccctctctcactcgcccacccacaccacacaccccctcgcgcacactccctcgccctcgcccgcacacactctcacactcaccctcccacccacacacactctccccccccccccctccgctcacgccacacacccccccgcgccacacacacacccacactcccacacccaccccctctcgcccacccacaccctcacccacgccacacacgcccacacacaccccacgcccgcaccctccctcgcccacaccacactccctcccgcccactctcactcactctcaccctctcccacccactcccctcgctccacccactccccctcactcgccccccttccaccgcccccccccttccgcgcaacccgccccgcccccccaccccccgccccccccccccccctttgcatattcactgtgaaactttgcatttcaacaaagcaactcacttcagcatttcaattcatgnacctcatnacaagcactcaatgcatcactgcctgtnctcgcaattgcaagcaaagggaaggncaatacattggcattatcacaaactatgccccatgcaaatgnactncatggcaggcaagctgcacagcagcaatacnccacgcccttgcgcccagcatgcattgctgcgcatttatgcaaaaaccccttntaaaagcaagcatgcatggcaagcaatttgct

SEQ ID NO: 498642 - DNA, 539 bp, Homo sapiens
  misc_feature (6)..(6): n is a, c, g, or t
  misc_feature (67)..(68): n is a, c, g, or t
  misc_feature (74)..(74): n is a, c, g, or t
  misc_feature (76)..(76): n is a, c, g, or t
  misc_feature (82)..(82): n is a, c, g, or t
  misc_feature (87)..(87): n is a, c, g, or t
  misc_feature (89)..(89): n is a, c, g, or t
  misc_feature (336)..(336): n is a, c, g, or t
  misc_feature (345)..(345): n is a, c, g, or t
  misc_feature (449)..(449): n is a, c, g, or t
atctantgaatactcctcctcctctaacgggtatgctaatgaggacaaatggggagcaggaggctgnnctgagntngacgangaagngnaaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagactttcaaaaaaaaaaaaaaaaaaaaaaaaaaaaaagcggccgctcgaattcgcggccgctcgacgtcgacgcgcagaatttccngggcgtccnggggctgcgagaagacgacagaaggggggacgtccagatcggtgacatcgtcacagtgggcgatgccggcctctgagcaagacatgcgcttcaacgtgctcaangtcaccaaggctgccggcaccaagaagcagtttccagaagttctgaggctggacatcggcccgctccccacaatgtgtttttttctcctt

SEQ ID NO: 498643 - DNA, 991 bp, Homo sapiens
ctctagactgttccaggctgcctgcggattaaagtgggggtgactgtaaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaacaaaaaaaaaaaaaaaaaagaaaaaaaaaaaaaaaaaaaaaaaaagaaaaaaaaaaaaacaaaagcgcgccgcccggcgcgacgcagatacaccacagagggcagcccaaaacacccacacaacgcgggtgtgtgttaagtctcacgtggaagaggagcgggccataacagataggagaggtaatgatgtatataattaggagcagagacggtagggtgagggacgtagagcagatagctgagcagagacagagaggagagagaggcgcgagaggcaggggaaagaagagaagcgatggcacgttgtctagtcgggtgatcgaagcgaaggaggcaggagcagcagggtcgcggagaggaggaggaaagaggcagcggagcgaaagagagagagagggaaatctggggcgggagcgagaggagtgaaagagagcaggagagagagcgggacaagtgggtgggagaataggcgagaagcgccggagaccgagcggatgaagtgagcaagtgagcggggcgaagagaggatcgtcacaaggacggacgagcggcgtcgcgcggacgcagtggagcacggcgaagcggccacaggagcgataccgaagagggagacagaaacgtagccaggaagcactacgaacggcacgacgagacagcaggcggcgagccgaaagcgcagcagcactagtgatacgacaagagccaggaagacatagaccgatcgaccaaccgccgatctgcagagcgctaagcgctagcggcgagaaggacagaagccagcacagaaaccaaagcgacagcgccgcagagacgaaacagcgtaaggaaac

SEQ ID NO: 498644 - DNA, 386 bp, Homo sapiens
tatgctgtcagagttcccgaatctcgagagtgtgcaactgtagcagggaacactgaagattttaggtcaaccacgagaacctaggaagagatactggatgtgttcctgtaaggacaccagtcatatgggatggaggcacactctgtgtccagatatgacctcactttgaacgttaactaatttctacttggcaatgggccctaattttcaacaaaggtgaaccttttggcagggacagggtgttagcacttcaactatatctttctattttggggttggggggtgagacacatatttaaccacataacaccataccaacacaagcttttcacataatggcctatcttctggcctcaccctatatgcacaactgtgtcgagaattcg

SEQ ID NO: 498645 - DNA, 187 bp, Homo sapiens
gagcttaagaaaaagaaaaaaaaagagaaaagggatgctaaaaaaaaattaaagaacacatgattttccttcaaattcctagggattgtctctctctgtcgcccaggctggagtgcagtggtgggatctcggctcactgcaacctccacctcccaggttcaagcaattctcccgtctcagccttccg

SEQ ID NO: 498646 - DNA, 368 bp, Homo sapiens
  misc_feature (6)..(6): n is a, c, g, or t
  misc_feature (67)..(68): n is a, c, g, or t
  misc_feature (74)..(74): n is a, c, g, or t
  misc_feature (76)..(76): n is a, c, g, or t
  misc_feature (82)..(82): n is a, c, g, or t
  misc_feature (87)..(87): n is a, c, g, or t
  misc_feature (89)..(89): n is a, c, g, or t
  misc_feature (239)..(239): n is a, c, g, or t
  misc_feature (241)..(241): n is a, c, g, or t
  misc_feature (248)..(248): n is a, c, g, or t
  misc_feature (251)..(251): n is a, c, g, or t
  misc_feature (333)..(333): n is a, c, g, or t
atctantgaatactcctcctcctctaacgggtatgctaatgaggacaaatggggagcaggaggctgnnctgagntngacgangaagngnaaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcaggggcgtctntnccatttnttncctcttccacaacttccttcttctcctttaagtccttggtggtgatttcggagctggtgtcctcgtgccgaattcggcaggncaagcgtgcccccacgctggaagtaactccgcacg

SEQ ID NO: 498647 - DNA, 93 bp, Homo sapiens
  misc_feature (38)..(38): n is a, c, g, or t
  misc_feature (72)..(72): n is a, c, g, or t
ggagtccgtaggggaggtgatggccagccaagacgatnccactcggcaacccaacagttttccaaccacccngggtggaactaatagaaaaga

SEQ ID NO: 498648 - DNA, 1513 bp, Homo sapiens
ttttaatagaatgatttttattatttgaagccgctgaggttaagtggcaagagataaacagacatacaacccctctctggaaaggatgaggaaatctgcatcctcaaagggaaaagggaggcccacctgactgcagtgtggaagctcggtgtaaagggagggcatgagaggactggagaggtgccaggtgtggaccatcctgggacaccagcctggtcactttcctaggaccgctcaatgccttctcctgtcagtgtcgcaccccactgggttcatccttccactttcacacttggggcgcggggaagggctgaatgcaggcaccactggtcacgagggcgtgactgggcaattcctccttcggcgggcgcccacctcctggcacccgtggcacagctccgggaacggctgcgggcccagccgctgcttccccgatagcgccgccgcagttccccggagacagaagtagagccggaccgccggaaaccgtagatccggggaggtcggggccgcggtgaactccagttcaccaggacaggaagtgacagcggaacgccggaaaccgcagatccacggaggtcagggccgcggagagctgtagttccccggaaccggaagtgatggcggacctccggaaaccgtagattccgggcggtcggagccgccgggagctgtagttctcccgcggctcagagaagtaggcagagagcggacctggcggccgggcagcatggcggggctggagctcttgtcggaccaggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactgaccacccagccacccatgtccagaataaaaccctcctctgcccacac

SEQ ID NO: 498649 - DNA, 222 bp, Homo sapiens
catagtatgaccttgtcttctacaaaaaaaaattagccattagccaggcgcagtggtcacgcctgtaatcccagcactttgggaggccaaggcaggtggatcacctgaggtcaggagttcgaggccatcctggccaacatggtgaacccacatctctattaaaaatatgaaaattagccgggcatggtggcgtgcacttgtgaatcccagctattcaggaag

SEQ ID NO: 498650 - DNA, 1623 bp, Homo sapiens
ttttaatagaatgatttttattatttgaagccgctgaggttaagtggcaagagataaacagacatacaacccctctctggaaaggatgaggaaatctgcatcctcaaagggaaaagggaggcccacctgactgcagtgtggaagctcggtgtaaagggagggcatgagaggactggagaggtgccaggtgtggaccatcctgggacaccagcctggtcactttcctaggaccgctcaatgccttctcctgtcagtgtcgcaccccactgggttcatccttccactttcacacttggggcgcggggaagggctgaatgcaggcaccactggtcacgagggcgtgactgggcaattcctccttcggcgggcgcccacctcctggcacccgtggcacagctccgggaacggctgcgggcccagccgctgcttccccgatagcgccgccgcagttccccggagacagaagtagagccggaccgccggaaaccgtagatccggggaggtcggggccgcggtgaactccagttcaccaggacaggaagtgacagcggaacgccggaaaccgcagatccacggaggtcagggccgcggagagctgtagttccccggaaccggaagtgatggcggacctccggaaaccgtagattccgggcggtcggagccgccgggagctgtagttctcccgcggctcagagaagtaggcagagagcggacctggcggccgggcagcatggcggggctggagctcttgtcggaccaggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactgaccacccagccacccatgtccagaataaaaccctcctctgcccacaccaaaaaaaaaacaagaaaaccaagacaaagaaaaaaaacaaagagaagaggaacacgaggacacagaaaagaagaaaagagacgagagaggagaagagggagaagaagga

SEQ ID NO: 498651 - DNA, 371 bp, Homo sapiens
ccatccggatatctattgaacatagaagcatatgttatatgagtacaagaagctttctcctcgcacacgcttacatcagtactaataatatactgatattaacaatcataaacaaacaacactaagcgttattaattatatggttaacccaacacaggagtgcaccaaggaaagattcaaagaagtcaaaggaactcggcaaacacaaaccccgcctgtttaccaaaaaacatcacctctagcattactagtattagaggcaatgcctgcccagtgacaccagtttaacggccgcggtattctgaccgtgcaaaggtagcataatcacttgttctccaaataaggacttgtatgaatccgcaaggcaaaaa

SEQ ID NO: 498652 - DNA, 442 bp, Homo sapiens
gagaacatggaatatttggtttcctgttcctatgttagtttgttaaggataatggcctccagccccatccatgttcctgcaaaggacatgatctttctttggcaaccactttttactgtcgccatagttcttccttttctagaatgtcatattggaatcatatagtatgtagccttttcagactggcttctttcacttaataatatgcaattaaggttcctccatgtcatttcatggcttaatagtgcatttatttttagcactgaataatactccattgtctagatgaatagtttatccattcacctattgaaagacttcttggtggtttccaagttttggcaattatgaataaagctgttgtaaacatctttgtgcaggtttttctatgggcatgtttttaattcatttgaataaataccaagagcttcagtgctggaaa

SEQ ID NO: 498653 - DNA, 1792 bp, Homo sapiens
ttttaatagaatgatttttattatttgaagccgctgaggttaagtggcaagagataaacagacatacaacccctctctggaaaggatgaggaaatctgcatcctcaaagggaaaagggaggcccacctgactgcagtgtggaagctcggtgtaaagggagggcatgagaggactggagaggtgccaggtgtggaccatcctgggacaccagcctggtcactttcctaggaccgctcaatgccttctcctgtcagtgtcgcaccccactgggttcatccttccactttcacacttggggcgcggggaagggctgaatgcaggcaccactggtcacgagggcgtgactgggcaattcctccttcggcgggcgcccacctcctggcacccgtggcacagctccgggaacggctgcgggcccagccgctgcttccccgatagcgccgccgcagttccccggagacagaagtagagccggaccgccggaaaccgtagatccggggaggtcggggccgcggtgaactccagttcaccaggacaggaagtgacagcggaacgccggaaaccgcagatccacggaggtcagggccgcggagagctgtagttccccggaaccggaagtgatggcggacctccggaaaccgtagattccgggcggtcggagccgccgggagctgtagttctcccgcggctcagagaagtaggcagagagcggacctgggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgaggcgagtgggcgcgcgggatggggaatcgtgtggccgtgggagctgcggggcagccgggctgagcgctggctcggggacttgaggggcaacggccggcgcgcctcagtctacacagccgatgctcagcaccgcatctcactcggagtaaacgcaagtccttagtgtgctgcgcggtggtcctgcctttctcatcggcctctgtccctgcgccctccttcctctttgcggctcttcaacgtgctaggcactcccccactcgctccctctcctttcagctctactccgacgtcactccttcccagacgaccttattatccacgcatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactgaccacccagccacccatgtccagaataaaaccctcctctgcccacac

SEQ ID NO: 498654 - DNA, 344 bp, Homo sapiens
caggatgcttctcagcatagcagccagaatgaccttgtaaaaatctttacatgagacatcactcctactgctcaaaagcatcagtggctttcgcacctctaacaataaaagccaaagtcctaatgatgatcaaaaaaattatgttatatgggcctctattacctatttgagcttatcttcttgttcacagtgctctagttcacaatggtctactggctgctcctccacatctctgatatggttccagattagggctgtttcaagtgttagcgggttccgcttggtgttgctctttccttttgctttcttaaagcgtttattcataagtcgccttttctgtgacg

SEQ ID NO: 498655 - DNA, 194 bp, Homo sapiens
tggaactgagaaaagtgaacaggaggaggaaaaggaagatcttgaaagggtggggtattgcctgctggagcagcctgaagcgaaactcaccgttgcagaaagagtacatgctggcaggatcattcacaagctgtttgtgacatcccagagggctgcagctatgactccaccagaggaggaattgaagagaatgg

SEQ ID NO: 498656 - DNA, 367 bp, Homo sapiens
  misc_feature (37)..(37): n is a, c, g, or t
  misc_feature (94)..(94): n is a, c, g, or t
tccaggtcagccagtctatgtaaaggttcctctggtnaactttgtagaaagttaaagtctgtactaaaaggttattatttatggaatctgtttnatgtggaaatagaatcgtggctggagctgacgttggcaatttaagacctgctaagtgagtgaacaaaatttgctaatatcaattaatgacctgcatgctttttctttaccctgactcattccttactggtaggatcagtcttttcagtatttgggttatggttcaatgagccagaaaagtaactttgtagtatcagaatgtcatccaactgtatatttactttattgtaaataatggtgaacagtggtcaataaatagttttatattccttta

SEQ ID NO: 498657 - DNA, 1834 bp, Homo sapiens
ttttaatagaatgatttttattatttgaagccgctgaggttaagtggcaagagataaacagacatacaacccctctctggaaaggatgaggaaatctgcatcctcaaagggaaaagggaggcccacctgactgcagtgtggaagctcggtgtaaagggagggcatgagaggactggagaggtgccaggtgtggaccatcctgggacaccagcctggtcactttcctaggaccgctcaatgccttctcctgtcagtgtcgcaccccactgggttcatccttccactttcacacttggggcgcggggaagggctgaatgcaggcaccactggtcacgagggcgtgactgggcaattcctccttcggcgggcgcccacctcctggcacccgtggcacagctccgggaacggctgcgggcccagccgctgcttccccgatagcgccgccgcagttccccggagacagaagtagagccggaccgccggaaaccgtagatccggggaggtcggggccgcggtgaactccagttcaccaggacaggaagtgacagcggaacgccggaaaccgcagatccacggaggtcagggccgcggagagctgtagttccccggaaccggaagtgatggcggacctccggaaaccgtagattccgggcggtcggagccgccgggagctgtagttctcccgcggctcagagaagtaggcagagagcggacctggcggccgggcagcatggcggggctggagctcttgtcggaccaggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgaggcgagtgggcgcgcgggatggggaatcgtgtggccgtgggagctgcggggcagccgggctgagcgctggctcggggacttgaggggcaacggccggcgcgcctcagtctacacagccgatgctcagcaccgcatctcactcggagtaaacgcaagtccttagtgtgctgcgcggtggtcctgcctttctcatcggcctctgtccctgcgccctccttcctctttgcggctcttcaacgtgctaggcactcccccactcgctccctctcctttcagctctactccgacgtcactccttcccagacgaccttattatccacgcatccggggctcccgggctcgagccctgccggacagggccctagtgaactgtcaatatagttcagcgaccttcagcacaggtgagcgcaagcgacggccacatggggaccgtaagtcctgtgagatgggcctgcagctccgccagactttcgaagcagccatcctcacacagctgcacccacgctcccagattgatatctatgtgcaggtgctacaggcagatggtgggacctatgcagcttgtgtgaatgcagccacgctggcagtgctggatgccgggatacccatgagagactttgtgtgtgcgtgctcagctggcttcgtggacggcacagccctggcggacctcagccatgtggaggaagcagctggtggcccccagctggccctggccctgctgccagcctcaggacagattgcgctgcttgagatggatgcccggctgcacgaggaccacctggagcgggtgttggaggctgctgcccaggctgcccgagatgtgcacaccctcttagatcgagtggtccggcagcatgtgcgtgaggcctctatcttgctgggggactgaccacccagccacccatgtccagaataaaaccctcctctgcccacac

SEQ ID NO: 498658 - DNA, 147 bp, Homo sapiens
ccccccgcccctttgttcctcatgtccccatgtttctctgcctctgcgtcttagcacctttcttctggccaaagttttctgtaaattttctccttttttccttctttcttttttttttttttataaattaatttgctttccgttcca

SEQ ID NO: 498659 - DNA, 320 bp, Homo sapiens
cagcacactccaacaccgggattcgacacacagccaccgccatggagaccagttctcccaacaagctcatccgcctgtcatcggctttgttcctctgagggctgaaaagcgatgcaaacataatctgccgaacagagtccttggtttgctcctggaaataactgcacatcatttcaagacgctgaagctcctgaagggcattcagtctcttgggctgcgtgcgctcccttgggcacctggaacacgaactcctccagcagctccacggggcccttgtccacgatgggcagcggcgcgtctcagctggctcctgaagtaga

SEQ ID NO: 498660 - DNA, 970 bp, Homo sapiens
ttttaatagaatgatttttattatttgaagccgctgaggttaagtggcaagagataaacagacatacaacccctctctggaaaggatgaggaaatctgcatcctcaaagggaaaagggaggcccacctgactgcagtgtggaagctcggtgtaaagggagggcatgagaggactggagaggtgccaggtgtggaccatcctgggacaccagcctggtcactttcctaggaccgctcaatgccttctcctgtcagtgtcgcaccccactgggttcatccttccactttcacacttggggcgcggggaagggctgaatgcaggcaccactggtcacgagggcgtgactgggcaattcctccttcggcgggcgcccacctcctggcacccgtggcacagctccgggaacggctgcgggcccagccgctgcttccccgatagcgccgccgcagttccccggagacagaagtagagccggaccgccggaaaccgtagatccggggaggtcggggccgcggtgaactccagttcaccaggacaggaagtgacagcggaacgccggaaaccgcagatccacggaggtcagggccgcggagagctgtagttccccggaaccggaagtgatggcggacctccggaaaccgtagattccgggcggtcggagccgccgggagctgtagttctcccgcggctcagagaagtaggcagagagcggacctggcggccgggcagcatggcggggctggagctcttgtcggaccaggctaccgggtggacgggcggcgcgccggggagctgcgcaagatccaggcgcggatgggcgtgttcgcgcaggctgacggctcggcctacattgagcagggcaacaccaaggcactggctgtggtctacggcccgcacgagctgacggctcggcctacattgagcagggcaacaccaaggcactggctgtggtctacgggcccgcacgagg

SEQ ID NO: 498661 - DNA, 353 bp, Homo sapiens
atcacacccaggtatcactgtgctgtcctttgctgtgagatttagaaatgtagttaagagctatgtgaaaacagacaatattagtttaggtcgggaactcgagatattgtgatcaaatagttaacatcaggaagatcattaggctggcttcatagggaaacttggccagtgaccagcacatatatttagaacccttcctgttttatgtgtgtacctggttcaccgctcaggtcatacctgcctctgacaggtacagttgtttcttggaaatcctgcaacctagcagttttactaacttgattagcttgagctgacagactgttagtacagatatctggccacagctgatgggg

SEQ ID NO: 498662 - DNA, 494 bp, Homo sapiens
gtcggccaagtgtacgagatgcacgtatctgggtcggcctctacgccctgatcatcggcaccgcgctgtacctggcagctggttgccgctgatgctggtgggcctgcccagcctctatggcgcctggctcggttacctgtttggaatcagccaacacgtgggcctggccgaagatgtgctcgaccaccgcagtaactgccgcaccatctacatgaaccgcgtgctgcgctttatctacatgaacatgaactaccacctcgaacatcacatgtacccgatggtgccttaccacgcgctcagtcaactgcacgaagagatccgcagcgactgcccgccgccgtacgccaacttgtggcaggcctaccaggaaatcattccgacgatctggcgccagcgcagcgaccccggctatttcgtccaacgccccacccgtggcgagggagcttgctcccgctgggctgcgcagcaaccccaataacccttcagacctacag

SEQ ID NO: 498663 - DNA, 1745 bp, Homo sapiens
tatattttctctcctctttttgtggggaaaaccccaaaacaaaaaaatccatctctctccccccctctcttttttttcccagaaaaagggagttgttgcaaaaacaaaaggggggtgtggggggggggagatctcctctcaccaccatctctccgcgggtttataacccccaggtgtatcccccgtggggtgtgggcacctgagcggcctcttatggcgccaagagtcctctctctcgagagaggacaatataaaaaaaaagattataatagaggaagaggtcgtcttcctcttctacaagaaacagagatgaaacacctctctctctataccctctctcttctccccaaaatatcatccccaaactctctccctctcacgcgtgtgcgccactctcttaaacactcataaagagaagagaccacacggtgacaagtagaggtgtgagagagatatatccaccatctatctcacccacaacacaccacactactaatctcacccacacaccacacaccacaccacacaccacgagtctctctctcttatctttacacacacacacacaacatcgtgacgatataaactctctctctccccgcgagagagaagagagaagagaccacacacagtgcggacacacaccacacacacacacagagagacgctgtgagggcggtctcaaagagagaaggagagagagcgcggggagacacacacgtgctgagtgacacacaagcgggggaaacacacacactctccgcgagggagaaaacaaaacaaaggtgaggagtaccccaccctctactatgtagagcagctactaatctccccccaacaaaagctactctctcctactagaatagaccagcccccgcccgcgccaccactatttcatctccacaaaaaaaagagaggagaggccacacagcggtgggggccccctactaaggcgcagcgaccacctcagaagaggggagcaataaaagaggagaaaacaagaaggggccccccccccaagcggggagccccccaaagataacaaacataacgccatgcggcgtagtcggaacaaaacaaagcagtcactggtagcaggaccaacggaccagaccaacaacaacctggacagacacaccacacccctctacagagtagaagcagagcagcggcgacctcacacacacaccaaagtgagtggtgcgcccccccaccggatgcaccgctgggagcgaccagcaacagcagagaaccaacacccaagcagaaaatatgacaaggcacactcctcaccacaacaaaacaacaccgtgtgattagactgaaaacgatgcttactcctactccgacgaagacgagacggcaacgcccccacctacgccaggccgaactaaacacacacccgagacgcgctaccaccacaccgcgcccaaactaaccgacgagaacgagtaatgttctccggaccccccaccctcgctagcctcttcagggagagccgccggaccaaatctctccccgcgcacaacacactacctaaacacagaatcgaccgggcctcgacaacaccgcgtgagaggcgaggtccgacgtctccccccgccgcgcgtacaaacaaaggagctacccaaacgacggcggctacttcccttcccccacaacgatagagaacgaccctagcacccacccgaccgcagtacttccacaagcacaggtcccacctcactagagagtgcgactcccga

SEQ ID NO: 498664 - DNA, 789 bp, Homo sapiens
ccattgttggcgtggcttcctctgcggcgcgtggactcctccggggtgtatttccgggggacccttgtccagcgtggagtcggattgggccggatttttcccaggcctgttgtgtgtgatgtctgtgggagtctggctgcgctcatgaggacaagccaggctgttgttacacaaggctccctctgtttcgggactggtatctatagagtaacactggggtataggggccggggccacccaaatgtgtacacctgcggggccacccattcgtccaccccagtgtgcacgcctgcaggctggagactggaccgctgactgcaccagcgcccccagaacatacactgtgaactcaatctccagggctccaatccatgcctagaaaacctctcgcttcctcagcctccaaagtggtagctgggaggtagtaaggtggaggtacacatgggtggattcatacatgacccaacatgggggcaaaaggtattgaagacacagcctcccccagccagccccaagctgggccgaggcagcagatttgtgcatatctgccatcaccatgtctcataaggagcagcgggaacggagcattcaggggcctcctcagtgaaggtggtggggcatgccggatctgggctgtggggcccattgggccacgctcttgaggaagcccaggcatcggaggaccatggaaaacagacgggtctgagactgatattgttttaacagctcggcagggtggacattcagtggtaccttggatgagtatcagtttttgggccccttgcttaa

SEQ ID NO: 498665 - DNA, 1669 bp, Homo sapiens
agagaaggcagctgccgacacagtcttggctcccccgaagaagctccagctcatggctcaggatgccttccgagatgtgggcatcaggtacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggacagaggaggaggaggaggaagaagaagaggaggaggccacagattctgaagaggaggaggatctggaaccagatgcaggagggtcacggaggatgatgaagaggaggacgaacgaggaagaagcagcgagcaggtaaagatggagacacagagccccatgtcctcacatacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgacccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttcttta

SEQ ID NO: 498666 - DNA, 186 bp, Homo sapiens
agcggaacggtatccgggtcttagtcgagacagcctgactctatagtgtaaccccgtctcttactagacatacaacaagttagccaggcgtggtagcccacgcctatagtcccagcctcctgagtagctggaactacaggcatgagccactgctcccggctgggattttgggatcttggactcgtg

SEQ ID NO: 498667 - DNA, 1005 bp, Homo sapiens
ggccgacgatccggctcgttttctcgcgctaccctcccggctgctcgggtgcctccgtgggtatttctcgttggctccacggtctggtcttcagtcacccgctgttcgtctccgagttcgcgactcgggacctggtgtccccggtgctgaataggcatgggcatccggaattgccgtttgccatggacgcacggactgcccagtccggtataaaccggtgtgcggattgggaggtgattgaacatgcctgtcgtctcataggacctgtgtcttgcatcgggtagcttatccccgcccatgggaccagcttccctaaagggcttggtttgtgcccactgaacggagtcatgagaacactcatgttgccagactatgcagacgcgtgtgcttgtagaccgcacatacgaggctggggctctggtgcggtaccatgaggctgcggcgaggcaaggattcatgaagtgcgtgctgatgtcccgctcctctggaactcgaggattgcccgagtggtaactatcgggactgatgtttacactcattcgataggcactgtgcttgagtttcagatggaaacacttccgcagtagaaggtggggcccagaatagctaacgcactcccttgattccaagggtgcccattgccactcgtgccttggacgaggtcaagcaagggcttccctgggcaactgctggaggccccccgggccggcacgctagccaatgatcgacgcatgtccggcgggaaacccagagagcacgggacatcctctccacacgggaccgccgcttgcgaaactcgcagtgtgcacgctccgaccacggggcgcgcccaccggtccgaacggccccagaacgccggtccgacgcgagcacgtggcacgcaaccctggtgcctgcgtcggcccccctgcccacgcacccatgagcaagcgcagggcgcacacaaaggaggccaggccgctcaaaagcgcacagcacccgacgccatcaaacacagtagaggcc

SEQ ID NO: 498668 - DNA, 240 bp, Homo sapiens
ccagaacagcagggtagccagaagagtgacacagaagctgtcatccctccttcggtcgtgtcatcactgggcgtgaaaacctggttggcacaaaaagagtttcagatcgttcccaaaaaaattcaggcacagatattgaaccaagggactgttgagataaacgagggaggctcagtgatgccctttggaaatcagtattggctggaggtttgaggattctccggcacaagggggttaccg

SEQ ID NO: 498669 - DNA, 1164 bp, Homo sapiens
agagaaggcagctgccgacacagtcttggctcccccgaagaagctccagctcatggctcaggatgccttccgagatgtgggcatcaggtacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggacagaggaggaggaggaggaagaagaagaggaggaggccacagattctgaagaggaggaggatctggaaccagatgcaggagggtcacggaggatgatgaagaggaggacgaacgaggaagaagcagcgagcaggtaaagatggagacacagagccccatgtcctcacatacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaagcagatgactgaggaagggatggactaagctaatccccttttggtggtgtttcttta

SEQ ID NO: 498670 - DNA, 231 bp, Homo sapiens
cgcgccgtttggccagagaacaagcccatcatggtgcgtatctcggcaacagactgggccgaaggcggcaatacggcggacgacggggtggaaattgcccgcctgttcaagcaagccggtgccgatctgatcgacgtgtcctcgggtgaagtggtgctggagcagcagccaatttacggccgcatgtaccagacgccattctccgaccgtatccgtaacgaaggtaaaccc

SEQ ID NO: 498671 - DNA, 286 bp, Homo sapiens
  misc_feature (15)..(15): n is a, c, g, or t
  misc_feature (55)..(55): n is a, c, g, or t
  misc_feature (67)..(67): n is a, c, g, or t
tgtaagaaaaacccnaggtgcctaaaatccaagggcctgacccatacaggtaccnagtcacaatagncccagaggtggaagcaatcccaaatgtcctatgaatggatgaatgaataaaatgtgatatacagatacaatggagtattattcagcctttaaaaataaagaaattctggcacctgctaagtatacctggaggacattatgctgagtgaaataagcctatcacaaaatgacaaatactgtatgatttcatttatatgacataatgtggcacaataaaaat

SEQ ID NO: 498672 - DNA, 318 bp, Homo sapiens
tgtgggtagcacaacctagtcagttttgcaggtggtaaacgccattaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 498673 - DNA, 1249 bp, Homo sapiens
caatgagttctcacagactaggatcactatcagagtctggtacacgagcgtagcatgggactcctgtgaacaggcagacaatccctactatactcagctcctctcatcgagctctcgagggtcccgaagcagtggaataaaggtcgcatcccgtataagcaatcttcatatagctctgaggagtccattcattactgatgttgagttcattaatgaaaaatagtagtcgtgatgccaccgctcgataacgagtagagaacgactgaacatcttcgatgaaacgatattagtgctagcttcaaatagtttctctatactcgaactactatactagctaagggctaatgtctatacacatcctattactttcatactctacgtttctaataattgcgcactatattacataaatggcaccattcccagacaaaatgattatgataggtgtcaagcacatgaagagacctggtgagtacagtggtgagccatacgagcgcccgcttgtaaaaatgccacaaagcctagtttcttcgagttgctgggactcagtacggaacccgagaggctggtggaatatctctctggaggtgatcgcagcagagaccgactgaggacttcagtccaatatcccttcggagggctcaaagtcacagcacagttagaacaaacaacactatgctttgtaaccagactctcaacacaaacacagaagtgattcagacactatagaatctctcaatacccggggggcctggatagtggccggggtaagcgaggaaagtccccttaggatttaaggtccctccacgaaaggctcttggacgtgctgcgttgtaagctcgccatagcatcgcgacaagggtccacgaagggttagtcgcaccgttcggaaaaaccattcaacctgcagttgcaagacggtttgggcaccgtcgttttggccaaggaatagttaagcctggtaaaaggtaacatttcgcttcgccgtccagttctggtgttccacaagttaccacattgttaccctcctagaggtgtacgggcacgccaggaaaaggcccgaaacgaaagttggtgccccaattggaacccgacaaacgattgcatatacgtagagaccgtaactatagactctcggacatcgttgcagccggccccggcaaaatttcgcaacaaggggcaagactcttccgaaagtatcgtacgttccctcgtggcgaacacagttaccttgtcaggccccaagtga

SEQ ID NO: 498674 - DNA, 352 bp, Homo sapiens
tccccccacccaaccgcccgggcccaggggttctttgagggggaaaggggaagggcccccattccccaacccccttttcccgggggttgggccttttctttaatccagtgggcccgccggttttcccgtttgaaaaggggccggtgggcccaccccatttattttggtttggttccttctttgggccccccgggttttccctttttggtttcgggttggttttttgtggggatttgtggggggttccctttttcccccgggaaccggttttgccttgtttcggtttttattccgcccccttttggggttttggcccctggggcccaagttttgggccggggccttggtccca

SEQ ID NO: 498675 - DNA, 107 bp, Homo sapiens
cgaggaggagaacttctaccagcagcagcagcagagcgagctgcagcccggcgccagcgaggatatctcgaaaaattcagctgctggccaccccggccctgccccta

SEQ ID NO: 498676 - DNA, 111 bp, Homo sapiens
tcgtgttaattctattagggtattgtgtaactcaattcagtacaattaaatacatgcaggttacttgcgaatcatatggagataagcacgtcacttccttgatataaatct

SEQ ID NO: 498677 - DNA, 1380 bp, Homo sapiens
agcggtggggcggggatgtgatgggggcgtggtcagatcctggggcggagatgtgaggggcggggtcatctcgctggagcggggatgtgatggggcggtgaggtcagcgtcacaggaggacgaagcgggtgaggggcgattggagtgcatcggcgggaattgcggacagatggcgggccggaggccgtcgtttggaagaacctggacggagatagacgtgctagaggcgtcactccgcagagagggtagagacgctaggagttgaggtcactggaatggggaccatgggtcactgtaagtcgtgcgatgcgaggtgctccgacatacgtccgaagacttccctgtgtgtgctcgctgagattacagttgtgcgcgagacctacgtggcctccatagactacgaaggctggaatcccagagtgcagcaaaaagtgcgtgcgctgtgtacacatgttaggctagatctgtgtggtggcgtgcaccagtgtctctacagcgaaagtgcgcttggaccgtacagtattcattggatgacatccagactcttctcacactgcgagggacagatatcaatctgagagactgagtgtagaaacgccagcaaaacacaaatgccagtgacagtgaacacagtctgccagtgcgagggagaatcccacctgtcagttgacaatccctttcaccaaagaattcactctggggtaggtatcaccacaactttacttggagtggtggacagggccaatccataaacataccatgggtagattcacatgatagcgttagggaaaaggaatctctggggagctttaaacctgaagcgcaaagaggtcatcggggcgggactttgggcgattcgttaaaggcaatggtactccaaagcggggacaaatagccaaagaacgtggaggtcgcctccgtggtggtccgccagagaagaagctttttctccacgcccaagtaggggagtccgagcaccgcataccttaatccaaggaccctggataatcacctaagtgatctccacgctagagggtgactttgaaagcttattaaaacaaggagaaggaaataattttacttagacggggcccttgttcctggggcgaagagggcccactagtgggctcccttgccgagccatgtaaggggattaaccaggttttggttctttggcctttgttccccccaaacaacacgggagttaaattgtttgccgattggagcctcgcgaaaaaccaaattaggagggaactttttcccggcgaaggggggccttatgaaagaggcgttggggtgaattccccggggggccaagcgcgaatgggttgtaaggcgccccaacgggctgtcttggggaatgtgcttacggggcgtcgg

SEQ ID NO: 498678 - DNA, 526 bp, Homo sapiens
gaggatcccctcctacgagcgcaacccatttcccctaagattctccaaggattttattcctttaagatagaaggaaggtattattactttcagtttacatattggaggaaaacttgaaatacagcgaggatatgatttgtccaagattatataacaagccagcgataaaaatcagttattaaagcttcttacctcttagtcttatctttatttattaaatcactgattcttgttataaacttgactgatactcctatatccccagattgcaggatcagctttcttagggagtaaattaggatgaaggttttgtatttagtattctcaagctcgaaaggtgtaatatcccatattctcatctctgctatcagaatatccactgtctctgtactttgttcttaatattctgtgtttcaaataggaggattaaaaaaattttactgccatttttgaggttatttttctttcttcttccctacttatagttgaggtagtgatggattagtcctttgcttactctcttgcc

SEQ ID NO: 498679 - DNA, 176 bp, Homo sapiens
gtgtacaggcaggcatgcacgcagtggtgaatacacgtcgaccatggtccagctttgcgttatttggtggtcagcgcggtgctcacgtgatcgacggaacttgtataggaaggcatgcaccgccgtggtgaatacacgtcgagctggaggcatgcctgcatgcctcggctcctgcc

SEQ ID NO: 498680 - DNA, 482 bp, Homo sapiens
gctgcacaaacagccttggtgccatggacagtggcatgaggcagactggctcctgggcaaaaatggggtgggtcctcagtgaaaccctacctttaggcaactgagagtctgaagcctgggggctgggctgccaggtcctcagactggagtgagaacttatggcactttttctactgcccatggaccaatcagcatgcacttcctccctcttgagcccataaatatcctagctcagccagactcaagaaacatggggacaacctgcctgcgtgtaggagctacccactccagatctcctctctgctgagggctcagcagacatcctgacgacctgcctgcagaaaggagccacccactgtgggtctcctctcagctgagagctgggcagacaaccggacaacctgcctgcagaaaggagctacccacttagagtctcctgagagctatactgtcactcaataaagcacctcttcaccctaaaa

SEQ ID NO: 498681 - DNA, 290 bp, Homo sapiens
tgacgccatctacaaaaacaaaaaaaaaaaaaaggataaaaaaaaaagaaagaacgcaaagacaatggtccagggaaacggagacagcaccgggccttgaacattgatgaggctcagccggtgtactgtgcaacgcaggtgtgggtgatgggcgcgggaagagaaggacacacctgtaaaccctaggggcactgaccgatggtgtccctggcctcagtagcggaggtatgcatcaggcagatgagaccagacacattgccaaaaagggtcccaggatggtgcccaaaaca

SEQ ID NO: 498682 - DNA, 132 bp, Homo sapiens
gtttaccctatctgagagctgctgcatttctgctgctgcccagcattatcagacagtatcatactgcatattgctagcctgggacaagataacaattcaaaatttgaagatatggttatcatactgaaatgc

SEQ ID NO: 498683 - DNA, 172 bp, Homo sapiens
aggttgctttgtagtagcatgctgatgtagcggctgctctctgtctataatcttcttcttgtcgtcctgtcctgattgtcccacaaaccgcttcttcttacggtcccacttgagctgctgctggcccctcgtcaggttctgggcttcatcccccatccagtccaggatagcg

SEQ ID NO: 498684 - DNA, 389 bp, Homo sapiens
  misc_feature (17)..(17): n is a, c, g, or t
  misc_feature (157)..(157): n is a, c, g, or t
  misc_feature (188)..(188): n is a, c, g, or t
  misc_feature (246)..(246): n is a, c, g, or t
  misc_feature (288)..(288): n is a, c, g, or t
  misc_feature (290)..(290): n is a, c, g, or t
  misc_feature (301)..(301): n is a, c, g, or t
  misc_feature (306)..(306): n is a, c, g, or t
  misc_feature (366)..(366): n is a, c, g, or t
gggtgggtgggaggtgntcagacaaaggagtggtgccagggagatgagagaccaggggattggtgaggatgtgttggcgcggggccagcggagtgtgggtgggagtggtagagaggggcatggggtgggctggcgggaggaacatgaggtgagcgantgggattgggtgagagagaaagtgtgggggngggagggcgtgtctgcatagcagaagctgaaggtctggaaactctggcatagcttgtnggccacagcacctgaagccagttggctggacaggtgcacgcnancaccataagtncagtnatagtggccgaagaaggcattggccacttgcaaggccacaatgtccgggctggcccagcnaggaccctctcctgcaatagcca

SEQ ID NO: 498685 - DNA, 779 bp, Homo sapiens
ggatctggcactcccaggactcccggccggggtagctcttcactcctcagcgcgacgtcgtgtcgagttcccaaaaagtctccgtaggggctgtagggatggcatacaagaattaaattctgaataagtctgcaggtaggatggacagttattttaaagctgctgtcagtgactctggacaaactccttgagtgatttggaacagaacccagatgaacaagattatctccaagatgtacaatacatgcagtatgattctaaccactgctcagtttcttcagagttggcttcctcacagcgaacttcattgcgtcccaacaagaccaagagtgcgttcaagtagtatgtgcctcactcagaaacatagctatggaacaaatgagagttccctgaatgaaaaaacactcaagggagcttacttctatagcaactagtgagcaataacatgtaacaggacttgatcttcttctcttctgtggatggtggtacttcagatgaacagtccagccgttatatatgggacgatgtagtaaagcctatctgtgatctgataagtgacactgggtaacttagttcatgctagaccaactagtgagagaacgatattaccagcattgattggccagatgatctggaagtctaatgcgagattccttgattggattcgcatatatcttacagctgtcagatactccctgtgtaacttcaaacagaccatgatagtgatactcgtcagagaacaacagaatgataccagttctgaatcacaaaatagcgaa

SEQ ID NO: 498686 - DNA, 259 bp, Homo sapiens
  misc_feature (117)..(117): n is a, c, g, or t
caacgatggtcctcagctgatccaagtgacctttgttactatacttggatcagctgcaaagtagtggtgtggggtttttggttggttttttggtttggtttggtttttggctttttngttttgagacggggtctcgctctgtcgcctaggctggagtgcagtgttgtgatcttggctcactgcaacctccacctcccaggttcaagcaattcccatgcctcagccacccgagtagctgaggaccctcgttggggtaccg

SEQ ID NO: 498687 - DNA, 748 bp, Homo sapiens
  misc_feature (748)..(748): n is a, c, g, or t
ctttgactgattcagagcgactgggcgcaagccctcaggaaggatgaaggggaggcctggctgagactgtcatcccccagagaaagcatctttgtatggcagacctgacttgtcaaggtaattggcactaggatggcatcccaagtaggttacatgcttcagcaaggatttactgtgaactgaaataaacctagaagaagctattcatatttcatgtccaaaggaaaatgcatcttctaagtctttgtggcaccatatactacttttctccagaattcatacaaagagtataacatgcctggacatttccagtcagatggaggtctaggctgtgtcttcttagttactgtacgggaccatgaatagatctggcacgtggcttctcaactggacgaatactcaggagaagctaattggaacaggacattgctgtattgagtgtgaaaccttgtgtggcacgcggttatattccgcgatcaaggcccctttggtgggtgccctgaggttggggcggaaaatggggaattggccaccatggtccttgtaaaagtcaccttattgccgctgccagccttgaaaggattggcttatagtctgagccttgggctgagaaccttttacaaaaggggtcgcaccacagagggcgagggctaataccctggtgccaattaagccaaggagccccaaatttccggggttttgcaaatcccgcgcgggcgcaagcgcacattgtagcgcttggttcctn

SEQ ID NO: 498688 - DNA, 557 bp, Homo sapiens
  misc_feature (420)..(420): n is a, c, g, or t
tgtgttaaggaggaattacaacgtactttgatttgaatactagtagaaactggccaggaaaaaggtacatttttctaaaaattaatggatcacttgggaattactgacttgactagaagtatcaaaggatgtttgcatgtgaatgtgggttatgttctttcccaccttgtagcatattcgatgaaagttgagttaactgatagctaaaaatctgttttaacagcatgtaaaaagttattttatctgttaaaagtcattatacagttttgaatgttatgtagtttctttttacacagtttaagtgaataagcgtctgttttcattcctggtgcttttatttaattttagataagtatgatagttaccttactactgtaaaatgtaaagctagaagtgtacactaagaaatgtaaagctccnatgagaagcagggtacccttgtctggtctttctctgctgtgatactaattccccacaccgcttgtatagatggtggcctggcgaccaataagtagcgcacctcaataaaaatatttgtttgaatagaatagaaaaaa

SEQ ID NO: 498689 - DNA, 329 bp, Homo sapiens
  misc_feature (4)..(4): n is a, c, g, or t
  misc_feature (28)..(28): n is a, c, g, or t
  misc_feature (41)..(41): n is a, c, g, or t
gggnatgacttcccatttacaattttgnaacttaataagcnacacacgtacataaaaacccagagacggccgggcgcgggttgtcacgcctgtaatcccagcactttggaggccgaggtgggtgcatcacaaggtcaggagatcgagaccatcctggctaacatggtgaaaccctgtctctactaaaaatacaaaaaattagccaggcgtggtgcgggcgcctgtagtcccagctactggggaggctgaggcaggagaatggtgtgaacccaggaggcggaacttgtggtgagcagagatcgcgccactgcactccagcttggggactc

SEQ ID NO: 498690 - DNA, 118 bp, Homo sapiens
  misc_feature (63)..(63): n is a, c, g, or t
tgactagaggatcccggcacggctgcggcgtcgttgttctgtcgccgtctttcatcagagatncgatctcctcgtcagtcacgtgctccccctcctttcctctcccttgagcttggtt

SEQ ID NO: 498691 - DNA, 1399 bp, Homo sapiens
caccaccttccaccacctccacctgcccacatgcccacgtggcccccagtgatgcacagcagtgtgggctgcccagtagaaatgccatgtgcctgtgccatggagccgtgccagagatgagactggactgcctgctgggcgctgggctggagctgggtggcatgcccatgtggtatgtggtgtgacacacggatgggccaggtggagtggtgtggacgcctggtggagcggcaggggtgtttccccgaatggatcgcactggaacgacttttatacaaacggaatttccaatgtggaggtcgagggagggaccagtaaaccttccttggtgccacgttgcgtccttcagtgaagtttacctcacggcacacgtttttccttcttgtattttaagtattataactagtcactactactacttgacactacgactacaagtactacaactaattgttgcggtgagacatgggccttgggcacacccatggggggttgcatcggagggcgtaaggggccttgccattgcttgccaaggagcttgactggcccgttggcatgtatggtcagggcaccacacgggacacttcttggaccaagactttgctctaccctattaaagcacggcaccaattgccccttttctttgggaacttccttgggaacgacagcgatccaaccagctcccttggcaagtacaactttggtggactactgcaccaacaagtaggccaaggcctctggcatggttacccccagtggcaagcgcggccttgcagtgcgttcaacagcggcccttgtttggcggcaaagggagcccaccatttcgattatgagcatacttcaactacggtcttccttacttatcccgcccaaattaggaccctaaacattgtacacaccctcaagcaaatcgtttgaccttttgcctcgggtctcggtatggaggccccccaagataaagtccctccaagttacaagccccctttaccagtaccattggccgtgaacattggttgacacgggcgtcctttgacgttggtggagcacccgttggatggagcaagcattcggacccatgtctgagggctcccaagaacgagcccagagggagttacgtgcgcgccacgagggcacaggtgcgggaaccttttagaactttggccaccaatatgggtcactgcgaccgtttgagatgccacttttcaccactacggattggcgatacgtcacacgcgtgttccacaatacaggttggaaagaacaacccttatggccctttctatgggacgattctacagatgccgcaggaaacgatcaagacaatacccagatcttaagcccacaggagtcagaaacattatacaaagattatagagcacccgtttagagcacacgaaag

SEQ ID NO: 498692 - DNA, 187 bp, Homo sapiens
acacatggaaaagtagattatgatgatctcgtattgagtttgtccctccgctgggaaaaagaaacaaaagaagtttattgaatactagcttgtataaaccttcagatgcagtgtaatatgaaaatgaggagtgaaagcatcccacggcagtcttaataaggtcactataggatagcaagggggatct

SEQ ID NO: 498693 - DNA, 439 bp, Homo sapiens
gcattagagtctagagtatcccctgctcggagtgcttttgagtgactttgcccaaaatgctgatagtggtatgatcaataaggtccaggctgaggtggtctcagatggagatgagaaacttgttgggaactggagtaaaggtgactcttgttatgttttagcagagagactgatggcattttgcccctgccctagagatttgtggaactttgaacttgagaaagatgttttagggtatctagtggaagaaatttctaagtggcaaagcattcaagaggtgacttgggtactgttaaaggtattcagttttataggggaagcagagcagaaaagtttggaaaatttgtagcctgactatgtgatagaaaagaaaaacccattttctagggagaaattcaagccagatgcagaaatttgcataagtagcaaggaacctaat

SEQ ID NO: 498694 - DNA, 296 bp, Homo sapiens
  misc_feature (7)..(8): n is a, c, g, or t
ggggggnncccggggtcccccctttttttttccccccccccccccgggggggggggggcccctttcccccaaaaaacccttttttttccccccctcctgggggggggggccaaccccccggggggggttttttgccccttttttaccccggggttttttttttttttttttgggggggggggggcccccccccccccggggggttttgggggttttttttttttcccccccccccgggtttttttttttgggccccccggggggggggcccgggtttttgttttttttttttttta

SEQ ID NO: 498695 - DNA, 1437 bp, Homo sapiens
  misc_feature (862)..(862): n is a, c, g, or t
  misc_feature (981)..(981): n is a, c, g, or t
tggggggcccacccctgagaggacactgttagttgttgactcgcatgcgctgcggtggcgtgtctctcgctgtggacacacgactcaaaatatcgtttgggtataaaattggggggccccaaaaatataatcgccgacgtaataaaatatagggtcgttggtagaacctaaaaccaggctcttttccgttggttggaagtgtcttatagggaaatgatttttaggaaaaaaccaccatgggttcagattccaataagtgcgttaaaagagggtttccccggggttaaaatttgtggaatagccccctttctaaggggttttttggcgccgggttgtgttttttttctttgggaaggaagttgtaaatatgccgatgttgtgattcccttcgtttgctccgccattagtttatggcgtacaacccgaaaaaagggttggtcctcaaaatgttccgtcaacatgggttttcggactctaggagattttttttaaaaaaaaggggtttttctgggggtggaaaaatcgtgggaaacaaacctacataaacagtttttgggggttccacatggagagaagaaatgtgtaaaaggtgcctgttgtttgttctgtatcccctgtgtataaaagacactttatgaggtaataggggtgctgtcacactggagaggtatacactggtagagaaatgttcttatgggccccaaacccccggtggtgtgtgcacaaaatgttttttttctgtgagaagctcgtcacagagaatatattgttgaaaagttaaacatgggtcacatatacagttgagattcttgggagagccttttgggtataaagggggagaccacagagagagagaaaaggnagagttccacaccgctgcaacagtgtctgcttgttgtgcttgtgtcttgacagaatatactcttaaggaagactcttctataggcacacttttggtgtgtgtgatatgtgagatttatnagtttgagagggagagccccacgtgataagagaacacacttctcggggtgaattttttggggagaaaccacaaagtggggttccacattggtgtaacacatgcacttctggctcgagaacttgataccacaaactgcgtgtgcactcctctcgagaacacacgggcacacacaggtggagaggcactttctctcctcgctcgtgtgggctgttctctcacgtggctgtcttctttgtccacaaataagaagtgggtgaacagtttgaacttggacacgagatgttaatcactacacgagaaatccttgatggagattaataataatgtgtgttttaacttttgaaatgttgacacaaacggagaataaactttaaaactaatttctcacgagggaaatatattccaagcatgaaatatgttgctttttcccagaataccaaccagtatactcatga

SEQ ID NO: 498696 - DNA, 120 bp, Homo sapiens
aactgggctgtgctgctttagcctcagaccccaggtcagcatctcggtctgcgccacttccttgtgtttatatggcgtttgtctgtgttgctgtttagagtaaataaactgtttatatct

SEQ ID NO: 498697 - DNA, 226 bp, Homo sapiens
tggatgtcaggttctgcttcctgacaccaggtgaccctcctcgtgttcaagacataacctatctagctgactccattctcagccccaggtatactccagcccccagcttgtcatctcttcctctaaaaagcctccagctcagcccctagtttccaacaacagtcagtgggaaccaagtgggcaccctgggatgtacggtgctccttgctcccagtcctgagatctt

SEQ ID NO: 498698 - DNA, 776 bp, Homo sapiens
  misc_feature (611)..(611): n is a, c, g, or t
agcggagggaggtggccggtctccgtcgctgacctctgacggtttctgagcgttgcgcctttggcacgcgctacccccttttgctctctggttctgccatgccgatgtaccaggtaaagccctatacacggggcgctggcgcgcctctccagtgtggagacttcccacctgcatgtacctggctccccaacgtgcactggcagtgagctacggcccagcgccgggcgctggccacgtgcatggaacgagtctaacctgtctctgcgagctcttgagtcccgccaagatgatattttaaaacgtctgtatgagttgaaagctgcagttgatggcctctccaagcatgattcaatacgagccagatgcatgacttggcatgtaagccaactagtaatgccaatgcggatgaggcccacaaactttaaccaccgaatgctgctgggacttgacattcagtagctctgggaaggattacgggggcgctgcacaagacgatcgtgcatcaacgacaaaccggggcctcccactcccctcatccctggcttgtagctagcgcagtgctagcatctgtgacgcacttacagggtacctgtccatcaggtgcacacgcnactcctcgagtcaaggagcgtgccttgaaaaccttctcaagtgctttggagaacagaataaccaaacagccccggcaagactatcagctgggattcactttaatttggaacgaatgtgccgaagacgcagactgagcattcagcatccaggacgatgtgccccaa

SEQ ID NO: 498699 - DNA, 1222 bp, Homo sapiens
cacgcgtcggagtccgtctcaaaaaaaggaaaaaaaaagaaagaaattttctttactgaactaaagcatctcttacaaggtgtccattataaagggccacattacatgagttggtatttcttactggtgccattcatttgggattcatctggccttaggctactgggacatttaagactgggactggccttcatatttctggtaggtattagctgggaactataatatagggttaactccaagtaagtagggtaggtgacgacataggttgggatggatccagaaatgaaaccaggagcaagcaggtttagttctgggattatagggtaaagtataaaattaagtgaatcattcctaattcatttagattggaatgtgtaggtaatagtaatactcaggagatacaataccttgtgcatatataagtttacccatgggtaaaaatgagataataggctaggtgcatgatactctaaaacttccttccaaagtctgaaatattcatgctataccaagtaaaaaatgcacaagggatccacaatattcaggtgatagaaatagacatcgacgaagaacataagactagtaaacaatgtacaaggagtctcccaattttataacattcaccttcattcagaacgcacaaaaaaaccttatggcaatcgtgaaaacagttaatttacctatactggaataaccgtgaatatagaagcgtggagcatgatgcatacaccgtggtaccctaaactagcgaatgaaagtccagaaaacactacacatgcaagcaagatgtacaggaaggacgcgaaaagcaacatgacacatgaggaatggaaaaagacacaccggccacagggatgcacaaaagagcgcagagacactacaaacgggcacaagaaacacccataataccgaagagaaacaatacagaaaaaaggcacacacaaagacacaagaaatgagagacaaactaggaccacggggaaggacgctgaacaggaaagacgagggacagcaatgaaaaggacgcggccggcaacaaaacagtaggcgactaaagaaagagggagaaaagacagcaaaagcgaggcagaaagaaaactagagggcagaaaaagacacaaaaacacaaaccacagaattataaaagcaccaacaggaagtaacacataataaacaagagaaacagagccaacaacgacaggcatccataatagcagac

SEQ ID NO: 498700 - DNA, 328 bp, Homo sapiens
taatcaccaggcgcggtagagcgaagaaatgtaaagcgatactgagctccttctattcgtctcttcatactacccagtcgagtccttcaacactgcctctctctctctctctctctctctctctatatatatatatatagtttgacctacagagactgagtctccctctgtccccaacgctggagtgcagtgggccacaaactcggcgtgcgtgcaacactccatctcctggggagtgtcaagcgatccatctacctcagctttccaagtagatgggtccacgagtgtgatgcaacacacccaggtaccgctggtgattccggggtac

SEQ ID NO: 498701 - DNA, 161 bp, Homo sapiens
atccatctcaatttcaatccattagatttcgtacatccgcaagtcgaagctgaagtggcataccagctgcacctttccgtgctacctattaaagaacaatgagtgtgatgcaccaagtctgaatttcgtccagcctctctctgaactgtgatctttgtcct

SEQ ID NO: 498702 - DNA, 249 bp, Homo sapiens
ttatctgttgctgtatgctacaatgcaatatacaattataattaatatactactatcatttaagatttaagattcatgtagcttgttactatgtttgaatataatattgcaattaatatagtaatatcagttacgatatagaattaacatccattactatgtgttgtgatacatagaattaatatgttactgtgtgatactatgtaatatactatgacaattaatataattgtatcataatgtaaaaaa

SEQ ID NO: 498703 - DNA, 1508 bp, Homo sapiens
  misc_feature (304)..(304): n is a, c, g, or t
tctatcggggcatccgatatctacatttttatccctttttcattttccagtgtgtatattttctcatttattgtggccaaagaaaaactcaaagagtggttatatagccgaaattaacaaagtggtgccagtgttaaaagttaagtctcgtggactttaagaagtgttcacaaatttttaaagaacattacagtgttctcacaagtgtttattatctcatctatttaatataacatttcatacgaggtggatataatcttatatcttatacaaaacacaaaaaacaacatagctgcgccataanatatatctccccttataattgcggccgaatattctccgagatatatctacaaatatttaataagagagcccaatatgtgggagagacacacatacgcgcgagacacacatataatatatacaggcggtgtctatcaccattcttctctctcatttctcgcgtgggagagaacacagagcgcgacgctgtgctgcgcaagagaagggctctctgcgctagatcatctttctccgcgtgaagcgactttctcacactctacactctctctactgagttgtacacacacagagacacacacacacacccccacacacagagagactgtgtgagagagtgtgcgtgtatctcttctttatgtgtgtgtatattatagtggtgtgtgtagtgtgtgtgtgtcgtgtgtgttctgctgagagacgagtgcgaggagtctcactgcggcactctgtggtggttcacacccccagaagaggctgttgtgagagtcgtgcacaaaagtggcggcgtgtgacacactctcgagcagcctcccactggtggggcgacgacctctcacaaacactactcctgtgggggtatctccaagagccggaacaatcatcactactcgtcgtggcgcccctcaagcgccctctcctcctcgtgaagcgtaatagccgcccggagaggagaaccatcacacataagggcggcccacccgcgcgcagccacacaacaaaggaaaacaccccccaggggcgaataaaccacttctaagcgggggacagataatctatctcacgcagacaacaaacgagaccacggggggggtgatccaaccacccacaatggtgtgttgcagcggtcacccacgagcgcgagggaggcgcccctcacaagagcaccgccccctggtagaaaccccctgccggtgggaaacattccaccaagccccgggagatcactgcggggagcctctccacccaaaaaagcgtgcggcacgggagagagaaaataacagcacaagcggccctactatactgagccccacacaccaaaccaaaccccggtgaggagacaggtcagcaagaaacgacgggcaatcactcactctaacaacagcagattaaatccacacaccccacgtggatggcgcccgcccgggtattggctagcaccccccccaggtaatgtgtcttgtatgccccgcacgtagttgaatcaa

SEQ ID NO: 498704 - DNA, 204 bp, Homo sapiens
gaatgaagttaccatgttatgctgttatgtcctaaaattcaagtcgactatgtgagaaaccctcaaattgtgcgtttcattatataatgatacagttagacaaaaccgcagactgagccatttgaaacaagattctctccattggagtttgtagcgaggttattgctgggtatgtcatgagaaggctaaatatcggtgttaatt

SEQ ID NO: 498705 - DNA, 186 bp, Homo sapiens
ggtaccaatcccgtttccacgaaatcctcaaagctatgcaaatactctgcagattctacaaaaagagtgtttcaaaactgctctatgaaaagaaaggttcaactctgtcagtagagggcacacatcacaaacaagtttctgagaatgcttctgcatagttgttacgggaagatatttccctttcca

SEQ ID NO: 498706 - DNA, 405 bp, Homo sapiens
  misc_feature (72)..(72): n is a, c, g, or t
ggacgaggagaaagagactcgagagttttttttcttttaaaaacaaaaaaagtgaccaagggggggctcctncccccggaaccacgccgccgccaaaagaaacaatagggaagatgggaacgccacagcgacagcggccaacgggacgagaccaggaaaagggaacggaccagaggacgagccgacgcaaacagggcccccaggaggaaggggcgagacgcaacaaacgcggcagagccgggaaccaacacgcgcgcaagggagccaggggcgggacaaagggcagaaaacaaaggcggcgcgacgacaaaaccgcaaacaacgcgaccgccaggagcgggggcaggacgaacggggcgaaagaaagcggggaggaaggggggaggagagacgcaccagacggcc

SEQ ID NO: 498707 - DNA, 512 bp, Homo sapiens
  misc_feature (8)..(8): n is a, c, g, or t
gcaataanctcctactggactctatcagcacgatgagatgtctcgacatctacagatacggagatcgcggacgggttgtgctggagtgaggggaagatgtcagtagacagaatgtaacatgatgactcgctcattggtggaaatgctccgctgaaggccccgagggcgaaggtaccgaaagcacagtaatcactggtgtcgatattgtcatgaaccatcacctgcaggaaacaagttcacaaaagaaagctacaagaagtacatccaagattacatgaaatcactcaaagggcaacttgcagaacagagaccagaaagagtaaaaccttttatgacaggggctgcagaacaaatcaagcacatacttgctaatttcaaaaactaccagttctttattggtgaaaacatgaatcccgatggcatggatgccaataacctccctaggtttcagcaaaggttgcgtggcttgacctcatccttttctctactgtgtgttccgcacgcactttctt

SEQ ID NO: 498708 - DNA, 422 bp, Homo sapiens
cgcagtcttctcccatcagtcagacagcccctattcaagtccataagcatttactgaggtggcttggtgcagggaaatggcaggccttcatagccataagtatgggagttcacatcttgactgttccttactgcctgtgtgacctcaggcaagtgacttaacctctctgagtctcagctgcctggttgtagaatggcagtggtaagagctagtgggtcctcatgggaattaactgggatgttgtctataagatacttgacacatagtagggcagctcacttaccctcagggcactctggacatggttgcaggagagacgaggtagagtctgagtactcggagagggaaggcaggtgggcaggccatgggctgatgggagcaatgggctcacctgagcctgcttgttgcctgcagctcaacga

SEQ ID NO: 498709 - DNA, 771 bp, Homo sapiens
gggcaacagagtgagattccgtctcaaaaaaaaaaaagaaaaggaaaaaaaaatagcattatacctcttcctgtgtttcaaccgccatgaaaattctgaacactccaaattcagttgaataatccaaaacaaaatttataagtataaacataatttgacttcttatagtaatagtatacctttaaaaaagcctcaggggtatataatcttctaaacaggctacaattcagtggcagctacattaaccaactatgtcctctagtggagaacaactagggcctatttcactggctggtgtagcctcagttgcctaacagtgggtgccaaataaatattcgtagaattacactgggaatggtaaaaaccattcgtttggtttacaacttggccaaaaatctcaaaagggcccggtatttatggtaatccttggaacattataatctattgtaatttctcagttatggactggctggggtgtggacttagtacataagtactcaatattataaaaacctcaaataatggacttgattttacacaagatccttccctttttcctacaaggttaaatcttcttgacaacatccattgcgctcatctccctaaatgggtatatccaaagggtcctaaaaaaccccatggcttcacaactttatgttgccttatcgagacacaaatcgggtaaatttttccccaaacactttcccacatgttccaaggactacattcgacggagacattcggcgagcgaaaaaactctaacctgtgcac

SEQ ID NO: 498710 - DNA, 166 bp, Homo sapiens
gccggcgccacagtgggcagctggagcgatcgaggctgcacgcgcgccggggagcatgactgccgtcgggtgcaggccagagctttggcaaaggagccccgcggtcctctttgaaccttcatccgaccccatcatcacgtgtgtggccctgctgtggtcctgtcct

SEQ ID NO: 498711 - DNA, 1167 bp, Homo sapiens
ctgttcaggcggcctgggaacgggcggtggggagctgggcggatgctggccctgcctctgcctggcctggcgccgcagtctggcgctgggcctgcgccctgcctggccgccaactgccctgatgctgcttgctgagtgccgatgggagacgtcggggcctgcacctggaggtgagcctgcctgctgctggcccctgagtgatgtgggtgctgttgccatgtgcggacatgcctctccctgcgtgctgacgtggggtgctggtggtgctgtgccctgcggaaggagtggcttggtctcctggcccccctggaccctccccttactctcccctggacttgagatgggcccgaagttgggggcaacaccccgggcattgagggctttccatgctctcacagaaccttcagcatccccaagctgccggatcttgcggccattcattcgaaagtcaaggagaagtcattaccgctgcttctggatgttcacactgcttatgcacctttacagactggagcacgctcgatatctctcttcgtatctactttcatcgacgcaagaaaagtgcttgggactcccacgttactcttctcccatgtgggtgataccgcgacgtcactgcctccgatatcacacgctagtaaacgtctggcgtgacacaactgcggcattatgcgcgcattccaatgtgcagggcgaactgcgtagtaccgtttcccatcaccccagcagggtatcgacataccttcataacgtggctggcactttctgagcgtgccccatctgtatgtctgtacttcatggtcccagcctaggcactttccaactccgcgtacagggacataattcaattctgaaggtactcccgccagtccctacaacggctacccaatagggcccagacgaaacaccactcggcgcagcgcaactccgagcaagctactaaaagcaattttaacacaaccacatcggctagattgctatccccaaggcaccctggataaggaaccacaaatacacacacagagcctcttaacagcgcctaacattcgcttgctaaccaaggaagttcttccaacccgggggcgaattaaatatcgacaagcccacaattagatcgtcaatctgggcactccaacacaacaaaaccaactagcaaaggacctcacg

SEQ ID NO: 498712 - DNA, 778 bp, Homo sapiens
gacgaggcttcctcgacagagtaaaatttaaaatcactctttcgtctgggtgcggtggctcatgcctgtaatcccagcacttcgggaggccgaggttgggggatcatctgaggtcaggagtttgagaccagcctggccaacatggtgagaccccatctctactaaaaatacaaaaaaattagctgggcatggtggcgagtgcctgtagtcccagctactcaggaggctgaggcaagagaatcgcttgaacccaagaggcggagactgcagtgagccaagatcatgccattgcactccagcctgggcgacagagtgagaccctgtttcataaataaataaaatcactctttttactttatatattttttgagacaggatcttgtggtacgcaggctggagtgcagtggtgtgtgatcacagctcattgtagcctcgacctcccctgggctcaggcagtcttcctgcctcagcctcctgagtagctaggactacaggtgtaagccaccatgcctggcccttaatatattacaatgagcaatgtacatgttagtcccgcttgaatccatggtttcacttaccagcaagttgatcaaatctacctcgctagttcagactgcaagccaagttaacgtcggcttgcaagatatcacgaaggggaaccatcacgcgcctccacgtggcccctaagttcaacccacccaggccaaccacctccagcagacgggcccaaaggggacaacgccacgcatcccccttggacgccccaagggagtaccac

SEQ ID NO: 498713 - DNA, 138 bp, Homo sapiens
  misc_feature (65)..(65): n is a, c, g, or t
agggtcctggccagcagtgtgggagcaggaggggaaggatagctgtgtactccagggagtggggnactagaactgggatgtcttggcttgtatgttgaagcttcgattatgatttttaaacaataaaaagttctccat

SEQ ID NO: 498714 - DNA, 386 bp, Homo sapiens
ttttatttatctaaaatggggattgatttttagggcggtttttaaaaaaaaaagtgttgggaattaagccagtgatttattgggaaacctactgaatggaaaaaatatttagatttaaaattaggtaggttgaagtttttttttttaaatgataaataaatggtgaaaataaggcttattgttaggattccgttaggttaaatatgccaaggacctcccatgttttggcccatagtaattaattaaaaaaatcgagccccctttatttcctaaaaagcagggttgttagttttttggtttacttttgttttgctggggcctttttccctgttttagtgtccttttattaataatagttaccataaaggtttacctttttttagtta

SEQ ID NO: 498715 - DNA, 979 bp, Homo sapiens
ccaccgcgtcggtgccaagtagaggcccttggcagcctcccacccccacctgcagttccccgtgagccagtcatcccacacgtctgatggggcatgtgtggtgacgctgccaggtccccctggacacctatcaagcgtccatctccgggtcctgggtacatcatccccctgcagggccctggtctcactaccatagagtccctgcccagctagcccatggaccctgggtcgtgtggcccgtgaccaatggtgtggatgaggccctgatggggagctgttctgggacgatgtgacgatgatgcctgtgaattgctggcagcgaggggcctacacgcaggtcatcttcctggccaggaataagcgcgatcgtgaatgagctggtacgtgtgaccagtgagggagctggcctgcagctgctgacggtgatctgtcctgggtcgtggccacggtgccccgtgctggtcctctctccaacggtgtctcctgtctccaagcttcactctactgccccggaccatgcgaaggtcctgtgccatctgtggtctcgctgtcgttgggcgagcacgtgttctcgggcagctggtgttatgccggtgcggagtgtgtggtctctccagagggatggctggttccccagtgtatagcagagcctgtgttgcgggcatccgctgtgtgctgggtctgggggtttgcatgtgtcaccctggagctgggcacttcacattccaacgccgcgggcgtcgcttgtttccagctcctgggccggggctcttggtccccaatgtgtcttaggagagcttctcccgagatcgtctggggtccgtggcctgggagggtgcgctgtgttataacactcgggtttgcctctccctgtgtccgctgcgggggattagccccccgctcatttgttccgccggacacggggccgcggggtgggttaaccagctctgccggtttccaggggccggtccgtgtttcc

SEQ ID NO: 498716 - DNA, 266 bp, Homo sapiens
gaggatcctcccgtacgccaatgattatcagtgttaccattattccagagcacaagtaaaatcagaattgactacattgtcctcctatggataatgccaatgcagatggagtagctgtctggtggcatgtgagctcctaaaggcaggttcagttaaaagaagcaaagaaaagtaacctcggttagggcattctcctcaaagcaaccaaagttagcagaaacactaccaaattgatgggccaggtaagggctagcagggtgcccagg

SEQ ID NO: 498717 - DNA, 163 bp, Homo sapiens
tctccgtcacatggctgtatccgtctttatatgtttaaaatgctggcagccgtgatagaatctttgccctgtaacctccttgcatcgattgaatatgtagggtgacttctgtagttgagtttgcatttatatgtaatctacctctgaaaatttgaaatgtgga

SEQ ID NO: 498718 - DNA, 307 bp, Homo sapiens
  misc_feature (78)..(78): n is a, c, g, or t
taaaaaaccccccccccttttttattggggagggtggggccccccccccgtggtttttttttctgggggaaattttcnccccccccccccccggttggggcccgcgggggagggtttttttttttttttttttgccccgccccgaggggcgcttttttgggggggggggttttttttttttttttgggccccccccccccctttttttgggggggggttttttttttaaaaagggggttttttttcctcttcccgggggtttttttttcccccccccttggtgatacccccccctggggggggggta

SEQ ID NO: 498719 - DNA, 356 bp, Homo sapiens
gacccaaagacaagcagcccggggccgggcccaaaaccaggcttgggcctgcttggcctaaacccagtggttaaaaatcaactcataacttagaaactgatgttttttatagattccagccattgtatagaagaacattgtgaaactcccggccctgttttgtttttttttgaccccggggggatgcggcccctgttaaaaaccgccgggtgggtcaaatcaattatgccccttttttgggaattttttagttttgtgggcccttaaaagggggggaaattgggcatttgggggggtgggtttttaaggcgggggcctggtgaggttcccaggtgaataaagcccttctttttcca

SEQ ID NO: 498720 - DNA, 386 bp, Homo sapiens
atgttcagtgtcagtatacaacatggtcaattcttgtgatgtcacagctcacgttaatacagaaggtggtgtgcacttgatgaaccttgagctaagcttgggaatcagagtgaactattgtccgcatccactttaggtgtagctagctcgcgtaatggtagaaaatcccgtgaggttgtgtatcagcccggttaaagccataagctgttgttagcagcgctttgtattgagtatcgtgagttacatagaactagaatagttgaacatcctatatgtatgctcacttccctggactgcagtataatttgagatacgttgcccagtacacccacgactcgtagttccgatcttatattcctacatcaacgtcaataacagcggtgttg

SEQ ID NO: 498721 - DNA, 132 bp, Homo sapiens
tagcagcctttcaggccagctcctgaatcttgcgtggccctccaggcccagactctgcctcccgtcggcctctgcagtcccaacgtctgcctcacagcagattcttcacgcccagcatctacctcactgtgg

SEQ ID NO: 498722 - DNA, 553 bp, Homo sapiens
atgaaacgttatagattttcttatctattttggtgcacaggctactccattctcggatcagtttacgagctctcggtgactcggttctgggtttcaagtgagaaaggagattcacacggaaaaagtgaacacacaccactcggtagaccaggcagcccctttaaggcatagatatcctcctaaacacaaaagcataaagacccggagcccagctgagaaacgggctggcctaaatacggatctttagaaaggacatgtacggccatccagacggttttacataagccaaatctccaaaatactcaagcctacccggttcagcatggacacctaaaaagaatttggactattctttaatttattaaataaaaaaacctaaaatatgataacttcctggccttattaaacggagtgcaccaaacaccatttagagcgtgatgacggcggtccattggagtgaagggccgtgctcacatggttctatggccccacagtgtcctctgggacttctaaagagtaccaggttgtttactacaccactcagggctgcagg

SEQ ID NO: 498723 - DNA, 304 bp, Homo sapiens
  misc_feature (14)..(14): n is a, c, g, or t
  misc_feature (18)..(18): n is a, c, g, or t
  misc_feature (20)..(20): n is a, c, g, or t
  misc_feature (23)..(23): n is a, c, g, or t
  misc_feature (29)..(30): n is a, c, g, or t
  misc_feature (95)..(95): n is a, c, g, or t
  misc_feature (111)..(111): n is a, c, g, or t
  misc_feature (127)..(127): n is a, c, g, or t
  misc_feature (164)..(164): n is a, c, g, or t
tgtaccatctatgngcantnagngccctnntctgcacaaacaagcagttgctgggaacttgtcgaagtttactttttcagaaagttgaagtatanaaaaaaagtacaagtngtgacattcgttcaangttgctgctacatgggtattcgtgagctggctaccanggaaggactccgtgcgtttccgagaagccaaggtcagctgtctcataggagcctgtggtgcatggtgcatgtgtgcccatgcacggcacttgtcgtacctgctcctgcacctttcacggcacttggatatgctctgacca

SEQ ID NO: 498724 - DNA, 208 bp, Homo sapiens
  misc_feature (200)..(200): n is a, c, g, or t
acctttctggtctctttccttctctccttaatgacattaacatctattctcaccatacctcctaggcgaccctatgctcatcccaattataccctagccaaccccttagaacacccctccccacatcaagcccgtaatgaacttatttcctattcgcctacacaagttccgtttcgcgatccgtccctaacaaacttagnggaaggcg

SEQ ID NO: 498725 - DNA, 553 bp, Homo sapiens
  misc_feature (1)..(1): n is a, c, g, or t
  misc_feature (102)..(102): n is a, c, g, or t
ntatatacctcccttttaaccgccacttggtcacactgtcaggtagcacattcactttctccttacaagaaagctcagcgagatctgggctatgagccactngttcagctgggaggaaagccaagcagaaaacctcagagtggatcgggacactagtggagcagcacagggagacactggacacaaagtctcagtgatggaagagggtgagacatggccctgggtgtaaatcaagtccttcagcaagtagagaccacacaaagacaggtgctgctgccttcttttgacacagaggccaatttagtgccttaatcaagtcaccaaagccttgccagtcactgacccagccacaagccttttttctgaaattcctctccaaagacacacgggcatctgtgccccagcttctgggtccaagcccctcagcacctctcatacctcagagctctttccattaatttctctccgcattcaaaacatgtatagccttcagaaaattctgcttgctttatgaagcccaatggaagaaacaattatttgtcaatacctcatc

SEQ ID NO: 498726 - DNA, 420 bp, Homo sapiens
cgactctagagtatccgcgacagcacgcgctaacaatctggataagtcggctgaggacgccgaatagccagtgtttgctgtagaccgtgctccctatgcagttctccaccggcccacctcctcctcctcctccttgtcgcgactcggcggcggcgaggggttgcgacaaagaggaaactaccaggactgattttacccaagatgatttccacttgaataatcttaaaggatattttatgtgaactttctttctaatatttttcaggcattaacaaaggagacggtggctcagggagtacaggaaggccagtagagcaaacagaagtgttcctctgcatttcaaaactttcttcctttctatagccctgtggtgcaagattttattagaatcctacgtgaagttgttagcgcgtgctgtcc

SEQ ID NO: 498727 - DNA, 959 bp, Homo sapiens
actactatcagaccgaacctcaagaccatcttcttcgaacccgccggagtggggagaccccatactataccaaaacacttcattctgataagttcgggtcacccgtgaacaggtgtctatatgcattcatcacttagctaaggcattcgagaagtaatctcccaatactgctaacttgacagtactccgggaacatatgaagagggcaaccctaggatgccaatgaggctatgggtctgcagctatgatatcgaatgggctatccgtagggattcagcggtgtgagactacagaagatatagtaacagtaggagataaacgttgaagagcacgagcctatattcacactcccgctactcataattatgcgctatacccaccggggtcaaggtacttagaagccttgagttcgccaaaactccacaggtcagcaatgatgaagatgatctgctgtaagggctctggggacctgaggacttcatctttcgttgtcaccgtaagtgagtgtgaactggtcttagtattagcaaaggtcaggtcactagactatcgtatgtactacgaaacgtactacgtagtggggcgtcactttccagatatgtccctaatcgataggagtctggtagttttgggcacatgaggaggggtggtaagattgagtgatttccacttatatcttcagggtaacctctagagcgaatctatgtcagaattccattaggtatcatattcgtcgggtaaatctaactgagttccatgcacttgctcggctattcgaatgccgagtattcggtaccgatgatacaaatgaaaatctatacttgaggcctaactggctagagagaataaaagcagggatggaaccgtaaagaagatagaaaacgccaagggtttggtccccacaaaggcggtaaacaagggcccgtgccggtttaaaaaaaaaaaagccgcgcgggggg

SEQ ID NO: 498728 - DNA, 219 bp, Homo sapiens
agcagtacgtctgagaatcggggggggggggttggggggaaatttttggccatgatgtctgtgtggaaagcggctgtgcaaacttccaatggttataactatgtcctacaagcattaattaattaacacactttagtaagtatgtccgcctgtaattatggaacgtaggtgccaatcctccagacgggtgcgctggggtcaccgagctccgaatccgta

SEQ ID NO: 498729 - DNA, 176 bp, Homo sapiens
ggacagcagccacactctgcagagagattggccaagcaggaaggcgggaacccgggcaaaggtggcagccaccagcaaggcccaacgtggttcttccaccgctttttccatgtttgaccagccaagatacaggagttcatagagcttcagctgtatcgccagatcgtatgcatcaa

SEQ ID NO: 498730 - DNA, 430 bp, Homo sapiens
gacgcagacgcgcggctgccccctggcggctggccgcggagctccggccgcgccatgccccgccttcctccgccatttcattccctgcctgcagcacgtccgcgttccgccaccagccttggcgcacaagcgtgctccgagggcggggccgctccgggcaccacgcatagtgcgggagcgttttttagtctggttcaccgagggctagaaggtcacctacatgtttacacacatttaatttaattattaattttttattttgttttatatttttgagacaggggctcactctgtcccccaggcctgagtgcagtggcgcgaccacagccttctgcagcctcagcttccgtgctcaagggacgcgcccgcctcagcctcccaacatgctgggattacgggcgtgagccaccgcccgggaacaacttaatta

SEQ ID NO: 498731 - DNA, 411 bp, Homo sapiens
  misc_feature (253)..(253): n is a, c, g, or t
  misc_feature (358)..(358): n is a, c, g, or t
  misc_feature (395)..(395): n is a, c, g, or t
  misc_feature (400)..(400): n is a, c, g, or t
acagttgtctacagtattcagtacagtaacatgctgtacagatttgtagctgaggagaaataggctatagcatagagcctagatgtgtagtaggctctgtcatctagatatttgtaagtatgctctattatgttcacacagtgaagaaattgcctaacaatgcaattttcagaatgtacccccatcgttaagtgatgcatgactgtattgaatattacccgggcaaacaaatactcttctactttgctggttngggatataaattgggtacaaccctttttaggaacagtttgggtgggttatgtatcttaagggcccttattaaacctacagggctctttcagctcccttttacccnaattatggtatttggaaccccttattctggtggcccncatanggggggacccc

SEQ ID NO: 498732 - DNA, 305 bp, Homo sapiens
tattcgccatgtttccctaatactcctgtcccaaactgtcctcccaccttagccttccaaagtgctggaattacaggtgtgagccaccgcgcccaacctccaatttatgagtctttaagatattttaaaataagcatttttttggccgctcccaggggctcacacctttaatcccagctctttggtaggccaagaggtaggacactagtccaagaccagactgcccaacatgatgaaaccctgtctctactaacaatacaagaaaaaaattagttcagccattgggccattatgtgtgatgattc

SEQ ID NO: 498733 - DNA, 134 bp, Homo sapiens
atagtatagcaggggacaggaattactaggtctcttcctagacttctctctcagtgtagtggaacaggctttgagaatgtggagagcaatgtgcacgagtttgatttcctccagtaacttcccacattctgtgt

SEQ ID NO: 498734 - DNA, 988 bp, Homo sapiens
ctaggtccacaacgagaaaggtcgcccgttatgccatgcgacttttcacggtgaccctaggcgttcccacgctttgcgacgatgcgcttcaatcttacgtggagtccctttctttgctcgtgcgcctaccagcgttataacgttctccaggaatgtgttgtcccagtcatgctttgggaaaacgtgtgttcctcgatctggagggccctccgacgtcacggaaacgtatttggtgtcccatagcctgaagggcctatcgtcgataaagttcccactgtggtatttgcgcggaagaggtcatggtgtaggcttatcgcgtgtcacgcggaccccatatacttggaaaccatgaaaaaggttcctcctagtccccgatgtgaacttggggggtcttctcctttccaaacacggggtctaccccatcgccctctcctcctgagaagcccttcgagtacctttcaccatttgccagtctgtccagtttctgctgtgccagtgaaaggcgcacgtgccccaagagtcgcacacatgtgcagcacccgatagatggtccatagctcataggtttaaaggttccctcaggtagcactcctttgtggcattagacacttctttactcccacccacccttctgcgccatgggtaccccggccataccaggcggggctgaccagagaacgcccagaccatgacctcttacagtatgtgtagcgacaccccgtctcctctcttcaggctggctgtagaatagccagtagtgttagtgacggtgtgctttgacgtgatggcgggtgggcagcgggtcggcgggctacgcgccaggcacgtcttgtccttgatctgcccgtcggcggctccgtgttgtgttttgtgctgtgtcacgcgctaaggcgacaccctctcaccccgtacatgaccttctcgctataagcgcttctcttcgcatagtcagcgtagctcccagccccaccctcttccctgggtctaa

SEQ ID NO: 498735 - DNA, 442 bp, Homo sapiens
gtcacaccgggatatctgctggtgtggccaattgatgaagagctgaatcagctgctacaggagttcaccatagcagtggggtgtgttaccaagatacactccgagttggtagcgaaaagcggggatccaaaggtaagtttggaagcgatcatcacaccacccccaggcaaaaagggcaagtctccatcccagaagaagcctgtatctaaaaaagcaggaggcaagaaaggggcccggaaatccaagaagaagcagggtgaagtcagtaaggcagccagcgccggacagcacaaccgagggcacaccttgccgacggcttcacagtcctctccaacaagagcctcttccttggccagaagctgaaccttattcacagtgaaatcagtaatttagccggcttagaggtggaaggccataatcaatccttatcaaaagacgaggg

SEQ ID NO: 498736 - DNA, 406 bp, Homo sapiens
cggccgcacagcttctcgagtagctgggattacagatgtgcacctaccatgcccagctaattttgtatttttggtagagatgggttttcgccgtgttggacaggtctggttttgaactcctgacctcgagtgatctgcccgcctcggcctcccaaaatgctgggattacaggcatgagccaccatgcccgtcctcatgcttgagtttagatttcatcctgagtctacgcttgaatgaccggtttccagtactgggaatgagatgcggagaccccgtgggtgtggcgagctggccccggagggcagggtcggcactcttcatgctggaggcttggaacagtgtggcttggtctgtgacatttgtcgtggttccggagcttgccttgggtggcggagtgggctcccgc

SEQ ID NO: 498737 - DNA, 416 bp, Homo sapiens
  misc_feature (26)..(26): n is a, c, g, or t
  misc_feature (53)..(53): n is a, c, g, or t
  misc_feature (98)..(98): n is a, c, g, or t
  misc_feature (139)..(139): n is a, c, g, or t
  misc_feature (170)..(170): n is a, c, g, or t
  misc_feature (261)..(261): n is a, c, g, or t
  misc_feature (312)..(312): n is a, c, g, or t
  misc_feature (342)..(342): n is a, c, g, or t
  misc_feature (372)..(372): n is a, c, g, or t
actgcagctgctgcccgtccacaggngccttagcctctcttcctgtgtggaancggggcaagcagggctgtggcagacaggcctggcatagcccaagnttcaggtgtcctgggcagcctgaccggttctgagtagcctnaatgaaaacacctgagaaaaagttaactaangagggtttcccttaatcaaccaattctattaacttaaggttaattggatttgtagaaatatagcctggtactggtgatgattggcataacngtgcttccagaagactacgaagagatccgaacgtgccatgctggctgttgnactggctacggtctcgtagcccgcctgagnagaccttaatgtagctggcacgtgagtagngctcctgctggacctttcacagtgtctagccggctgttgccctt

SEQ ID NO: 498738 - DNA, 1508 bp, Homo sapiens
ggacgccttcaggaggagtctcaagaaaggacagcggtatggacttgcgtatgtgttgcgtcagtctgccagaagctcgtgccagtggcgtcgatccgtctagcaagactgccgccgtgacgtcgagggctgctggctcgtccatcgggaactgctaggccgccatcagaatgctgctcgatcgtatcctgtctaacgtggaccctaggacaaatactgagtgtgaatattctcctgaattttcgttgcattattactcgttaatgccctcaaatagatgacatgacgcttccttgagacaatacattttcgagcaaaatatcggctcattatatcgtgaccagtgggttagctctagaatatggatgtggatgtacgtggtaagtggtacgaaagtattcgggagggacagtatagtgaattaacaaggatggtgttgcaatatttatgggaatggtatttggagtaaatatgtggtttgtcatgccacttctggcacaggcctgtggagagaggtatcaaaggtacgaatcaggtgcgcatggcagtgctccaaggatggtgagctagacgtggaatagtgggtacacataggaagacccagatggttccccgttcaatgtttaccgagaacacttgctggggggcacttcgtccaacctggggaaatagaaaaccaacatgcacggatacgcgtgtagacaatttcaccgtaataagtttcatggggtatatcatcccaggtggtggatccggccacgatactctaattggacacaataggatcgcgtccacgtagaacactggaaaacggtgagggattccttcatttggcacactctttgtttcgcaagcatatagatacacaaagcacattggaatcggatccggtggggcttagagggacaccaattgggcgttcgtagggttcgttgtgtggctcgtactagcccatttctctttacaacaagaggggccgacagtggggtctccggcgtaggcattctccaaattgctctcacaaagttctcgctaaatggggcctttacgagactattaagagttgctaaatgcttgggggcaactgcttgggtgtcgcaaagctatgtcacggcaatgtataacggcggaggggccatacctcccaacatcgaggggaatgtgtgacagagtgtgttgtcccatcacacgtgcaggtcggggcacacattgggcctagcccagggtggtgacagtacacgtttaggcagctccgcgttgtcaacgcgcctagtggggggacatggccaccaccggttacagtggtgtcgccccaaagtgttaaggatatattctcacccagagaagatgtgggtatgggagccaggcttggtgagtacaggcggcgaacaacaaaggcatgtgattaagagcagcgacaagaccatcatgttaatgttcgtcacaagtagagcaaagatgttagtggacactgttatgaggagtgtgccgcgaaccatatgtcagat

SEQ ID NO: 498739 - DNA, 299 bp, Homo sapiens
  misc_feature (1)..(1): n is a, c, g, or t
ncttgagtaacaccgatgtccctgttagtcgtgtggtagacgacaatataacaatctgtgagactgctgaagctggtggcatgcctctagactctagcatcgacatttagctagtactgcatgaattgaatacgtctcgtactgtagcataacacgactacgtagtagtagaattagtagtacatactcgcactcgactagctcgactagactaactagattaattgtgaattacttgactagactagataaactagtactagtcgctagactagtcgatacgtactagtagtactggg

SEQ ID NO: 498740 - DNA, 167 bp, Homo sapiens
ctgttctcgaggatccctgagtgcggctgtatacgggggagcttgatggcaggagaatcgcttgtagcccggagaggcggaaggtatcagtgagctgcatagccactgaattctagcccgggcaacagaacaagactctgtctacacaaaagtaaaaaaagaaaaga

SEQ ID NO: 498741 - DNA, 110 bp, Homo sapiens
tgagcagtgaggcggagaagcggagagctacctggagggcgagtgcgtggagtggctccgcagatacctggagaacgggaaggacaagctggagcgcgctgaccccccga

SEQ ID NO: 498742 - DNA, 691 bp, Homo sapiens
actagttctagatcgcgagcggcctccctttttttttttgtttcaagggtaactaactccaaaattctttatttagtaaaatggtccctttggatgtcaagggaatacacaaactcaagtgtgctacaaacatagatgttacagagcatcacagctcgtgggcaggtgcagctgagtgtgcacctgtgcctctcatctccccgctgaaggtggcaagttcaagctttggttatagcccagggctgccgtggaacactagttgcccagcaccattccgtgccaccttctgtgcccccaagaagcccgtcacgagggccgtgggtgaaaggcgtggggtgggttgacaccgtggggaagaagcgcgtggcaagcttcttacaaaattctttccttccgtgcccgttagctctcccttcccttctcacccaattccgagaagtctgtgcgagggtctcccttaaagagagtttctctatagaaaaaagcggggcgtgggcgccgtgaactgtggggcgtgggtatacccagggggctgtgccccgtgcagagccattccattcagagaggacacgggagggaaagacaccgtgggaagaactttccggggggccccataaccgcaaccacaattcttgaaacccgcgtggtgaaggaagggagggagaaatcccaggggaaggggccgggcccc

SEQ ID NO: 498743 - DNA, 543 bp, Homo sapiens
tgtattacacacctgtattgcctaaagtttctataacaaacatcttacattggaacgatattcttgtttttattttctacaaaaaaaaaagcggggggacgttaaaattaagcatagaaatggtggaactttgggatttcctgtccagccacctgcgagccagggtttattccaattgattcaacgtggcagattaaatgggaaaagtaaaagggtgggctcctttaggcagcaaggcttgcttctctcctgggtacctctgcctacatagatatttggttaagcaagatgtttatacccccacacatattctagaaagtcctggtcatgaagcaagtcacaattttccatatctgcccaatttttaaaaaatgggactaccccatttggacaaaaaatctttgggaaggtaaggttaggccaagccatgggaggaaaaattggaaccaacttcccttggaactttcaaaggaagaaaggctccctttttccttactcaaactcccggtggtatgctggaaaatgccagcaggggaggggcac

SEQ ID NO: 498744 - DNA, 506 bp, Homo sapiens
  misc_feature (78)..(78): n is a, c, g, or t
  misc_feature (81)..(81): n is a, c, g, or t
  misc_feature (89)..(89): n is a, c, g, or t
agagagagagagagagagagagagagagagagagagagagagagagagagagagagagagagagagagatctggtttnatntaggcctntttggtatcctttgatgtgcaactggattattttaaagcaaattctggatgacattctgctgagcatttctgccagaattacacctctctttgctaatgtgaaaaaatgcccatgataactgtaaaatacgtgtgtcctattgaggtgtctaaacactttaatgtcacagtatggaggccttaaaatatcgctgagatatgtttttctaaataaaaagactgcattttttagatatacagaaaattgagcagagaacagtgagttcccatatacctttttgatcccaacagtttcccccttattaacatattgtgttagggggggcccatttatcacaagggaggggatattggatatttttttgattgaactaagatttttatagctctcacttttgggggggatagttattttgt

SEQ ID NO: 498745 - DNA, 230 bp, Homo sapiens
cctgttaggtctgactctagagttatccccggcgcttcggggggtaaggcgaggttagcgaggcttgctaccaagtcatcaaaaagctattagtgggagtagagtttgaagtccttcagagaggattatcatgcgactgttagtgcgttcgtactttgagtttgctaggcagaactagtaatgaggatgtaagtccgtgggcgattatcagaatgactgccccgatcacg

SEQ ID NO: 498746 - DNA, 109 bp, Homo sapiens
  misc_feature (71)..(71): n is a, c, g, or t
tagaggatttcccgtgagacgacttgagtgagcactacgccgacctgcgcatgtacgttgcgcccgagccncatcagcaggccaatcaatactggctggcgcgcaaggt

SEQ ID NO: 498747 - DNA, 169 bp, Homo sapiens
cttctctacagcgaagacaccctcaggtgggctgtctgcccccggccccgtgatgctgtagaaaatcgttggtgtctctatctttattagactagagctgattcagtctctgggggaagggacccttgccatttgcagggacagatattggagcaaccacccaatctct

SEQ ID NO: 498748 - DNA, 105 bp, Homo sapiens
acacaacgctgactcttccctggacatggcaataaaacaccactgcggcactggatcccactagactacaaggcataaattgtggcccagacttcactccatcct

SEQ ID NO: 498749 - DNA, 384 bp, Homo sapiens
actggcgtctggacagaggagctctcaggcagcccgacctatgcttctgggagcaggtttctcacagccagattctcggaaattctgactttctacgtctatgatggggcccaggaccttgcactggggaggagtccctgggaattctgattccagtggcttagagaactctttttttggaaatcgtgaattcactcatctctactcaattcttctcaatatcatccaagactcaacttgagcatgacttaattcttggaacaactttacacagaactcacaagtaaaacattgtacaatgcttatctgaactgtgctggttacatagaagatttctcaccttccagaaacgcccatcaaggtaccctactttagacagggagg

SEQ ID NO: 498750 - DNA, 1940 bp, Homo sapiens
cggcggcggctcccgggcgtccgggcccggtggcggcgcgtgctgtggttggctgagcgccgcggtgccgcccggttccttctcgtgccgaatcgcgcacccaggttctcgcacaccgttaggaccgcttactagcttactaggaccggcgctacacagcactcgcactcctatatcactacactcacccccaggcacctgcacacacagcattcctgctgaccaacctcgctccaacttgcttgacaatagacccaccctgcgcgcatgatcagacgcacactaatccatcacaccgcaactacctgcgaaccacctaccgtgcccgcagaccatgagaacctaagccctgccccgaccacatgcgcagcgccaccatcacaacctcgccctgcgtacccctctacctaaactctcacactgacacaacccccgtactcgaccactaaaactaccagcaactcccaacccagctcaggccacacctcacacgccgcaagcccccacacccgtccattaacacacggcccggcgcacatacaccagccaccaccccacaacacggaacagctgcaaccgccacccccacgcccacacatcacctacaaccacgacgacgcaggacacactaccatcaacacatggcatacgaccaaactccttcaacacccgttaacgcgcagtacaagacagaaacgtccatactcctacaaaaccccacctacggcacacatttacgatcccgcatacaatgcagacacactccaaactcagactcgacagcaaaccaactatctcgcacaccaactccccccacacagacctggctccgaaactccaacaccgcacacaaacggacaactgacataccaacacccgtccaccacgagctttgcggcgaccataataacaggaaaataagagtagcacagacatcgcaggaactacaagcacatagtagcaaattcagtactggaaacagcacacaataacagataggccaggacagcacattaggcgacaatagacagacaaacagcacaaactaaataccaccagggtagaaagaagaagcgcacaaacaaagacgcgaaaggcgagatccaaattagaacacaaaagaacgcacacacggacacagccacactaccgaaaccactccgccaccagcacacacagaacagacacaaacaaatcaccgaccaaccacccacgccaccacccacaaccgcacgcgccacccacactcatagaccccgagcacgaacacccggccacgacggcaaagccccaaccacttcaacgccaacccatacatcccacaagcggaccgccacacactccgacacccagccacacaccacgaacgaacacccaacacacacaccccacaacacacggcaaacaccaccacacacaacgaaaggaacacagacagtcaccaaacacatgacacccacccaccacgacgacccaccgcacccacacacaaccaccacccccatccacacccaatacactaccaactaccataaacaacaccatccatcaaactaccttcaccatcctaccacaccacaaacacctccacaacacaacaacaacaatacgctatacaccaaaccacacactcaacaagaacacgaagaaaaagataagcaaccacacgcgcacgacaaacaatattacaccaccacactgacacatatgcatccacaacgaaaccaccctaccacacgaacgcaagacacgagacaacgaaagagacacagaaccaagacagagaccatcacaagccgcacatctctcctcgctctatcaaccacgacgaacgcaagacacccccacgacaaacctggaccaaccacactcgaaggccacgacacgcgacactgaccagctgagcgaccaccctctcccgcacaaacaccacaacacat

SEQ ID NO: 498751 - DNA, 120 bp, Homo sapiens
ccagtgcatgcaggtcactgatttcatcctctagtttccgcacagtgcctaccataagtatgtccgacaagcctagtagaagggagacatcaatactcattgtaccgacaggtattacca

SEQ ID NO: 498752 - DNA, 308 bp, Homo sapiens
cctccttatttgcacagggaaccttcaaacaattgggagcagaagcagaatgatgcctgtgaagcctttgccccttatcctcagctcgctgcctcccctcaactccctccccatatactgcggtagctgcatgactccagcaggattccaccatgaaggtcaggaagccttcagcagggggcaagcattgcctggcgaggatgtgggtgctccagacagcctggatcagagttgactccagtcttgggtgagaatgagattaagggctccaagaatgttttccttacaggattgacagaataaaggca

SEQ ID NO: 498753 - DNA, 140 bp, Homo sapiens
tgtagaataagcatagagcatgaaacccaagaatgaaagagaaaaaacacaaagagaaagagagagacaaggagaagaagaaagaggaggtcccgaattcttgtaaaaactgctgaacaaactcttcagtttctcttaag

SEQ ID NO: 498754 - DNA, 979 bp, Homo sapiens
cacccctctacacgctgggcgtcacctacccggatgagaacgtcaagtccagctgctcgcccgtctacattgccatcttctacacagcggccatcctgggtccagctgccggctacctgattggaggtgccctgctgaatatctacacggaaatgtggcctgacgtgacggacgtctgaccaccgagatgcccactgtgggtcggcgcctggtggtgtcgtgcttcctgggctctggggccgctgctttcttcaccgtcgtttcccatccttggttaccctcggcagctgccaggttcccagcgctacgcggctcatgaaaggcggcggacaaatgcaccagattgaaaggacagcagccgctggggaggcgtcgcaacccggacttctaggaaaaccattcagagtactctgcctctctcctatctggctcctgctggaagaacccccaacagtacattccgtgcttctgctcgtggcctggggccgcctgaggccactcgtcatctaccggcatgtccagcgttcaggcgcgcaatgttcttggcagttgccaggttcagcctgagtgcctcagaagctgccaccttgctttgggtacctggtgctgcctacgcggagtggcggcggcaccttcctggcgcggcttctctatgtgaacctagctcaggctccgcgggctccgcgtgtcatccaagtactgccctgttctgcaccgttgtacatcctgctggcgcatccgtcgacctactcactgcactgccccagtggtgcccatggcggggccgtcaccgccagctacggcgcgagcctcctgcccgaagggcacctgaacctcagcggcttccatgaaaccgctgtctgcagctggcacccgagaacctacagccctgcgacggctccgaaggacccatgaagactcaattgcccacagggtaccagcacacacggaaaagaatgtggaacggcagaaggcaccg

SEQ ID NO: 498755 - DNA, 955 bp, Homo sapiens
tgtgctactagacaactggtaaaccgggaatgatcgttcaaaagcagagacctgctttaggccagggaaacaggaaaagaattgagggaacaatctgtcccaccacatgcatctacgtgcaggtctgtgctactgagcacaactggtaaaccgggaagatcgttcaaaagcagagaaagctgatatggaagaaaatgaggcagcatttcaacgtgattagactgaggagacccacatgtaaactgctctagagctaatgcagtctacaatagatggcagagagggtgcaagatgaggaggccggaagatgatgactgggatgaacaagtattgcaagaaagccgcgctatgagtgggttcagatagcttccacgttgaccttgtaacaatagtgtggatgaatatcagttttttacaacgaagctctgataactgtgcagagtcgagatgcagcctggtaccagctgctgatggcaccactcagcgaggatcagaggacagcactgcccggaggtgtacacactgtcagagcaccgacggacggtggcagaggcaaagaagaagattgaacaacagggaggcttcacctttgaaaacaaaggagtcctctccgcatttaatttgggactgtgcccagcaacaactgaaggaaagaacatcagctgaccaaatgtcatcgctgcgttttatttcccaagaggagtgtgagggtccggggatgaacatgaggggctgctttagggcctctgctgtgcagttaccatctgccttttgggcacgcctttatctactcttccccttgaccttggccccggcatatttttttaaccgctctggtttgactggagacaccactggcgggaaggcaccctattccaggggagccagtggtaggtgggtactcggcgcccgttgggccgaactgggttgggacaaggcctgtggtctataccac

SEQ ID NO: 498756 - DNA, 288 bp, Homo sapiens
gtgcatatggctcacgtctgtaatcccagtcacttgtgagtaaggctgaggcaagcggatccctggaggtcaggaatttgagaccagcctggccaacatggcgagaaccccgtctctactaaaaatacaaagaagttagccatgcacggtgacaggcacctgtaactcccaactactcaggaggctgaggcacaagaagttgtttgaacccgggagaaggaggttgcagtgagtcgtgattgtgacatccctgtccgaggcctgggcaatagagtgagtctctgtttc

SEQ ID NO: 498757 - DNA, 460 bp, Homo sapiens
  misc_feature (65)..(65): n is a, c, g, or t
cagctgtgttgggccattccaaaaaatgtcagagaaatctgtctcggggtaaaatctcagactcnttcaggacctgctttcaggtgatgctatacagagcgcatttgaagttgggtatcttattgctacaaggcgtttcttccgtcagtcttaggatctctattttcatgtcactgctgctcagttgggtctgaaccacaaagggtggagggaatactgaggcgtgcccgacccctcttctccctcatggcctgaatgaagttttcaggtttatttgggtccccttggctgagaggaggatccgttcagttcattgaggggcttagaaatttaattttaatttacattgtaaagtgtaaacatatacaatgttgatcagttatacctgaatagagctgagggaaaagagaataaaaggaaccatgactaacaacaatgaaaagaaatggaaaaaaaaaaa

SEQ ID NO: 498758 - DNA, 374 bp, Homo sapiens
catagttgagcgctccggatactcagacgtcatgagtgaggccttgccgccgagcagtttaccaatataattgtatgctctataatgtgaccattcaagatgtgtaacatatgtcgctaccaaagacaactgctacatcttacatgaaagattctctaagaatggaccaactacctctgccattgtatatgtgcaggatactaagcagatccaagtcgacaaggatctacagtacattggacgacatgttacatcagagatggcagctcagttagatgtcgagcagctggtacactcagtccacttaactcataattcagatgaatcatcaatcatcacttatgatgcatccattttcacacatgactcacgtt

SEQ ID NO: 498759 - DNA, 411 bp, Homo sapiens
ccctacagagatcttgtggaatagttttctaaactggaacgtttcaattaagtcctcaacagatagaaattatacatgcctcattctcagaccactttacagtaaaatgagatattaaatataaaggctgggtgcggtgcctcacgcctgtgatcccagcactatgaaaggccgaggcaggtggggatcaccgaaggtcaggagttctagaccaaccgggccagcgtggcaaaaccccgtctctaccgaaatatacaataattagcaaggcgtggtggcatggctcaagtggtcccggctgctcaggaggctgaggcatgagagtcgctcgaacctgggatgtggaggtttcagtgagccaagattgcgccactgcactccagcctgggcatacagagtacgactcttatc

SEQ ID NO: 498760 - DNA, 127 bp, Homo sapiens
gttccagggtgacagccacctggagcagccgggctgtaccatcattgtgtggatgagaacatcgagaggagaaaccactacttagacctggcggggatagagaactacacgtctcagtttggacccg

SEQ ID NO: 498761 - DNA, 173 bp, Homo sapiens
cagaatacagactttatttttatttaacaaatggataccatattaccttcatgggtgggaacagcttctgcaagcataaaggggaagagaaaaagttagaatggccgcctcagtttctgggcaatattgaggtccagattttcatccaaaaagctgtttgcaatccccagggc

SEQ ID NO: 498762 - DNA, 310 bp, Homo sapiens
caacatcctctctaccatccccaccacagcatacagcctccagacacctgcttctactcagaggactcaggtctcatatcacgtctccatgacgcttcaaataaccattcccgcctgtgcagtccacacatcactctgagctgtccaactcctctgtactccatcatgatgctgtccatactcctcatgatgctgtacaccatcctctgatgcatgtccaccatcctctgatgcatttacagcatgtccaccatcctctgagctgtccagcagtacacctcctcagtgctgtacaaatcctctgtgctgt

SEQ ID NO: 498763 - DNA, 214 bp, Homo sapiens
tatgcaggtaagtgatgtaactcctctaagttagaggcagaaatagtgagaacaagatgttattacttttttaaagtatccacggtatgctgtctaccagagactcacggtagattaaaagacccaaatagtactttaaaaattagtccggcatgagggtgctctccggtagtcctagctatttgggggactgagtggggaggatcccatcagc

SEQ ID NO: 498764 - DNA, 377 bp, Homo sapiens
cttcgagtctcggtacccgtcagacgctgaactatgtgtatgtttttatgactgtaccatgctgttttggttactatagctttgtagtatattttgaactcaggtagtatgatgcctccagctttgttatttttgcttaggattgctttggctatttggggtctttagtggttccagataaaatttttggaatttttttttttttttttttgaaacaagatcttgctctgttgccctggagaacaggggcatgatctgggttcactgcaggctccacctcccaggttcaagggattctaatgcctaaccctcccaagtactggaattacgggcgtgagccaccatacccagccgggtttttttcaataaatatatgg

SEQ ID NO: 498765 - DNA, 383 bp, Homo sapiens
tccaagtatcttttctttggactccgagaatctcagaggttcttttatctctcgaatatgctttgccagctagtcggataccagcatctcttcgtcttcactctcagatacactgtcatactctccagcagctagttctcagctcttctatactttttctaattcttccaatttcttcatgataggctggatcaatatgatcagctatatatataggccttcccagatttctggtatcttatcatgtttttcagacaaattcattaaatcccagtacttctgaagatccaaaatataatcatctcccatttccagctcaagatctcgttccctcttcttcctggactcctcagtttccatcctcttcctgcgagccaccactc

SEQ ID NO: 498766 - DNA, 1008 bp, Homo sapiens
ggagcgggggccgcactggggagtgtgggctgggccgcgagatgtcatgtggcctgtgtttgggaccgtggttctgtacctatggctccttatgtcacattccctgttgccttcgtgagtcggggctgtgggttaccacctggaatggttcatcaggggaaatggacccccaacccgtggaggaggaaaagagctatctcagagcgccggtgaggatcgctatctggattgagcttctaggcaaggaccaaatcgcaggtggtgagccttaacggtactcagtctagcaattgggccccgaatatgctgtgtctgaagcagaacagccgcccagagatagaattaatgtgaggacacagggtccctatggtcctactgtgggtggtgacttgtcctgctaccatgttgacagagccccagtaagccacatctaattggctttgttgcttattctggcccttcccacagcacagaggcacacaaatactggctgctccttgatggccatggcagacccagcagcagccgaggggccagtgaagaggaaggccgcatctgtcgtgtggtggccacaagcactcaggcatctgagtttactggtgcactgctgggaggagagtcatgagatgaacattgagtgtcaatctctgtgggcaggcgggtttgggctctagtgggaatggctagggatttgggccgttgcctttagaaggggatacctgcactgtctacgttccagtactgcaactggaaaagaagttcacaatatgcacctgggctcccttcaagtatcacggccctatcctttgtgctcactttttactgagagtccggtcttgtcaagctcaggaaattggaattccgccaggaaggaaagaacttgtctgatctgggaagccaaaatggtcactttggggcaggacaaacattgttcctctgtattggttggaaacggaccattttctaccccataagtattaggaaaagtgtaaaaggtattgaaccata

SEQ ID NO: 498767 - DNA, 148 bp, Homo sapiens
cgcattgagattgctcggggcgaataggtatgtgattaggatagggcttaggatgagtgggaccgaagaaagagaggaagtaaagtttaatatattgtcctcttttggcgtcgagagtaatcccgtgagagggggtaccagagctcga

SEQ ID NO: 498768 - DNA, 788 bp, Homo sapiens
tttttttttaagaaggaaaacccggtaatgatgtcggggttagagggataggatggaaaagggggagataggtgtatagaccatgagggtgtttcctcgtgtgaatgagggtttaatgtggtcaatgtgtgggtggggtgagtgtgaagccccatgtgtggtgttgtggtggataaaaatatgtgtataaagggagataatagggcgtggtgacttagttagtgtgtgagctccgtgtataagtctaggacgagtgtgaatattgtgactcagagaaaagtggtggtatactcagcaacagagaagatttcctccccaggatagcgctataaatagcgtggggggtataagggccggaggttatagccgaaggtccttgtgctagaaaagtctcattcaaaaacgcttatttagcgtgggaagttagaagtattgtgaagtctccctctggagaaagaagtgactataatacactgcgcaaacttgggggagactgtcgcgcgtctcgcgcaaaccttacgagagtgttatgcgctatccgcgcacacacattatctgctaacactgcagagagtatgtagtaaaatgtccacgagcggcgcgccacgaatccttatgcgaaacactattgcgcatctgggcgcgccgcgtgtcagaaaactctctccaagggcggcgagtctacgggagtcttcagcacaccatgggcggctctgtcgcacctaccaccaaacgggcggctccatctaggcgcgctgcgctttcgccacacccaactttattgagcg

SEQ ID NO: 498769 - DNA, 297 bp, Homo sapiens
tagtaagtctaacctactttttcttcatatgcattgcctattctctagatactttattataagtggaatcaagtaatatttgtcccttttgtctggcttctttcacttagtatgttttcaaggtttattcatgttgtagcacgtatcaacttcattcctttttatacgtgaataatattccattgtatgtagatatcacagtttgtttatccatttgtctgtggatggacgcttggattgcttctaccttttggatactgtgaaaatgctgctatgaacattggtgtacacgtctct

SEQ ID NO: 498770 - DNA, 150 bp, Homo sapiens
agctagatgctctacatttagtatatgtatattagtaatacctgatttcattatagtatagtactagtgtgtagtgtgtgtaatatagctcattgggcatatattatgaatggttactcattaattcttattccaggtaaattccatcaa

SEQ ID NO: 498771 - DNA, 439 bp, Homo sapiens
tggagaatcccaaaggggccagttttggccccttcaggtcctgtttcaggatttgttctggttcctgaggtttagggtggtaaggtgagccacacacccctccgtttgcaccagttgcctgcaggttggatggaacccagtgccccacttttttgcaagtaggtgggttgtaaagggtgaacaaagccatgggaggaaggtttggcattgggaagccgccctggggacaaacgaaccgcctccttccccccttgtgccctatgggaggccggtggtgggtggagcccttaaagtccagcctccagggccggaagcccctcctgtttcccgctcccattgggcccttaaaagccaaatttggtggagggaaaaaaaaaaagggaggaaaaaaggtgaataaaacttctggtcattccttgaaaaaacttgattttattta

SEQ ID NO: 498772 - DNA, 496 bp, Homo sapiens
  misc_feature (7)..(7): n is a, c, g, or t
  misc_feature (68)..(68): n is a, c, g, or t
  misc_feature (192)..(192): n is a, c, g, or t
ggaccantcgaacgtgtctatctctagttcctgctgggaaagatggagcccccgaatgtgtctatccntagttcctgccggaaaatggaaccgccatcttgaacgtgtctagtccctagttcctgccgggaaaatggagccgccatcttgaaacgtgtctagtccctagttcctgcccggaagatggagccnccatcttgaacgtgtctagtcgttagttcctcccgggaagatggagccgccatcttgaacgtgtctagtccctaggtcctcccgacatcacccgtacaagctcccagctggcttgtgtatgtctgcagctcgacttgacaggctgttcattgttagaaaatgacttggggctgctcgttaaggagaaaagctgccgggcgcagtggctcacacctgtcatcccagcacttttggaggctgaggcgggtggatcattaggtcaggggttcgagacgagcctgaccagtgaaaccgcgtctctact

SEQ ID NO: 498773 - DNA, 773 bp, Homo sapiens
acccgggggcgtaaccagagacgagtgcacgccccccgggtgtcccatgaactagacgttcaaagactccgagaaattgagagcgcatgaaagaggaattctgttccctgttaagatgagcatgctgcctgaccatgggaggagtaaggttgcgcagttcctgggcggaccagactcgttgctacagagaacaactgccgactcgacagaccgatgtccagattaccagttgtagatcctcctatatcatgaagaaatcgaaatattaagcttgatgtactgataccacacagggagtgaataaccgactaagatacttctacatagcacatcacaacaatacgagaggatagggcgcatatgagcaggtggcatcaatggcctataacataaggcacaccaagaagcacccgagggcatgaccacctatgacttcgacgaccttcgtgagactcgaaaggatcgtgggcagcaaggagactccctgttaatgttgcaatggatcaccgtcgaaggaccgtctggtgaacaatgtaagacagatcgccttaaataataggacctgcaatgaaaggttccatacggcaccagcggtcatgcaccatattggctcaagtgccataggtcggccaggcaagcttttcgaagcagtgatctcgagaccctgcaattgcgacctatcgttacttcgtaggagtcgaatggtcgactctgcgttctgaagctccacgtagcatgggacagagacgtaggcgttttacaagtactccctg

SEQ ID NO: 498774 - DNA, 119 bp, Homo sapiens
actggcctgtgggtctatgccagcagccaggcacaggcagcccgtcggggcccacgggacacggctggtccaggcctggtggtcccggctcgcccttctggcccttcactcctttccgg

SEQ ID NO: 498775 - DNA, 1025 bp, Homo sapiens
  misc_feature (238)..(238): n is a, c, g, or t
  misc_feature (1025)..(1025): n is a, c, g, or t
atggcacatgcagcgcaagtaggtctacaagacgctacttcccactatcatagaatgagcgtatcacctttcaatgatcacgcgcctcataatcatttggccttatctgctgtcctagtcctgtatgcccttttcctagacactcacaacaaaactaactaatactaacatctcagacgctcaggacgagtagaagagcgtctgaacctatcgcatgcctcgttgcatcagtccgtantgcctcatcgtcacgcatctcctatacctctacgctattcctattacgatcaacagacgaggttctaaaggtatcccttgctcattatccatcatagattcagattctggcacgacgcgaaagtggtacctggatgccatacggagttgacaccgactttggggcaggacgtaagattcttccaatttcactacatactttcccgcgcatttatatccttaggaacccagggcagaaccttgggggacatcccatgtgaccagatttgaccaaactcaggaagtataagtacttcgccgaaatgggaaagtacccctcgaatttcggctatctaaatcacagttaaactatgtcgacccaaggaaacggattctttgcaactatctagttggaagccatggttcccccgaacaagttataatggggcggtttaaaaatagcaagaatttgactaagtttaccctcggggaacgggtttctttaaaatcggaagatatgacaagtttttaaaaacaggtttaagaagggaaccggaggtgaggataattgacttaagcggtgttcaaatggcatttcctggaacacatttccctggtgtggaagggcaaaataacccaccatggatttcggatgagcccccatatcgtttaccgtaagagaatggtcaacatttcccggcgataaagggaatactcttgagaaacgctaaagggggccccggtacttggtaccccacttattaggcacccgacctctgtttaaccccacagtcttacaaaggccaaan

SEQ ID NO: 498776 - DNA, 1116 bp, Homo sapiens
ggctgacttctgcatctggaacactgccttcatcttgaaagaaaagctccaggtcccttctccagccacccagccccaagatggtgatgctgctgactgctgctttccgcactggctggcctcttcggctgcggccaccagggacaagcatttcatcttgggaagctgccccaatcctccggtgcaggacaacttttgacgtgaataagtatctcggacagatgcgtacgaacacttgagaacgcatcccaacaacctcttgacgactggaccgctgcatccaggccaactactcactacctgcgcacaacacggaaagatcacaagctgttcaaaccacggagtagacgacgctgaattggccctggtgaatcacatctctgaacgggctgaacgccacccccaagttcaagctcacaggagcctgccacacctggacagtgcacacgtcatccccatggctaacagcgcagtacgggcaccggacctaggagatcccctgaacacaccgactacgagacaacgcactgaccacccgcaagaacaccacagcaccctgcacacataacacaacaccgacaacggtgcaccacagcccggacccagacacaacgcaaccccactaccactaccctcacacaaaaccgagagacactcgactaacaacaccagccactagacacccccagcacacactccgacccacaaccaacacagaacgacgaacaagacccaaggatcagcacgagccaacagacaccccgcaccgccacgcacacacaggggcgacgcacacgcaacacaccctcactgggaacagcaccattgaaaccggagtccacacctagacaacgaccggtccccgcggcgtagaccaagaatcacgactacgcggagacctggcccagaagcgaagagagaccaagcgggtatagtagagcgagagagcacgagccggcagcggaagacgctcagagagaggcaactaggagggggcagggagcgtcgcaagaacgaaagcagagagtgcggacgacacagagggaccgcagcacgaggtaaatcagtaggccggagggacgtagaggagacctagaaaacagccaccccgccggc

SEQ ID NO: 498777 - DNA, 294 bp, Homo sapiens
  misc_feature (13)..(13): n is a, c, g, or t
  misc_feature (15)..(15): n is a, c, g, or t
  misc_feature (18)..(18): n is a, c, g, or t
  misc_feature (21)..(23): n is a, c, g, or t
  misc_feature (25)..(25): n is a, c, g, or t
  misc_feature (27)..(27): n is a, c, g, or t
  misc_feature (30)..(30): n is a, c, g, or t
tcggcccttactncngcnccnnncncnacncatccggttaccaccgcgcagttacaacagctccagttacaacagctccagttacaacagctccagttacaacagctccagttacaacagctccagttacaacagctccagttacaacagctccagttacaacagctccagttacaacagctccagttacaacagctccagttacaacagctccagttacaacagctccagttacaacagctcgcagttacaacagctgtagataacaggagctgtagtgacaagaagcggaaa

SEQ ID NO: 498778 - DNA, 237 bp, Homo sapiens
gtcgctctagcggatcccagtccgggtcccccaactcttcgttgtctgcagctcatctggtccctcaagtaagtgtcttccggctcctttggtatcttcctttctggtcttgcctcctacctttggtctcttggtgtgtggggactgtttgtttttttttgtttttttttgttttttttgtttttttttgttcttttgttcttgattgagattaggttgttcattttagcttttttg

SEQ ID NO: 498779 - DNA, 298 bp, Homo sapiens
  misc_feature (13)..(13): n is a, c, g, or t
  misc_feature (15)..(15): n is a, c, g, or t
  misc_feature (18)..(18): n is a, c, g, or t
  misc_feature (21)..(23): n is a, c, g, or t
  misc_feature (25)..(25): n is a, c, g, or t
  misc_feature (27)..(27): n is a, c, g, or t
  misc_feature (30)..(30): n is a, c, g, or t
tcggcccttactncngcnccnnncncnacncatccggttaccaccgcgcagttacaacagctccagttacaacagctccagttacaacagctccagttacaacagctccagttacaacagctccagttacaacagctccagttacaacagctccagttacaacagctccagttacaacagctccagttacaacagctgccagttacaacagctattagctctagcggtccatgcatacttaatattatacttgaattcaatacgagctgttgtagctggagctgttgtaactagagct

SEQ ID NO: 498780 - DNA, 256 bp, Homo sapiens
  misc_feature (134)..(134): n is a, c, g, or t
aggaatgagctgctgtgaggaccgtcatcactgtctctctgttgtcttcctacttcctgaaccttgactcaggtggttggtgtcctcatccacagttctcactgacctctaagctccaggaatggcagatctcnacccctaagccttcacatccgtttgctgtcatgcttgtgcccacaggtttctcatttggcttttggtcatgcccatgtgcccatgtgtagacatgaaatgccttgtgtcagatggactctgg

SEQ ID NO: 498781 - DNA, 359 bp, Homo sapiens
  misc_feature (13)..(13): n is a, c, g, or t
  misc_feature (15)..(15): n is a, c, g, or t
  misc_feature (18)..(18): n is a, c, g, or t
  misc_feature (21)..(23): n is a, c, g, or t
  misc_feature (25)..(25): n is a, c, g, or t
  misc_feature (27)..(27): n is a, c, g, or t
  misc_feature (30)..(30): n is a, c, g, or t
tcggcccttactncngcnccnnncncnacncatccggttaccaccgcgcagttacaacagctccagttacaacagctccagttacaacagctccagttacaacagctccagttacaacagctccagttacaacagctccagttacaacagctccagttacaacagctccagttacaacagctccagttacaacagctcccataagataaaggggggtggggaggtaacagtcgaggcaagaaaaagatctatttaggattcagcttgtccacgtctcccacagcgcttaagcttcatacttgttccgtcacttcatccatcagcgcttgtatctgctgtggcttgactgttgtaactgg

SEQ ID NO: 498782 - DNA, 279 bp, Homo sapiens
  misc_feature (13)..(13): n is a, c, g, or t
  misc_feature (15)..(15): n is a, c, g, or t
  misc_feature (18)..(18): n is a, c, g, or t
  misc_feature (21)..(23): n is a, c, g, or t
  misc_feature (25)..(25): n is a, c, g, or t
  misc_feature (27)..(27): n is a, c, g, or t
  misc_feature (30)..(30): n is a, c, g, or t
tcggcccttactncngcnccnnncncnacncatccggttaccaccgcgcagttacaacagctccagttacaacagctccagttacaacagctccagttacaacagctccagttacaacagctccagttacaacagctccagttacaacagctccagttacaacagctccagttacaacagctccagttacaacagctcggccattatgcattacaaccagacagttgatatttggtcagtgggatgcataatggccgagctgttgtaactggagctgtt

SEQ ID NO: 498783 - DNA, 347 bp, Homo sapiens
ccgcgcgcgtatcggggtccgggattttggcccagcccccgggggctttactccagttcccaacaagttcctcatcttcatctgaggccacctcagcctggactttgttgtccatattgctatcagcatttgggggggacgggtcaacagtctgtagcactgcccccttttttcccccgggagccccctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaaga

SEQ ID NO: 498784 - DNA, 290 bp, Homo sapiens
  misc_feature (13)..(13): n is a, c, g, or t
  misc_feature (15)..(15): n is a, c, g, or t
  misc_feature (18)..(18): n is a, c, g, or t
  misc_feature (21)..(23): n is a, c, g, or t
  misc_feature (25)..(25): n is a, c, g, or t
  misc_feature (27)..(27): n is a, c, g, or t
  misc_feature (30)..(30): n is a, c, g, or t
tcggcccttactncngcnccnnncncnacncatccggttaccaccgcgcagttacaacagctccagttacaacagctccagttacaacagctccagttacaacagctccagttacaacagctccagttacaacagctccagttacaacagctccagttacaacagctccagttacaacagctccagttacaacagctttggcttctgcttcttttatctcagatgctttccgcttcatttccttgcacgaatgtctcacagtctattgaagcggatagcatctgagactc

SEQ ID NO: 498785 - DNA, 159 bp, Homo sapiens
tctttccaagcggagatgctgaccaggtggcgctgaacccgcagaacaccgtgtttgatgcgaagcggctgagtcggccgcaagttcggcgagcccggtggtgcagtcgcgacatgtaagcactggcctttccaggctgatcaactgacgtgagacaat

SEQ ID NO: 498786 - DNA, 1052 bp, Homo sapiens
gacccacgcgtccgggatttgtatatgcaacacagtaaggagatcttccattttactacctttcaagtgaaaaatagcctatcatacaatatgcttgatttcagattttcatactaaaacttaactacatacttaaaagtaggttcttatcaagggtctctaacattgctttttaaaacaagatgtgaactaacttttcttaaacatttttttaaatgcttcatcttttagttttatataaagaatcccacatgtacattcttgttttagaatggggtgactaccttattataaaattccaagtttccaagagacttcttttcattgaggcttcgtaaagttttccattttgattctgactacacataaaaataagataaccctgtagttatcaagggtctctaacattgctttttaaaacaagatgtgaactaacttttcttaaacatttttttaaatgcttcatcttttagttttatataaagaatcccacatgtacattcttgttttcagaatggggtgactaccttattataaaattccaagtttccaagagacttcttttcattgaggcttcgtaaagttttccattttgattctgactacacataaaaataagataaccctgtagttattaagtgtggttctgtacaagaaacaggtaagtaacttattgtaccagttaatgccaaaaatattgttcacgttaaatattcttcaggaaacaagggtaaaggtatgcttagaatttatgtaattctgtaactaattcagtatattacgttatacaatctttatatacaatgacttttccatggggtactggtttggggaaaactaggtcacgttttctcacgcctatgtaatattatgactgccagctaacacctataattcggctatggaaagaaatggtcctttaagcgtacggggttccacggttacagtcacggtgtcaactgtcaagtcagaactatataactcggcacgtcacactgtatattacacacagactaacacagtagtacgacaatcctcacactagaactaac

SEQ ID NO: 498787 - DNA, 442 bp, Homo sapiens
  misc_feature (278)..(278): n is a, c, g, or t
agcaggatctagggagccttaaccgtacggaggggatagaggtaccagatccatggtggaggaacacttatgctggatatgcagcaaaagaagcagctagtattcccagatcgtgtccctcaaaggcagttttcttccttctcatttatcactcccaactattctcccacgggaaggggatgggccatctggtctcccgggttcaatttcattcccacaggacttataccttctaaaaaacctcaggatttacttcaacattcaggttatgggtgggntacccccaataaaatggaaggtccgtgacagaaggaaatccggtcgggcctgtacatattgtctccagggcctaacggaagggtaggccatattccaccaccctcctatcaaccctaaggtaaggcgacgacggccaagagaactgggccccttgccaaggcta

SEQ ID NO: 498788 - DNA, 781 bp, Homo sapiens
ggcaggcgcattgggcagagggatggcaagcttgcgtgccccagcgacacaggcctcgaggctgtctctgacaggtgttcacaggcaggtggggacgcctctgcgcgaggaacgaggcagctacgggccttgggccggggttattgccatgggcaagcggttgccggcatcgaatgcataattcttcagcgagttccacctcaaggctgggaccccaaggatcacctaatcaggtcccgtgaagactttcatctccccgaagagcttgtttgggacgacaccacacagggggtcccacggttgtcaccatttttcccaaatttttttcccaagaacgccccccacacacaaacaacacatgtggggtggggcccccccaccagagcgcagcaacagagccagggggggcgcaacaccaatcaacaagagggcgcggtcccgtcaccacacatccatcattctcgttttgtcggggtggggggcgctccccccacctccataacacaaccacatcactcgcgagcctgcccatcaccaccaacacaacaccacaccatcatcaacaaacaccccacctgctcaacccaccacacaaacataacacaaacaacacctctctcacactcaacactagggtgatggcgtgccgcatcgaccaaccctccaccacccactcttctcttctatcttcttcttctttctcatctccacacctcctcacaccacaaaacaacaactcaccccactcctctcttcttctccccttctcctccacacccca

SEQ ID NO: 498789 - DNA, 220 bp, Homo sapiens
gctgggaaagagtatgcacagggaatgcctcatcttgggatgtatctttcaatccgatattcaggtcatagtggaaagacagcagagcacgtggctctctctctgtctctccctgcatctcgcagtctctgtctctctcctcggtctctgtctctggctctctcatgtctgtctctgtctctctctctctctgtccttcctttctctggcgctttatcct

SEQ ID NO: 498790 - DNA, 1214 bp, Homo sapiens
cagaaggcgcagctggacgctgtccactaacttgctggccagcaagttatttcaatggagactcaagagacccacctctggcctgccacagcaacatcctgaattcactgttttcagtgttgattgtagtaaggacaatcacatttacattttgcttgtaatggatgattaaataataagagtatataaattcgattgtatttgtttcttacaacacttctgtaaagaagagagggcagctatttctaatgcattttataattgaggaaattgtacctcattggccaaaatctcacagtgacatagtcgcgactggaaccaaggtctccatatgcaattatcctattcatggtctacctgctttattagatctgtaattgaatattcaatgatttggatttggcatgcccaaattccagtgttttaatcccttttcaaccattacctcacgtttagtttaaaagtatcacttgatatctgatttcaatagagtaatagaattttagctttatccaattacagcatttatgctttccagatattttttggactaaataattctcattctgtataaatgtgcatagccctcatcattagtcatgtattgtgttagcacctttgtgtactgcatgtgtattcattactaagcactattgtagatgttgaaaatagagcagtgaataagagagatagatgacaaataaatatacaaacaaataagataatctaagtcagtttcccattactggattggatttctattttaacacttatttctgagtacttgtggggtgatgccaacattaaatgttttgaggaagctcctttgagatggctttgaaaagtcctaaagtgagaaaatttaaaattttcccaaacttatttatgtggggtgtgcatgtgtgtgcctgtgcctgtgtgcgtgtgtgtgtgtgtgtttttaagtaaccgcatcatggctgtaatcagttaagtctcctgttctaattactacggaggaatcaaatgaaccccattgtcgaatgtagccaattatgtatgtgtgtacacaaatacaaatttttatgatagcctatattgtatattagcattatatttgtatatcttttttattctgagcaatatttgttctagctaagcacatttacattcataatttacagccttactaatgtaaataaaagtaaatatgtaattgaatgttaaaaaaaaaa

SEQ ID NO: 498791 - DNA, 284 bp, Homo sapiens
accgagttctctctgtggggactgtaatctgaccatataccggagttgaatattgttttcatactgctgtggtttgaatgttccctccaacactcatgttgagacttaatccctaatgtggcaatactgaaaggtggggcctttgagatgtgattgggtcgtaaggctgtgccttcattcatgggttaatggattaatgggttatcacaggaatgggactggtggctttataagaagaggaaaagagaactgagctagcatgcccaacagagagagcgtccgtc

SEQ ID NO: 498792 - DNA, 199 bp, Homo sapiens
tctctaaaaaaggccttatgttgactaaagaaaacataggctttagtttcagcttctgtcagaattagtaccaattctgaatctggtggagtgataagacatggtttcatgctgggaagacactgctgaaatcctccttgtgggagaacatggaaattttatactgaattaaattaacgcatgtgacttttcccattca

SEQ ID NO: 498793 - DNA, 898 bp, Homo sapiens
accacggtgtgctggcggcctgcgggcggcgctgtggcccgtcgggcggtccacagagccgccctagccttccgccttccccaagccaacgtctccgccgtcggctcctggggccgccatggccgacgttggaagacggagaggaaaaccttgctgccctggccctctcacctccgggagtctcaggctccagttcggggagggcggaccgaggatgttctccctcgaggaagtggaccgcggtgggccagttgttgtcagtctgggaccggtgtaggtgccggatacgttgcgcccatctgccagggtccagggttgatggagttgcccgtgatcttaaggattgttccaatgcgtgacagagcataacagcggagggcctgtggtggctggaccgggggggcaaggaatgtacctccatttccctttccagcaaacttgcttgcaatgttcccctgtgggtgacaccagtagacaattcggcttgcccctctcttgaccgagacaggagaactggggtggtgtcccaaaaagaacagtcgggcacaattagagacagttggtacagacacgggcttctatacgacagcaggtatgttcaagaaggcaccatgggtggactcctggatagactcccgaggttgacccctatcaaagagagcgtctacgaaaacccaccttacagggggcgatttgagactttcctttccagagattaggggacggcccgacttgcacttcttgttggctcctgttggggactccgttcgagaggcccttgggttttacgcagtttttgggcacgctataagccttccgagaatttctcctgggcagctagagggagagctatctttattaaacggggggccttctctaccctcttgtgggggtgggc

SEQ ID NO: 498794 - DNA, 958 bp, Homo sapiens
ggataggggacagctggaggtcaaacaagttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggagggaggagaagggccgcgtgtggcggtgtgtgcttggtgggctcggagagaactgctgctaggttgagggaggttggatatcacttctgattgatttcatcctggattgaaggtggatgttcaagatttcaggcaaaatctggaggatgagttagtaaagggaagctcttaaacagggtgtagatctccggtcatattcaaagcaagttgagctggagcatagggacagatggaacagaaatccattcgggattatattcaagagagtgagaatatagcatctcatacaaaacagatcacagcctgtgatgctgtccctggagcgaatggagcagatgtgggagcttttcagagtgacactcagcttccatcagtctgagatcggaacactgcaggaaacagtcaggagccatgaacattcgacttcgaaatcgccagggcagtcggggacacttggggagctcgtgatgggccctggggggagccctatcgtccgggtgcggggcatacgcggaggctcagcggacgcgcccaggaccaggagcagctcccggggcggacgccccgccggcgcagcgagcagcggagctgaggcccgcactcggacaaggaaagggggcccaacggtcggacggagcgaagcacagagtagccacgcagatcgggaaacggacataggaccaaagggggacagcactacggggcaagcagagggggcagtcggcaaccgagagtggagaa

SEQ ID NO: 498795 - DNA, 300 bp, Homo sapiens
attttgggggggggttgggggtttttttttttgggtttttagggggaaaaaaaacccccttggggttttttaaaaaaaaatttaatttgcccccttaccccggggaaaaggggcccccaggtttttttaaaaaacccccccccccctttttccaaaaaagggggggggtttttttttccccctttttttcccggggttgccttttgccccaaattttttttttaaaaaaaaacccgggggccccccccccttttttttcaggggcccccgcccccaaaaggttgggggcctttttcccca

SEQ ID NO: 498796 - DNA, 424 bp, Homo sapiens
gatatgtctccatcatcggtaccctctggggctcgctctgtgaggatcctgcttaggcgtaactctgcagtaataggctgtcaactcggacctgatatatgattatggctacaatacactgtagccaacaatgaggactggtacgctagattggcacgtgaagcaaaggacagaacctcaacattatgatctagtctaggaacacagtatcaatcgccaactggcaatggcaatgaactgaattaggcaacactgatacccatcagattaaagacctacactgggctaatttgttcacatattaggagtccataagatgcaccattctttatcaagtgcttagaaaggtcctaagaccctacagtgcatgtcaggtcagcccctataagcaaactgttaatatttagttcaacttgtcaactgc

SEQ ID NO: 498797 - DNA, 180 bp, Homo sapiens
agaggatcccgtatagcctcgccagtgcagtggcatgctgttccatcttcctgctccccgaacaccacgccgctggtattgttcttggtgtggctctggccctctcctgtacacctgccttccggggagctgggattgcaggcgtgagccactgcgcctggccccacacccaacccaccc

SEQ ID NO: 498798 - DNA, 136 bp, Homo sapiens
taccggtgttatcgatgcacctagcagccaaccgtggacagtagaaaaaataactgactaggcctgtttactcactagaaaatatatccccacatgatgagccttaacagaggtcatcatgtggcatcgataaaca

SEQ ID NO: 498799 - DNA, 832 bp, Homo sapiens
ctgttgtcttcccctcggccgctcacatgtgtattcagcagccctatggccttggtctgggcctgatgggacaggggtagagggaaggtgagcatacgcacattttcctagagcgagaattggcggggcaagctgttatcttctactattaacaactacacttcagatgtaaaaaaaaaaaaaaaaacagacccggacggcctctcctttctgccgcgggcgcgcgggagacacacagagcgtaccgagaacaggggccccggcgccctctccccggttcccggccccacccttcctggtacaacagggcgacaactcccgcgcgcgggctcccccacatcacaacagcggaccgacccgaccctcacaatccccagatacaacccaccggcgtaaccaccacgcgaccagtaatcaaacagaaccccgcgcacaccaccccacacaccacaccacccacacccccccaaccgaacgaccatcacccaccaccacccacccaacatgacgcaggaacacaccggcgacccgcaacaacgggactacgccccgacagacagaacgccacgcgccgcccacgcccccagcgagcgcatgagatgaccatcaccataagcgacttcgccaccacagcaggaggcaccacacaccaccacagcgcacaagacccgcctctgccgccgagctcgagcatgtcagcacagaccaccagcgcgacatcagcgcacacgagcacacgcggcagccgccctcgccgcgcagcgccacacgccactcgcacccccgcagcgagcgtgaccgcatcacagcacaaccgccgcccgcgacacaa

SEQ ID NO: 498800 - DNA, 983 bp, Homo sapiens
  misc_feature (20)..(20): n is a, c, g, or t
  misc_feature (756)..(756): n is a, c, g, or t
  misc_feature (800)..(800): n is a, c, g, or t
  misc_feature (807)..(807): n is a, c, g, or t
  misc_feature (852)..(852): n is a, c, g, or t
  misc_feature (854)..(854): n is a, c, g, or t
  misc_feature (900)..(900): n is a, c, g, or t
  misc_feature (965)..(965): n is a, c, g, or t
agcgggggataaaataagcntggcccggcacgctggctcacacctgtaatccccactttgtgaggctaaggcagggggatcaccagaggtcaggagtccaaaaccagcctggccaacatggtgaaaccccatctctactaaaaacacaaaaaattagttgggcgcgctggcaggcacctgtaatcccagctactcaggaggctgaggcaggagaatctcttgaacccgggaggcggaggttgcagttagccaagattgcaccattgcactccacactgggcaacaagagttaaacatctcaaaaaaagagaaaaacaaaatgagagtttgccctccatgtgacaaatccatgggggctctcattgagggatctgcccttcccaaggctcagaaactacaaacatggagaagacccagggaatgcccaggagttcctaccattttcccagggggacagtttcccagaggagcagcggacaagctggaacctatcccagcccagccttgtccctgcccagacctgccaggctgttcacccactcgctgggtgctcagtccatccatcctcctcaaagagtgcccgcagagcgtgcggcccccacgggtggtgcccacggccctcgctcacacggccctactcaccatattgccctgttcgccacccccatcatcgtagctctttctctcagttatctcttcaaccatccaaccttctgccattagatgtgggcattcacaggccctgaggtgggcctnaccctcactctctcccataggctgtgtccggcgctgtccctgcngtgcggnggacacacaaaggccccagggaaggtctggtggcggttgcgcaananctgctaaccacatcgtggagcacagctggttcgagacaattatcancttcatgatcctactcagcagttgagcgctggtaccctcctggggatgcagggttgttgcagganggctggaggaggagggga

SEQ ID NO: 498801 - DNA, 923 bp, Homo sapiens
gatattatactagcattcaccatctcattgctaggaatactagatatatcgggcacatctcatatcctccctagtatgcctagaaggaataatactatcgctgatgcatgatagctactctcataaccctgcgaaaaccaactccctcttagcgcaaatatggtgccgtactcagtgcatactgaatgtctaatgctctgctctgctgaaatgcatacggagggctcatatggcgcgcatagctatggcgtcaactcgtcccaagcctatcactactgagctcatatgacgtagcgctacagtaactcgtgaagatccctacctcgcaatttgcataaacacttaagtcctgtctcggcaatcatatatactacttcatccttaccacttagatcacttgacttctgtcctcatagaaactaccataggtggtggcagtcgaacgagaaccaggccagcagacctaaattcattagcattcatccaccgccatacttacttttcattaaactcgagaaagtcatacagatcaagaacccctattttcagtccctgtctcccctctaacaccttaatgccatgcgctgaatccttcccttaaaactaaattcacgcgcgcgtcccatacaatatcttaaacctcaccatagaaattctcatacacatcattcaacaaaatccactcgtggcacagtcacaagccgaccattaatctaataccgagtcggatactcaccgttactgactgcacagatacacatacttcctacacgtcatgctacttaactaaacttctctcaattatcatacactcatgccctctaagtttagtaagcgtttcaccagtatactagattactcagtacccgttaacctactaattctacgtaattaggactctcagccggagctaggagaactcc

SEQ ID NO: 498802 - DNA, 307 bp, Homo sapiens
caggatcacttgagcccaggagtctgataccagcctgggcaacatagtgagaccacatctctacaaaagatcaggtcaggcatcgtggctcaaccctgtaatcccagcactttgggaggctgagactggaggatcgcttgagctgaggagttcaaagctagcctgtacaacatagaccctatctctaccaaaaacagtttttaaaaattagcccgacatgcctgtgatcccagcactatgggaggccgaggtgggcagattacctgaggtcaggagttcgagaccagtctggccgacatggtgaaac

SEQ ID NO: 498803 - DNA, 236 bp, Homo sapiens
  misc_feature (45)..(45): n is a, c, g, or t
actctacaggatccttatccccggttctgggtacgtacacatcantacccagggaggaaaggttccattggcacagcaggcgagaaatattcatttgtccattagccctgtggggtcatggctaccactgcggctttctcctggtctcccatccctccatggctgctgggctcagcctttgtctgctgtgggcatgcccaggcacacgagctgggaggggaaaggataaggagagg

SEQ ID NO: 498804 - DNA, 656 bp, Homo sapiens
  misc_feature (40)..(40): n is a, c, g, or t
gagaaagcaccttgcagctccgtgagccttgttacagcantgggccagggggcaaggaaagctggcaaacacatccaaggccaccgccactgctgtgccaccactacagcccctcctagcgtcctcctgctgcctcatctcatggggactacctatagcagcacaggcaaggagagaggaccaccacgcgagacgccgcagcgcgagacctactcagcgcaacacaccagacaagcacggagcgcatgcgtgaacgcaaggagacaatcacatcggataggggcacgaatggtggagattaaagacggacagcaatgcctagacatgaactcgtactcacagcacgtgtactcaatgccacaccgaggggtagatacctataaattgtaaacattcaagaaccacattcaagtccgacacgcatcaaacgagatgtataaccacaatggaaaacacagcgaaagccacaggggagtcagagttgaagagtgacagaaatattacgtgtggacacgagaacaagtaacagggagagaaggcaccagaaatgagaacatacttggatggattaattaaagctagaacgtaaatcaattagaagtaattgcgaagaagaaggaaaggtatgcggcggggatttgcaggatgaagaaaaa

SEQ ID NO: 498805 - DNA, 351 bp, Homo sapiens
ctaaattcgcggccgcgtcgaccccaaaaccgtaaaaatcctggaagacaacctaaccagtaccattcaggacataggtacaggcaaagatttcatgatgaagatgccaaaagcaattgcaacaaagcgaaagttgacaaatgagatctgattaaactaaagcgcttctgcacagcaaaagaaactattaacagggtaaacagacatcctacagaatgggagaaaatttttgcaaactatgcatctgacaaaggtctaatatccagcatctaaaggaattaaacaaatttacaagtagaaaacaaccccatttaaaaagtgggcaaaggatgctgaacagtgccgtcgacg

SEQ ID NO: 498806 - DNA, 1013 bp, Homo sapiens
cgcagcgttaggcatgctgttgttgttgtactttactgccgcggagtttcccggtattccagcaagtcgagatattgacagtaggcgctcccatgacactctgttgattacggaaggagagaccaaggtcacaggaaggcgagacgcaggagcgtgtacctgagtgcacagagggtcttacaagtgaatgtggcacccgagtaccacccagtgatgacatgatcactaggtcctctggtattatccagctccaacgattatagcttagacacgttcgtggcgctggattggtgtaacacatgtaggcaggcatgaagtggtgcctgcaatggagtgcacgaattcagattttcctggccacactaaattgaaccgaccgaaagtacaaagatggcgggagatactaccggaaagagcaaagcccacaagaggcatgaacaccaacgaagaggctccaaagccgacgccagaagaatgtgggaaatcgggacagcacggtagtcgggggcgcgcgacccaaagtaggactcgtgacaatctcacgcgaaaacgaacaagcacgggcgcgtgcacgcgagggaatagcacacaaaacccacaaaagcaagaagtgggccggacaaaatccgcatgcaaagaacgcaaacaaaaaaaaaaacgacaaaagacaaaacgcggcagaaacaaccataagctactagagattggacatatacacagtagggcgttccccgggaataccgcagaaagacagaaaaagagaaaaaccaggacaccaggccggacaacgcaaggagagcggaaaaatcacaaacgcgtatcttgttgactgtggggagcacacacgaggcatggtgcatgttgcacgacgtcagtgagaacgaggaaacgacaacaggaacacggagcggaggaagcaatatgaggagacaccaacaccgaacaccaaagagacgagagaaaacaaaatcactaggggaacactagaactacacaagacaatgttggacaaa

SEQ ID NO: 498807 - DNA, 120 bp, Homo sapiens
cccgctcatgccagagtcacggcttgcaccacggggattgtcttgaatagtccatgacaattcccccagactggtctgccgtgcacaatctcatcatttggggccatgccgtatagttgt

SEQ ID NO: 498808 - DNA, 93 bp, Homo sapiens
gcaagaggtatattgtggacacttactttgctgaagtagctgaaacataaattaatgagctggaatcattttccagagcagaacaaagagaag

SEQ ID NO: 498809 - DNA, 164 bp, Homo sapiens
  misc_feature (22)..(22): n is a, c, g, or t
  misc_feature (39)..(39): n is a, c, g, or t
  misc_feature (144)..(145): n is a, c, g, or t
cagtgggttccctccttacctnggagtgcagttgtctanaggccttacctgagctgccctctcggcctttctgaccttttcccctaccgtttccttgctcatctgttatgatgttcttactgccttctgttgctgtaatctgcnngatatgtttccacgccgag

SEQ ID NO: 498810 - DNA, 425 bp, Homo sapiens
gagtcgactctcgtaggatcccctcgcgaacgtgttatccctgtacgggtatggggatgggagaacggagtttgtgttatatcaaaatctcgcacctcagagtacctgactatcttggacttcacgacacttcagcttctaacgccaactctgactctctccttctaacaacatcctatcactatagacccatatggcatcaaccacaaacgcttctactacctacttaccctcactcaactcccacttctggctccagacaactacaaactgtactcctgcggacatctccatgctgcatccactagcaaccttccacattttccatgtcctcacttcaggcatctaggagtccactgaggtcacttaaccatctctactcagagtcctcacagaggatcaggctgtctgaaacctgcagggac

SEQ ID NO: 498811 - DNA, 373 bp, Homo sapiens
catatatatattctatactttatagtcctataagtactctaagtccttgtgtaattattgaggacaaaacgtcacttaaaggtaaaaggaatactaagttgcagactagcaactgtatagcatctcacaagaacaaaagccttaacaaaccgtatactttatgcaaacacagtgatgcctcactgccttagagagacaagtcacatgccatcagtgtgtcagaaaatatctttcttcagtgatagttaaggtcacctcgccagctactttccagagacagctccaggacaatactggggacaaaacaaaatcagagccataggaccacaatagagccctgtgcaacaaaaagatgctaaataacagaattcaa

SEQ ID NO: 498812 - DNA, 245 bp, Homo sapiens
  misc_feature (1)..(1): n is a, c, g, or t
nccggacatgctgctcacgtgcttgatacatatttatttcagaatcacaattgtaaagattaggccgggtgcgggctcacgcctgtaatcctaacactttgggaagacaaggtgagtggatcacctgaggtcaggagtgcaagatcagcctggccaacatggtgaaatcctatctctacaaaaaatacaaaaatcagccaggtgtggtggcacccgcccgtaatcccagtcactcaagcacgtga

SEQ ID NO: 498813 - DNA, 500 bp, Homo sapiens
  misc_feature (357)..(357): n is a, c, g, or t
ccacaaccatatgatgagagatacagggtttaaacatggacaactcctgttaaaacctttatcaatgtgttcatcaactcagtaaccacagagttctgtcaacagctaaaaagagtttagaaaaagaggaagagctttgtttgtttactcctttgctgtgtacatccaaaatacaatggtgggagaagatttgttctagtttttcccaaagatactccttagggaatgcactcaaaagaacaaaataggttttctatgactccacagaaatagaatctgtagtattatttttgcttaaatgtgattaggtgtgaacattgctttgttatttgtttcctgattccagatttggaatanatagcccttgatacaggatttggagaagattttggtattaatcaatcatagacttcaggagatgatttcaataggtccttttctggaatttcatttcagtatagaaactgtatgggcagaatttttattattattattattat

SEQ ID NO: 498814 - DNA, 368 bp, Homo sapiens
atgccgtgtcgcaatctcagctcactagcaactaccacctcccatgttataacaattctcctgcctcagacctacctgcatttgctaggatttcaggcatgcatcaacatacccagctaatttttatatattttttggtatatacagggttacatcatgttggtctggctggtctcgaactcctgatctcacgtgatgcacccctcctttgcttcgctcattagctgagattataggcataaaccattgtatccggcctgagaagcatagttccttgtgtttaatttaaccattttaaagtgctcaagggtatttgaaaacagttctctcaaatattataaatagtcttgtttccttttttttttgaa

SEQ ID NO: 498815 - DNA, 423 bp, Homo sapiens
gcggcattcttgcgggatatcttctgtaacgacatcccgctgatcttccgccgcgagctgtatgccagcgtgtcgttcctggctgcctggttctacttgctgtgccttgtacctgaagctgcccagcgagcaagcaattctgctgacgctgttcagtggttatccatgttacgcctgctggcaatccggtttcactgggaaatgcccaagttcgtctacaacgacgatgtgcactagcgcgcagtgtgttgctccagagcccattccacgtgttcgcgtaccaactccgacgggtagtcccgccgcgccttcaatgacttccagcactggaatgctggagggagcattacccaggcccaccgaaaagttgcgtaacccgcgctcgtaaccggcgcgacgaaatggaacgcgattaaacttcgg

SEQ ID NO: 498816 - DNA, 284 bp, Homo sapiens
cttgatttcagagtcctcttcagtcattgattgattggctcctactgggatggggcctctgcccagctggacctcttcatccatcctggctgcacagcctgtctcttcacatgagtcagacgtgcagggtaggatcagaaggagatactctggggtttgtgtgctgccagcccggctcagactccgcccttgggaaagataaccaccatctgctctaatcatgtagacgtactgccgcctggtttctctgttacaataaaattactatagacccaaaaaaaaaa

SEQ ID NO: 498817 - DNA, 733 bp, Homo sapiens
ggtgggaccacattgaggtgtctgatgatagaacgacgagacgcaccccaagcatcgacacggccagtctcgttccgctggctggaatcagagcccgaggatggaacgcatgtgagcagttccagaaggagaatggaggaatctggacaggggctgccgcggaagtgctaatcagaccagaggttgcgcctgtaggttgtccaacgagggatatactgcagatgtggacgcttgcgagtgttgcgcccggacgtggccggacaagtggctaggaagcttgtggaaggcggcccatttgccataggggccccgaaggggccacctaagccaaaagggacttgacagaacaaaaagggggaaggggcaagccggagaagccctagggggaaccggcacacggcacaaattgccttcgcggcactcgggggcatgaaatttgccagagccacaaaggaaaaccgggggaaaggcaaggaccgaaagtgcaaattgcccccgcagtttgtagacagcatcccacggtttggagagaaccgaaacgggggccaatttccaaacggcgcgaacaacatgggacatcccggcgcggtcgatttcgatccaaagcggcctaacagacgggcaaaacggcccacaaatttgcggcgctcacaagcgacatttttaaacccgccacaaaatggccccccgccgtggacgcgcgaaccaagtgcaaccacgcggaaacagcgca

SEQ ID NO: 498818 - DNA, 1651 bp, Homo sapiens
  misc_feature (1601)..(1602): n is a, c, g, or t
  misc_feature (1616)..(1616): n is a, c, g, or t
  misc_feature (1618)..(1618): n is a, c, g, or t
  misc_feature (1622)..(1622): n is a, c, g, or t
  misc_feature (1625)..(1625): n is a, c, g, or t
  misc_feature (1634)..(1634): n is a, c, g, or t
  misc_feature (1641)..(1641): n is a, c, g, or t
  misc_feature (1647)..(1647): n is a, c, g, or t
gcgcgtccgactcaaactaggttggaaggtcagggaagggttcctggcaaatatgaccaaagctgagatctggttagccatgctaaggagaaagcaagaagcttctcaagcataggggacagtagcagatgtccagaaatgagactgagcacagatatttgggaacccattttggagcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactaaatactgactacatttctctgttaatattgagctaaatgttaaaaaatggctagattaaaagatatcaatttgtagttctccctacaaagcaaaaattattaccctactcacttttcgtaggctacaaggatatttgagtgcctggttatgaatttctcaaatcatgttagatgagcgtacggttaaaaagtctggtgtgtttttgtgttaccaaatagggcaaacgttaacttagacagacccccagcttaatgaggtcagaggaacagaggtttcacatcctgactccagaaatgggtagctgctagacaaaatcggggcaagacctgtggaatgatgcaatgaggtcaagaaaaagggtttagagaattacagcctggatattcagctctaagaaaaatgtgattgacaacattgaaaatgcagactgtagttatacacaacgaaaagacagtggggctgatccctaggcaggtgtagtnncggctcagcttctnanactngangcctatttncatattnagaaanggaa

SEQ ID NO: 498819 - DNA, 243 bp, Homo sapiens
gcggccgcctactactactactgctcgaattcaagcttctaacgatgtacggggacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttga

SEQ ID NO: 498820 - DNA, 201 bp, Homo sapiens
ctattgtgacagatatatacagatattatgtgagatataagagcagagtatatctgacttgaaaataaaatattatagtgtattaactgagatacagtaataagatatgtcaattattgggcagatagataatagtttatagggcatcaacatttaattctataaaaatgtatgctttctgttactcttacaaactactta

SEQ ID NO: 498821 - DNA, 1628 bp, Homo sapiens
  misc_feature (11)..(11): n is a, c, g, or t
  misc_feature (14)..(14): n is a, c, g, or t
  misc_feature (1578)..(1579): n is a, c, g, or t
  misc_feature (1593)..(1593): n is a, c, g, or t
  misc_feature (1595)..(1595): n is a, c, g, or t
  misc_feature (1599)..(1599): n is a, c, g, or t
  misc_feature (1602)..(1602): n is a, c, g, or t
  misc_feature (1611)..(1611): n is a, c, g, or t
  misc_feature (1618)..(1618): n is a, c, g, or t
  misc_feature (1624)..(1624): n is a, c, g, or t
ccgtaggctangtncgaggcctggcttctgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactaaatactgactacatttctctgttaatattgagctaaatgttaaaaaatggctagattaaaagatatcaatttgtagttctccctacaaagcaaaaattattaccctactcacttttcgtaggctacaaggatatttgagtgcctggttatgaatttctcaaatcatgttagatgagcgtacggttaaaaagtctggtgtgtttttgtgttaccaaatagggcaaacgttaacttagacagacccccagcttaatgaggtcagaggaacagaggtttcacatcctgactccagaaatgggtagctgctagacaaaatcggggcaagacctgtggaatgatgcaatgaggtcaagaaaaagggtttagagaattacagcctggatattcagctctaagaaaaatgtgattgacaacattgaaaatgcagactgtagttatacacaacgaaaagacagtggggctgatccctaggcaggtgtagtnncggctcagcttctnanactngangcctatttncatattnagaaanggaa

SEQ ID NO: 498822 - DNA, 874 bp, Homo sapiens
  misc_feature (5)..(5): n is a, c, g, or t
gtctngcttgggcctagtgtgtcatgtcccctccacacacgccaccaaactcccactgctccgagccgcactacatccctgctccccagcctaggggctgtgctggggcctgaccctttgtgagctctcctcagtcccagtcaagtggacctcctccctccctctccacagcccttgcccttgtccaggccaccatcaccatcaccaacaccatccttgccagcctggagtcccctctcttcattctgtggggctaatgggggtggctgtgtgggaagcctctggggtctaccgttggggagctctgcatggctgaggttgggggttctctgggaacctgtggccaagggtctctggtcacagtgccgaggtgggcctggcttttccacagtggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttga

SEQ ID NO: 498823 - DNA, 376 bp, Homo sapiens
  misc_feature (101)..(101): n is a, c, g, or t
agaatcacgatttggtgccattgtttcatcttccgcattgatgagcagtgaatctggactgctctgttgtgtgctgctgaataattctatccagagaggcnaagtacagtggcaggtggatacgccctccaatcgggtaactcgcaggagagtgtcctgagcaggacagcaagccagcacctacaggctcagcagcaccctgacgctgagcaaagcagactacgagatattacaaagtctacgcctgcgaagtcacccatcaggggctgagctcgcccgtcacaaagagcttcaacaggggagagtgttagagggagaagtgcccccacctgctcttcagttccagcctgaccccctccctccttgttgcctctgg

SEQ ID NO: 498824 - DNA, 909 bp, Homo sapiens
  misc_feature (11)..(11): n is a, c, g, or t
  misc_feature (14)..(14): n is a, c, g, or t
  misc_feature (761)..(761): n is a, c, g, or t
  misc_feature (765)..(765): n is a, c, g, or t
  misc_feature (776)..(776): n is a, c, g, or t
  misc_feature (788)..(789): n is a, c, g, or t
  misc_feature (799)..(800): n is a, c, g, or t
  misc_feature (803)..(803): n is a, c, g, or t
  misc_feature (806)..(806): n is a, c, g, or t
ccgtaggctangtncgaggcctggcttctgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtnttcncggtcctcccngacttgagattnntaacgggganntgnccnttcgtccccgtcttggggccggggggtttgccctcccccagtggtggcgtgcccccgagttctgtgccctggcgggttgccccggggtcgggcgcggggggta

SEQ ID NO: 498825 - DNA, 1670 bp, Homo sapiens
cgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagaaaaa

SEQ ID NO: 498826 - DNA, 1461 bp, Homo sapiens
ggggcctccctgctcgctgcctccccgggtcctggatatggaggccacggctgccagctggcaggtggctgtccccgtcttggggggggccagcagacccttggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagaaaaa

SEQ ID NO: 498827 - DNA, 1078 bp, Homo sapiens
gctcgacactctgtacttccgccgcctccgacgtacgcgtagctctgccggtcgcaatggaagacgagatcgccgtgctggatcattgacatatgagctccgggatgtgcaaagcatggctatatagcatgagggacgacatctcaccgatcgcgtgttatgcatatccatcgataatggcgccgacagaaaatctagagggattatggatgagtgcatgtgaccagaagagcatcctacagtgcggcaaaccgagggtcccagaatcaaaaggcggtggggcattccatggaggccttgaagatgtaaccccgcgatatcgaggacacttggccatactgtccacacgaagactggcggacgaaccattggtacgaaagggattctagggcatcgcatgaggcgcttcctaacaacaacgggacggaccatggccagcccgataggaagaccaccccggcgaaacggcaataacaaacactcaaacgggatgcacattggccatagaatctccccgacagatgacacccaacaacccatgagaaaagcaccacccccaaagaagagacagcaaacaacgaaagcacggtagagaaacagcaattgtggaccacctaccaaaggaaactccacaactaggctataaagacagaatgcagttcgtcaaaaagacaaagcacccaggagaccccaaactaggacaacgagagcatggaggaccccaaagtacccaaacggggaccacaggaacacacactgatagcaccacatataccattaacatgaacacgcactcaattagtagagcgaccgactcaacacgcagaacagatttgtagagcccacaaatgaagcattcacacatatgagggcaaaacgatttccactgggggaaagtgacaacaacggtagccgagaattgcaacaaccggctagagcaaccaggggtaaatgggcagccaccaaatacagttacaccagacagacgggcgacgataacacagacacatcagcaatacgcagcacgaagcaagcatagaacgcaatcatcggccaaatgacaagaaattaccatagg

SEQ ID NO: 498828 - DNA, 353 bp, Homo sapiens
cgcgtagggccatactcagccaagtacctgaatccttctaaaaatttttttattgaggtgaaatcacataacataaacagccattttaaagtgaacaattcagtgacataatattcacaatgttgcacaaccaccacctctatctcgttccaaaacattcccatcaccccaaaggaaaaccccaaactcgttaaggagtcactctctaatccctccttccccaggccctggcaaccaccatctcccttctgtctctatggatttatatattctgaatatttcatctaaatggaatcatgcaataataagactttggtgtctagcttctttcgtttgggcactcggcgtgtgca

SEQ ID NO: 498829 - DNA, 278 bp, Homo sapiens
ttggttcctctgttgccgttctcttcctgccggagcctcagtttcttctccaactcttcgtcgtctacaagaagactaaccacctctttgggttcaaggtatctggtttgaagtacccacctgaaatcaccatccgctgaatctcactcttctccttggctctttgcagaatgcgtactccaatgctgcctttacagatgagccggtacacagtaacctgctttgtctggcctaagcggtgtgcatagtatcacccttcccccactgtggcgcaaggg

SEQ ID NO: 498830 - DNA, 602 bp, Homo sapiens
ctttttttttaagaaagctttgaattttgttcagagaagatttgtgttaatccatctaagtggaattcaggggtattagaagtttgttttgtcagtgcccaagaatatcatatttgtattttgttcatagcattttgaggtcaccaagagttttaagatgatgtcttttgttgtagacaagtttcggaatcagaccagtatggaggatgcaatcttattgtgtctttgaataagtacccaggctagtatggggacttgtgtaacacagaaagaacatctgcaaccttccccttgttgccacactttaatttgcagttaggctttgcaggatgtgttgctgtattctcttttcccagccatcattctgtctacctgcaagggtcttttgtgtaatattagtgtcatttaaatctgtttcagaatagatttgattctgaatcacttacttctataatattttaacctttagttgggaaatgaactttcatcagaaagataaaaatggattgattaaggaaatttgaaaaacaatatgtttttgagagtgtcatggtgtataggatatagttcatagacttggctttgagtttttaggagttaat

SEQ ID NO: 498831 - DNA, 475 bp, Homo sapiens
  misc_feature (5)..(5): n is a, c, g, or t
gtctngcttgggcctagtgtgtcatgtcccctccacacacgccaccaaactcccactgctccgagccgcactacatccctgctccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagaaaaa

SEQ ID NO: 498832 - DNA, 792 bp, Homo sapiens
  misc_feature (171)..(171): n is a, c, g, or t
tggggtccccaggagctgagggccccaggatcgacatgattctgaaggtgattgtcatgggtgcagggagcaggagctgatggggcagaagtgctagtggccggggtgctgtcaggaagcaccaccaggtagcctgggttgtgatagtcgtcctcatcctcatccgcatcntcacaggctggttcctcgttctcgtagctcgccacactgttggcaccatcagaatcccgccgggaagatggcgtccggtgggagcccccaaggggctgcggggatgagtccgtttgaactggatgccccttggatacaaactatctgaggatgtgctgtcgtaggagcctggcagtctgtggcagtgcacacacagtgccatcaacatggccaggatgggcagcagcaggagccccagcacgcaggggaccaggatggcctcctccatctgcaggggagctcggagcaggctggctgcacccctaggcccctcaagggcagagtcaaggccagatgaagatggggtgaggaccggacccggcagggagcagggggcaggtaggcaccaggtggcaggggagcccgggaggaggcagctgtgccctccccggggctcccgggatgggtcccctcttttactgggctgagtgtgcgtccagctgactgtggaaagttcctgctcccagggtggtcagaccagggcctgggctgaagtcgggggataccagttacacctgcgtcccagccctacctgcccctcctcggcgcccgcctctccgtgcccgccctcccgcccgcctg

SEQ ID NO: 498833 - DNA, 120 bp, Homo sapiens
  misc_feature (73)..(73): n is a, c, g, or t
cagccaaatgctacgacccccgacaccagacagctacctagaacagctaaagagcacacccgtctattcgcanatatagtgggaacgatttattggtggaggcgacacacctaccgagcc

SEQ ID NO: 498834 - DNA, 1330 bp, Homo sapiens
cgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttga

SEQ ID NO: 498835 - DNA, 241 bp, Homo sapiens
  misc_feature (38)..(38): n is a, c, g, or t
aggtgatctagaggatcctgcaggtctctatgcttatnttttcctccctaggatgtaccacttctggattcctatattttaaatttatgtatctggtgagttttgggactcttcacaaccaccacggccccacccccctacccagtagacttcaagctccaggagggcggggggttagccttttaagtccaaggctctattcccagagccctaggtagagagccgggcaggggtaccgagc

SEQ ID NO: 498836 - DNA, 176 bp, Homo sapiens
aacctaacataccatcttaatttaactatttatattatcctaactactaccgcatccctacaaatctccttaatcatcagatccacagccctagaactaattccgatcctatagtcttcatcaaccgcagaggtatccccacatagagcgtatgatcatccgctgaagtcgcccgg

SEQ ID NO: 498837 - DNA, 103 bp, Homo sapiens
ctcagccgggtcggcattgccctgtcccatgcgttgttctggtcgattaccgcctccctcgtggtgcgcctggcgccggaaggcaagcaggtgcaggccctcg

SEQ ID NO: 498838 - DNA, 1300 bp, Homo sapiens
  misc_feature (13)..(13): n is a, c, g, or t
  misc_feature (18)..(18): n is a, c, g, or t
gccatttggtacnggtcnaagtcctatgatgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttga

SEQ ID NO: 498839 - DNA, 582 bp, Homo sapiens
aggatccccagcttctcatcaggtacgcgatgcacgggtcggagttgatcacgatctcagtagccaggcccatctggcggggtgtgtaggacttctcggtactgaggaagtgtttcccgtaggaccaatggtgatagcccaagggcatgcccaccgaggcataggcatccatcatttgttcagcggtgatgacttccatctggttgggataagtgtccagggcataaggcgccgcgatacggctgatttcccggtcataggcctggatcagttcgaaggtccactcggagccagtggaaatgggttggcgcttgttctcttttttggcggtcatgttactaacctgcgctggaagagttcacggaagaccgggtagatatcgccggccgagaccagttgctgctgggcgaacgtgtcggcaaatgcttcgccgatgcgctcgtattcgaaccacagggcctggtgctcacggggggtgatttcgacgtaagtgtagtactgcacgaacggcatgatctggttgatcaaaatgtcccggcagattggggagtcgtcgttccagttattcgcgtcggaagcttt

SEQ ID NO: 498840 - DNA, 1757 bp, Homo sapiens
cgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgagggtgcgtctgggatccgaggtgcccaggctgggtggggagtctggggtccgtcctggactaggctgacccctgtgtcgttacccccagaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttgagcgtgcgtctgtgtgtgcctgtgtgcgagtctgagtcagagatttggagatgtctctgtgtgtttgtgtgtatctgtgggtctccatcctccatgggggctcagccaggtgctgtgacaccccccttctgaatgaagccttctgacctgggctggcactgctgggggtgaggacacattgccccatgagacagtcccagaacacggcagctgctggctgtgacaatggtttcaccatccttagaccaagggatgggacctgatgacctgggaggactctcttagttcttaccttttgtggttctcaataaaacagaacttaaaaaattgtctaagaaaaa

SEQ ID NO: 498841 - DNA, 1514 bp, Homo sapiens
  misc_feature (945)..(945): n is a, c, g, or t
  misc_feature (1000)..(1000): n is a, c, g, or t
  misc_feature (1017)..(1017): n is a, c, g, or t
  misc_feature (1048)..(1048): n is a, c, g, or t
cgcaggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgagaacgaggaaccagcctgtgaggatgcggatgaggatgaggacgactatcacaacccaggctacctggtggtgcttcctgacagcaccccggccactagcactgctgccccatcagctcctgcactcagcacccctggcatccgagacagtgccttctccatggagtccattgatgattacgtgaacgttccggagagcggggagagcgcagaagcgtctctgggtgagtaaccggtgcttgtcggtgcctgcccctgnaccccgctgccccaccatgctctcagtgtgaccagatcccaccctggggctaccnacaccctctgccccctntgtctgggcgtccccttgctctctcgccctnctgacccctttgcgtggctgcccctccttctgatctgtccccacagatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgtcccccgaacgctctgcaccttctgacgcagcctgagaatgacctgccctggccccagccctactctgtgtaatagaataaaggcctgcgtgtgtctgtgttga

SEQ ID NO: 498842 - DNA, 870 bp, Homo sapiens
  misc_feature (165)..(165): n is a, c, g, or t
caccgctgcgtcgccgcagcatttggctggcaggaagagtccggttctgggacagctggggacagtggtggtgactgaaataactttaccaaaggaaagctatttggcgaactatcttctccagcgcgagagtggccaatgtgctgtgtaacagcagccagactngttgcctatctcccaggattatggctcttgagtttaacaagggttgtcaatcccaaagccttttcgacctgctggatcatcaggttcggatgagtctcatgtggctgctgcaacctccaagatatatgctctcagaacagtgtggccggatgaaatctatgggacccttggacctcaagatcagaggttccagctttcctgggaacataggttggtgtgtcacctcaagtgggactgcttcacagaacgaaaagcctggtgcataaaacctttgcctgatgttctagcagaacctttatcaagtgaagcacatgtgttctgtgatggcccactattgtgaactgccttccgggtaatgatgcgccagttggaatggggacctttacccagtgcggagaaccttactttggaaggtgccagagtacgaggtgtgcatggccgggctgttcaggaatcgctgcgacacgatttggatccctggttccagaagtagctcatgtgcacctatggtctggcggttcccaacctacaatggttgttgctgtggtgccacattcacttgcgaatgctctttacattccagcgggcgaggactcgttggcctccaccgggggagggggggctgacaccccttcgggggggcgcgaacaccctttggggggcgcggtggtgcggggcgggtcggcctgtgttgtcgccgcatct

SEQ ID NO: 498843 - DNA, 277 bp, Homo sapiens
  misc_feature (93)..(93): n is a, c, g, or t
gcaaatttcagagagtctcaggtgtcaggctgaagtctggactcaattatcaacaaggagcctagtaagttcttcattatggtaaaaacacgnataaaagtgatattttagaaaaaccggccaggtgtggtggctcacgactgtaatcccagctttttgggaggctgagacaggagaatcacttgaacctgggaggcagaagttgcagtgagcggagaccatgccattgcactccggcttgggcaacaagaatgaaactctctctctcaaaaaaaaa

SEQ ID NO: 498844 - DNA, 875 bp, Homo sapiens
  misc_feature (419)..(421): n is a, c, g, or t
gcacattaaccggcaggatgtcggaggtgcggctgccaccgtacgcgcccctggacgactttggtctggggtcggcgcgtctggcggtccggatccatgcgacccgcagcgatggtgccaccgggtcatcaacaactccttctattaccaaaccaataccttctctgcttcggcatcggactcgctctcgccggtgatcctggtgcacgccttcgtttgcgcctgcgacaactttaaagaaccaagattgagcacccaagatcgaagagcatttggtctcaaagcgggacgcccaatttgtgcccttgcctacattaagacgcgctcctctgggcacaaagcgagccatgggaagtgccttggtattccctaagagcccccttgggaattcttgtaccccagggacctcttgcgttgcnnntatatatctccagccccataaccccaagcacataatttggtgacccaagagccctttttcccaaggcactttaaaaacagggagcattaaggaagcctcacttttggcccaaaaaaaaggcgtacaagaagacaccccacgagagggggggcaacaccccaccccaagatctttttcccgcgcaggtgggggggagagatgagtacacaacaaaacacacaccacacgcgagaggggggggggggccaacacccacccaaacagcacataaaggaattaagagaagaaccacagcgcacacagcagcaagccacagagcaggcagctccaccagagagagccacctgctaccccgccggggagaggcagcacacaacaacaacacaagaaggagagcaggagaggcgacacaacaaacaacgcgaaagcagcgcagcaagcggacacaggaaga

SEQ ID NO: 498845 - DNA, 82 bp, Homo sapiens
ccgccccccgctcccatccttcctctcgtactcttccccccctccctcctccctgccatgctactccccctcttctctgcct

SEQ ID NO: 498846 - DNA, 82 bp, Homo sapiens
tttttggtttttttttcccccccagttttaatgttagggggaagggatttaaccccttatttaaaaaaaacttgttttcaga

SEQ ID NO: 498847 - DNA, 105 bp, Homo sapiens
  misc_feature (16)..(16): n is a, c, g, or t
  misc_feature (54)..(54): n is a, c, g, or t
  misc_feature (82)..(82): n is a, c, g, or t
gatcttcctggaaatnagcagtgactaacgctcacataactggttttttttttnaactgggctgatgaatacatttacctangaaactcatttcgttttacttaa

SEQ ID NO: 498848 - DNA, 113 bp, Homo sapiens
tcatcaaaccctagtacatgctaagaatttaccagttaaagcgaactacttttctcaattgatccaataacttgaccaacggaacaaggtaccctagggtaggttttcgatgg

SEQ ID NO: 498849 - DNA, 579 bp, Homo sapiens
tgtatctcccagctgctaaccctagcatccagaagtggcacaatataccccgtctgactgtctcgatgtgtgcaactgagatctgtcagagcagtggctatctcaggggtccagctctgcagcggtgggggctagagaggaagcgagggagtatatggacagaggatgcccacgctcaggtggttgcagaagtcagtgcccaggccccacacagtctccaaaggtccggcctcccaagcgcggggctcctcgtttgaggggaggtgacttccctcccagcaggctcttggacacagtaagcttccccagccctgcctgagcagcctttcctccttgccctgttccccacctcccggctccagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtccgagcgga

SEQ ID NO: 498850 - DNA, 156 bp, Homo sapiens
aactgtgtaaaagtagacaacggtagaggggatacaggttgagggctcaacatgagcaaagacaggagatagcagataggctaggggtaatattgtcacaagtagacaacaggaaatacagtaacaagccctaggacctaggcccatatctatcat

SEQ ID NO: 498851 - DNA, 182 bp, Homo sapiens
ccccgggtttttaaaaaaggagggccgaaagggcccccccccctccagggtggcctttgatccaaaattagggaaaaggctgtccctggggggccccccctgttcccgtttgggggtttgaaaagtttgaaaagctgggcctttttttgggggaaaaaaaatatgaaacttttggattccca

SEQ ID NO: 498852 - DNA, 384 bp, Homo sapiens
  misc_feature (12)..(12): n is a, c, g, or t
  misc_feature (358)..(358): n is a, c, g, or t
accactcttagnagttgtgtgcccattcccttaacacaggtagatctgtcttacccgtttcctgggtgggaccttaggaatccagtgccctgagactatgtctttattatttatgcctagtatctcagtcttcccacactggcaaagagtatagcaactggtggttagtgataattgacaaggttctgtccaggctgcttttttgaggtctttgttttagtaagctatgaaatggagctgtctcttgcatgatgaataaacactctaccattgtctccactggccctagctgtagtacctggctgataggattatggtggaaattgtgttattgggaaacctttgagccttgagagangtagaaattggttcagaaactgtgtc

SEQ ID NO: 498853 - DNA, 991 bp, Homo sapiens
tgacacgtgctgacactacaaggctcggtagctccgggcactcagacatcatgagttggtccttgtcaaccgcccgagaactttaatttctcttacttactatgctctttatatgatcttcatcattcaacgatgtgtagcatatgttgcttaccaataagactacatgcatgccatctctagatgaaacgattcgggagtcattggtccaatctacctgctgggcacttgccatgactttcctgtgctagcttatccagaaccataagttagtaccaaggtacttctaacagatccttatggcacacgtagcattcttgacatcatagtttgtaaaaaactaagatccctcatggacatgtcaacatcaagtcttgactccaaaaggcatattcctcatacatcctaactctacttagaatccccttgaacttgaactccaattcaaaaagacccaataaaattattggatatgcaacgcttggctcacctctctcgcacagttccccatgggacaaatcatagctcctatgccaatgcacaccattcttattcgtaactattactttgaaagccaattacagaactatgtactaaacacacaatttgaatccttccaggaggttattttccggcactaatttccttggccacagggcacaacattgattactcacactcttcaacagaattgacacttcccacaccatcacggacgttgcgcattcttaataagcccgttagcacacagtggaagcagaacagggtataagcgccccctacaggccttttggcacacaggtccagacaaggtttgcgccaagcagaaaaaccccctttttgccatacacaagggagcgaagcgcggtattggccaaaaataatcccccaatatgcaatctagcttgcaaccttgtgcgggcaaacacgagacctttttggtccaaaagggacccacactctgtgcgcccaaaaataatacgcgggcgag

SEQ ID NO: 498854 - DNA, 885 bp, Homo sapiens
tggactggtcttcccagccctaaaccctgccccaggaagcccacagcctcacctgctgctgcccctctaggtctgggcagccatgacctgcagggcccagagacactgtccttcccctcatccacccaaaggccccagccagcgctcataccctgtcctttctcccttgaccccaaggtgcacagagtgcaaggcctcctgtctacagcagcttcctcagtttcctacttgctttaggaggccccttgtttgttgttcagggaaaggcctcttcatgggcatgttccttgctggggcgcgagtgggggtttggtcccacactcttgctaagtttcctgaggatgagggtctaagccccctgtgtggggacagacacagtgtgtacgacctttcttcctgctagggcctgacactgccctgggtgtcgggcccttctggtgggccacaggcttgtggccaaccccgtgtaacagaaattcgagtgctgtatgcttggccagaccccagagcgccttgtgccatcttacatttcccttggccaaggagtagattgggggttcccagccatgggtcgaaggaaacacaaaatccctacgtgattatcctatgttcccacgttgtgcaggccgaaagacgccagggaccacaggcgtactgggccagggggtgctggaaattgtccagggggtcacgcaggttccaccaagcgttggacctgtcccaagcctgtggatagcttctgccatgcaattgagcctcctggcatgcttggtctggaggtgggattgtgaccgggccatgggctgaccttttggtgcaacaagacttaatggcctcagacagacacaccacacaaaacatcttggagccgccgtcactaaccat

SEQ ID NO: 498855 - DNA, 685 bp, Homo sapiens
  misc_feature (539)..(539): n is a, c, g, or t
taaaatcaagggccttgtttttttttttcacaaggaataaaccaaaagcgcgccaattgggttaaaaaatagtttttttaaccacagttaccacggttttgttaaaaaaggcaacgcgccggcatttgacagcccctcaattaagaaagggcaagtgtgaagaatgaaaaccggtacggccagagggatattaggcgagcgggcaaatgttggatatacgaattgtccattccgcttgggtacagccaggatttacagagtcgaaagggtatcaacagcaggccagtgacgtgtgatatgactctttttggcgtgatttcggtaccggggagttcaaaagagcaccccgagcaacaaaggtggctcagacactggcgctataagattgagccgtgcgagttccactgtagagctcgccttggaggactagggagtgacccctgttaggccggccaccgtggtatctcgttccgcgcagtacccaacagagttgtcatggcatgtgcaaccgtcgtgtcatcgttcgatggtgcatatgngcctctgccgtcagggtgaagtcggcccgcaggtgattcacttagagtttcaccatctgcctcatgaccatagtcgtacacgttataaaaatctcgagctttcagactctcatatgtgggtccaggggtgttctcgctcggccgaa

SEQ ID NO: 498856 - DNA, 785 bp, Homo sapiens
agcggagcgcgggccgggccgggacggggactgtcggctgcaggcggcatgcccaccaacttcaccgtggtgcccgtggaggctcacgccgacggcggcggggacgagactgccgagcggacggaggctccgggcacccccgagggccccgagcccgagcgccccagcccgggagatggaaatccaagagaaaacagccattcctcaacaatgtcgaggtggaacaagagagcttctttgaagggaagaacatggcacttttcgaggaggagatggacagtaaccccatggtgtcctcgctgctcaacaagcttggccaactacaccaacctgagccagggcgtggtggagcacgaggaggacgaggagagccggcggcgggaggccaaggctccgcgcatgggcaccttcatcggcgtctacctgccgtgcctgcagaacatcctgggcgtcatcctcttcctgcgcctgacgtggatcgtgggggtggctggtgtcctggagtccttcctcatcgtggccatgtgctgcacatgtacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgc

SEQ ID NO: 498857 - DNA, 161 bp, Homo sapiens
cctcaaattcctgggctagggcgggcccggtggctcacacctataatccaagcactttgggaggccgaggagggcagatcacttgaggtcaggggttcaataccagcctgaccaacatggtgaagtctctactaaagagacttctctactacatttagtct

SEQ ID NO: 498858 - DNA, 409 bp, Homo sapiens
cctccaggtcctgtttcctagccactccattgagatggagagccctggagttgggggctggcattcggcgggagccgggtcatagaccctgacttgggagtgttgcgatgccggcaggctgttggaaaactctcctcagatggctgcctgtctttttgcagacaatgctgaccgccatttccatgagtgcgatcgctaccaacggtgtggtcccagctggcgggtcctactacatgatatcgcgctcgctgggacccgagtttggaggcgctgtcggcctctgcttctacctgggcacgacgtttgcaggggccatgtatattttggggaccatcgagatttttctgacgtacatctccccgggtgcggccatcttccaggcggaggctgcaggtggcgaggcggccgc

SEQ ID NO: 498859 - DNA, 336 bp, Homo sapiens
  misc_feature (290)..(290): n is a, c, g, or t
  misc_feature (293)..(293): n is a, c, g, or t
  misc_feature (326)..(326): n is a, c, g, or t
gaagaacaagaatcttgcctctgtcacctcaggcctagaaggcagtggcacccatcagagcctcactgcagtctcaaacctccctggacctcaggtaatcctccccaccctcaacctccctgagtagcctgggacctacaggtgtgcatgacccatgcccagcctaattttcttttttttcttttttttgtagatatgggatctatgttgcccaggctggtcttgaattcttgggctcaagcaattgtcccacctcggcctcccaaagtgctggggttacaggcgtgagnctntgcgcccagctgagactggaatctttatagaanccatatctac

SEQ ID NO: 498860 - DNA, 146 bp, Homo sapiens
catcagcagcctgagcacagcctggtcacacaccaactttctttccttctgttttttgtgtgtatcgttgtttgtatgtatgtatttgagacagagtctcactctgtcgcccaggctggagtgcagtgacgcgattctcagacggg

SEQ ID NO: 498861 - DNA, 205 bp, Homo sapiens
ttcgattggcgggcacttagcgagacaccatctctacaaaaagtaaaaaattagccatgtgtggtggtgtgcaattgtgatcccagctacttgggaggctgaggtgagaggatcacttcagcccaggaaattgtggctgcaactagctatgagtgcaccactgcattccagcccaggtgagagattaagttgcccgccaatcgaa

SEQ ID NO: 498862 - DNA, 140 bp, Homo sapiens
  misc_feature (11)..(11): n is a, c, g, or t
gtcacactgancatcgccagctgctccacagacgcgtctcttgtctcctcggcctgccccacttcagggctgctgtgagatggaattccaggaaagaacttcaggtgttctggacccttttctatctagcataatatttt

SEQ ID NO: 498863 - DNA, 117 bp, Homo sapiens
aatcagctcggtacccttattgttgatctgagcagttgccagtccattgctattgaatcattaattgttatttgaatctgtcctcggttactcatttcaataactgcttctgcatag

SEQ ID NO: 498864 - DNA, 791 bp, Homo sapiens
  misc_feature (491)..(491): n is a, c, g, or t
  misc_feature (589)..(589): n is a, c, g, or t
ggaggtgagctcgggtcagatcgctctggatgcgcgctagctgcaccggaccgacgggatgagcaccgcgaagacccggcggagctggaagtccagatagagcggtttatgcctccgaactagttggatcgtgtaatgccgaagtgtatcgtgaagaggagctaaaattctgtggcgattgcagcagcgccatcgtcggagcatccgccatagtggcgctgccagcatgtgcgtatatcgtgttacggccgatagatcgaggagaagcatatgagcgcactcgtagtggacaccgtggggattccgcccggaagcaacgtgagtggaagcaagacacttatcacctgcgaccactggtgctggtgggacgcatgtgattcgagggagaatcgcttgacgagtgtaggcgctgcagtcatctggtggagacgcgtaaggatgaccgagtgcaccgggagcactagtgtggcgtaagggacacgaataattgnggtaggcccatgccattgcgtagcacgcgttgtcctcgccatgccacaattttgcaactccaaatgcatgatagggttccaacctcgtgtcgcacgcncccacacagagagaagcgtcgagatctctcgtggacggcgcgcatcgaaaagaacgcggtgcgcttatgttgcctaggaaatctcaagggtaggtaagcgcaagcgtagagacagtgctgccagggcgggggctagcgcaagttgaggaacttcccatgacgatggactaggttgcagggtttgcatcacaggagctgtgac

SEQ ID NO: 498865 - DNA, 111 bp, Homo sapiens
tggaaggccgggaccgcggatgggtgtcggcgtgaccaggccttagctccctgtctttcctcagtgaaataggtctttaaaccctgcgtggcattcctgaaggaaccgccg

SEQ ID NO: 498866 - DNA, 84 bp, Homo sapiens
ctagaagattcagcaaagtacttttgtgctcttggggaaccccttcctaaggtactgggggatccctggagtgcacaactcttc

SEQ ID NO: 498867 - DNA, 107 bp, Homo sapiens
atcagaaatatcagaagaatgagtgatgattcttctgtatcatcatatgtaaatgatgtcttttacttatatagcaccggaatcagtcataatgctatagcaagaat

SEQ ID NO: 498868 - DNA, 942 bp, Homo sapiens
  misc_feature (7)..(7): n is a, c, g, or t
  misc_feature (143)..(143): n is a, c, g, or t
  misc_feature (174)..(174): n is a, c, g, or t
  misc_feature (177)..(177): n is a, c, g, or t
  misc_feature (207)..(207): n is a, c, g, or t
  misc_feature (869)..(869): n is a, c, g, or t
  misc_feature (872)..(872): n is a, c, g, or t
  misc_feature (887)..(887): n is a, c, g, or t
  misc_feature (899)..(899): n is a, c, g, or t
  misc_feature (910)..(910): n is a, c, g, or t
ttcgctnttttgtgcacttctatgacatggaaattattgaagaagaagctttcttggcttggaaagaagatataacccaagagtttccgggaaaaggcaaggctttgttccaggtgaatcagtggctaacctggttagaaacngctgaagaagaagaatcagaggaagaagctnacnaaagaaccagccaaagccttaaattgtgcnttacattctgtttttatgatgtaactgcatttgacctaaccactgcgaaaactcattccgctgtaatgttttcacaatatttcaaagcagaagcacgtcagttaggatttccttcggcagaagggttgtggtgtagtgtaatgtctgtaatcatagtctaccatcaaatattttaggagtatctttaatgtttagatagtatattagcagcatgcaagaattacatcataaggtctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtntanttaatttatcaagtnatgtcatgcccngattttataanttgtatttatcaataaacattgtgataattgg

SEQ ID NO: 498869 - DNA, 943 bp, Homo sapiens
  misc_feature (7)..(7): n is a, c, g, or t
  misc_feature (143)..(143): n is a, c, g, or t
  misc_feature (174)..(174): n is a, c, g, or t
  misc_feature (177)..(177): n is a, c, g, or t
  misc_feature (207)..(207): n is a, c, g, or t
ttcgctnttttgtgcacttctatgacatggaaattattgaagaagaagctttcttggcttggaaagaagatataacccaagagtttccgggaaaaggcaaggctttgttccaggtgaatcagtggctaacctggttagaaacngctgaagaagaagaatcagaggaagaagctnacnaaagaaccagccaaagccttaaattgtgcnttacattctgtttttatgatgtaactgcatttgacctaaccactgcgaaaactcattccgctgtaatgttttcacaatatttcaaagcagaagcacgtcagttaggatttccttcggcagaagggttgtggtgtagtgtaatgtctgtaatcatagtctaccatcaaatattttaggagtatctttaatgtttagatagtatattagcagcatgcaagaattacatcataaggtctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaacttatagtctacttataattgatcaaggtcatgttcatgtcctgattttaaaccgtgggtctatcaacatttttcttgtgg

SEQ ID NO: 498870 - DNA, 573 bp, Homo sapiens
agaaatcctcatgcctttaagacttctgtgcatgacttgacgttttggatcccgtgcctagggtctgtgaacgaggcctggtctcattccctggaggatttcgtttccatgggcttgtatttctcctcttgccagtgggagtactgctaggtctcttctctgtggaaacttcacgagcgttggctgggcctcgtgcgttcgctggagtgtactccagggtgaaggcagagtgggattcgagacccaggttaggcacgagccaggctgagaagggacgtttccatcattcacagtagcctccccagagacactagctcaggcccgaacctcgaggccacacaggcgagactgggaatgagcaggctggcctggagctggaaggtgagacccggggcctcacggagcaatgggtcctgagtgggcccgagacggacaccaaggccaagaggtgaacaacgtctgactaggggatgcctggaagtcccgggcaccaccagggacggtctgggagaaccacgaaagccagggtctcacaggaggcccgagggcacctcaaggactacccggtacgcc

SEQ ID NO: 498871 - DNA, 719 bp, Homo sapiens
  misc_feature (33)..(33): n is a, c, g, or t
  misc_feature (70)..(70): n is a, c, g, or t
  misc_feature (95)..(95): n is a, c, g, or t
  misc_feature (109)..(109): n is a, c, g, or t
  misc_feature (113)..(115): n is a, c, g, or t
  misc_feature (138)..(138): n is a, c, g, or t
  misc_feature (147)..(147): n is a, c, g, or t
  misc_feature (156)..(156): n is a, c, g, or t
  misc_feature (162)..(162): n is a, c, g, or t
  misc_feature (175)..(175): n is a, c, g, or t
  misc_feature (178)..(178): n is a, c, g, or t
  misc_feature (182)..(182): n is a, c, g, or t
  misc_feature (190)..(190): n is a, c, g, or t
  misc_feature (193)..(193): n is a, c, g, or t
  misc_feature (197)..(197): n is a, c, g, or t
  misc_feature (200)..(200): n is a, c, g, or t
  misc_feature (202)..(202): n is a, c, g, or t
  misc_feature (207)..(207): n is a, c, g, or t
  misc_feature (239)..(239): n is a, c, g, or t
  misc_feature (261)..(261): n is a, c, g, or t
  misc_feature (269)..(269): n is a, c, g, or t
  misc_feature (646)..(646): n is a, c, g, or t
  misc_feature (649)..(649): n is a, c, g, or t
  misc_feature (664)..(664): n is a, c, g, or t
  misc_feature (676)..(676): n is a, c, g, or t
  misc_feature (687)..(687): n is a, c, g, or t
ggctatgaggtaacggcatccgacctccccacngcgaaaagccactccgcggcaaggcgtcacaagaggnaatgccgaagcacgccggtggggangcccgccggcaganggcnnncggtagtgtaatgccccaaccanagccccccnccaaagagngggggnggaccggcaaggnggngacnggagaccngcngcangcnanaaccncaccacaagcccccaagcagaggcagcccatngcaaggcccccccccgccgccnggcaccanaggccgccccaagccagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtntanttaatttatcaagtnatgtcatgcccngattttataanttgtatttatcaataaacattgtgataattgg

SEQ ID NO: 498872 - DNA, 558 bp, Homo sapiens
  misc_feature (485)..(485): n is a, c, g, or t
  misc_feature (488)..(488): n is a, c, g, or t
  misc_feature (503)..(503): n is a, c, g, or t
  misc_feature (515)..(515): n is a, c, g, or t
  misc_feature (526)..(526): n is a, c, g, or t
atagcattgcatatgtatatttatcattcattaatgtatcttcaatgcatgaggcatgtcttatttgcattggatcccttctttgcttgccacgtttttcaatatggcttgtttttatggtttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtntanttaatttatcaagtnatgtcatgcccngattttataanttgtatttatcaataaacattgtgataattgg

SEQ ID NO: 498873 - DNA, 556 bp, Homo sapiens
tggaaatagggtctcactctgtcgcccaaacgggagtgcagtgaagtggtgcaatcttagctcactgcggtctccacctctcaggtgcaagtgatcctcccatttcagacccccaagcaggtggcactacaggagctcgccaccacgccgggctaatttcctggtatttttttggtaagaagatgggtgttttggccatgttgcccaggctggtcctgaactcctgagctcaagcaatctgcctgcctcggcctctcaaagtggctaggattcacgggcgggacgccaccggtgcctgggcctacctcctttaacctgttgtttcacaaaatctttggtccctttccctttttttttttttttaaaatggggtgtctcccgctcattgtgtgaccccacaagcgttcgggatttacaaatgcggcacatgtacatccagattcaacacgagcaagactacaagcccacatgaggataccaacagaagatacccttggaacaaagacctaccacaaataaaactcggaaatgccacgaccacaaccacaaagaccaa

SEQ ID NO: 498874 - DNA, 241 bp, Homo sapiens
ttctcacgtcagccttccgagcagtagaggttgaggagggaggatcacttgcagcccgggagctccaaggctgcaatgagccaagatcgcactgttgaactccagcctgggtgacacgagcaataacctgtctcaaataatactaatacatccggcttagcgatatattactacgactacgatacggtacgactacgactacgactagaactacgatagactacgactacgactacgactc

SEQ ID NO: 498875 - DNA, 185 bp, Homo sapiens
aaccgggacccctttgacaaatgtctctgagcttctgggatgtagggcgagcccaacaacatagctaccctggaggactgtgccaccatcagagactcttcaaacccaaggcaaaattggaatgatgtaacctgtttcctccattattttcggatttgtgaaatgctaggaattaatcctttgat

SEQ ID NO: 498876 - DNA, 454 bp, Homo sapiens
ataagcccatcgtgactcaaaactcacttgtataataagcagtgttgagggattttaaagtttcaaaaaaagaaaaaaaaaaaaaaaaacaaaaaaccgttgttgtgcgggccgcgcccgcgggcccccgagaaaagagtttctaagaacccgttccgcgttggggggcgcgcggcggcgccccgagggtataggggaaccgggcgggcccagagcagcgcggctgccaagagaaaaatccggggtcacgcggcaaccagcggggcggcgacattccatcccaacactataaaaaacgcgcgccgggggggcagacgcgcggagacgtttgggaaacaactccccaagaggaggagtctccgaggaggcctctatcaggggggctccatcctacacggggaggagtccaaggcggaagccgccgaattcaaatttaggccccgcggcggggaaa

SEQ ID NO: 498877 - DNA, 1590 bp, Homo sapiens
  misc_feature (1469)..(1469): n is a, c, g, or t
atgccagagagctggatttctcctagcattactgccacgtggctttgctaacgagacggctgctctcgctaccctactgcgacgctgcagactccaacgctgcacagcacgccttcctcgcatcaagcgttagcacgttttactgctccctggcctgctgcgtcaacctactctgactcggcctacacttcctacacccatggcacccaacgcagccccgacctctctttgcgcacgctacacacgcaacctccggccttccccactcccactacctggcatctacgcctgcacttcggccacaagaaccccccctacaccccacggcaaaaaacctctcctctgcaactaggccctgggccttcctggcgccttgccttgcacaacaagctctgccgcacgccccttccgtcccgacaaacgccccttatctgcactgcacacacccgtactaactcttgcctgccgcagctcggtggcaccggggcgaagctcaacgccatccctcggcaacacacacgcggaacgcaatctccaccaacgcgcgcctcccctcatggggcccccttgggcaactttcctcatcccaactttccccgggctcgccaatatctcgtcaaaagaagcccacattcctttacgtatttccccccaacgttccaagaacggggcccagtaacgtccttcgcaaccagatgctccccgagactgttcccggccttaacctattccccccgaaaacacctggccacttggcaacttcctttaatcccccccctattaaaccattgccaagcttaaagctggcgcccgttgttgatgcccgacgaacaaccccctctttcccggcaggccgttcgccccaacgagaaacaaacaccctaagagacactatgggcccctgttgcgccacggacagcttgttcggcaaaacgaacttttggagccgcactcccgtttagcgccgcccccctctttaaacaacacacactgggtccccccgcttataacacacccgcttgggcgccatttcgtcaacgtccactgcaactcgggcaaaggaagcgctgccgattgtgttagggtccccaccgctgtttccctcaaatcccgcgtttggctgccgcatccctgcgagggccctcatcccctccctccaaagaagacggcgccatttacacctaagccacaaagattttaatgcttttggcagggatcctcccctcctctgcgtcgcgctggcaccacgccggcccagcataagagtcccgcaactacgagattccgcgaaacgcacgtcgtttccccgcttttagagtcttttgcccgccccctgttgtgtggcccccctattatggggaccccatatattggcggcgcgggcccgcgaccggctcgcggcccccatcatttgctcccgtacttgtaggccgcaccatccaccacgcggagtggacaaaccagtcctnccctctttcggggggggcgcgcggcgccagcacgcaccgctgccgccttctgtcgctcgacacgccctccttgggcggcgacaactaggcaccccctcctacgcctcctcaatccccccgg

SEQ ID NO: 498878 - DNA, 1061 bp, Homo sapiens
  misc_feature (400)..(400): n is a, c, g, or t
  misc_feature (406)..(406): n is a, c, g, or t
  misc_feature (408)..(408): n is a, c, g, or t
  misc_feature (415)..(415): n is a, c, g, or t
  misc_feature (417)..(417): n is a, c, g, or t
  misc_feature (419)..(420): n is a, c, g, or t
  misc_feature (493)..(493): n is a, c, g, or t
  misc_feature (508)..(508): n is a, c, g, or t
ggattacatttattgattcacgtatattgaaccagccttgcatcccagggatgaagcccacttgatcatggtggataagcttttgatgtgctgctggatttggtttgccagtattttattgaggatttttgcatcaatgttcatcaaggatattggtctaaaattctcttttttgattgtgtctgtgccaggctttggtatcaggatgatgctggcctcatacaatgagttagggaggattccctctttttctattgattggaatagtttcagaaggaatggtaccagctcctccttgtacctctggtagaattcggctgtgaatccatctggtcctggactctttttggggggtaagctgttgattattgccacaatttcagagcctgttattggtctnttcaanantaactcntncnnagtcttgggatggaaatgtagtgctcgagtcacattctgcttaaagttgtaacaaatacagatgagttaaaanaaaaaaaaaaaaaanaaaaaaaaaaaaaaaaaaaaaaaaaaaaaaaaaaaaaaaaaaaaaaaaaaaaaaaaaaataaaaaaaaaaaaaaattttggggggggccctgtccccaatatcctctatagtgggtcgtattcaattaactgcccgcggttttacaacctttgaattgggaaaaccttgtggtaccccacttaaatcgcttggcagcaaatccccctttctccagttggtttaaaatccatggggcccgcaccgatggcctttcccaatagttgttaaccttgaatggcaaatgtaaaattgtaagcgtaaatatttggtaaaaattcgcttaaaatttttgtaaaatcagtttattattaacccaataggctctaaatttgcgaaatcctttttaattaaaatgaatagactctaataggtttgcactgtgtcccacttggtaacaacattcctttttataaagaacgttttttcaaccttaaagggctaaaaacctgttttaaggccgattgctcctctcgtgtaccattaccctaatcaagtttttgtgttccggtgctc

SEQ ID NO: 498879 - DNA, 204 bp, Homo sapiens
agacacacacagtactaggtccccgttgacaatctgaggtggggtggccttaggagttcgcctgccaaggctcgcatctcatccctcagggacgttgtcctgagagatgtaccactaactagtattggatgcgcttcccatccaggatacgggacacctcgctctgctgggacttgattacgcgggagccgatgaccgacgtgc

SEQ ID NO: 498880 - DNA, 186 bp, Homo sapiens
gaaatcctaattacgcctgctcctcatgatgctagtcagattcgtttctgctgagccaggacgggaacttctggggtgggtttttttaaataagcgatagaatggtttaactttccaaacctaatcttttaaagtgcctgcctcctttattttctgagtgtaaaggaaacatggcattttagtctc

SEQ ID NO: 498881 - DNA, 878 bp, Homo sapiens
  misc_feature (400)..(400): n is a, c, g, or t
  misc_feature (406)..(406): n is a, c, g, or t
  misc_feature (408)..(408): n is a, c, g, or t
  misc_feature (415)..(415): n is a, c, g, or t
  misc_feature (417)..(417): n is a, c, g, or t
  misc_feature (419)..(420): n is a, c, g, or t
  misc_feature (493)..(493): n is a, c, g, or t
  misc_feature (508)..(508): n is a, c, g, or t
ggattacatttattgattcacgtatattgaaccagccttgcatcccagggatgaagcccacttgatcatggtggataagcttttgatgtgctgctggatttggtttgccagtattttattgaggatttttgcatcaatgttcatcaaggatattggtctaaaattctcttttttgattgtgtctgtgccaggctttggtatcaggatgatgctggcctcatacaatgagttagggaggattccctctttttctattgattggaatagtttcagaaggaatggtaccagctcctccttgtacctctggtagaattcggctgtgaatccatctggtcctggactctttttggggggtaagctgttgattattgccacaatttcagagcctgttattggtctnttcaanantaactcntncnnagtcttgggatggaaatgtagtgctcgagtcacattctgcttaaagttgtaacaaatacagatgagttaaaanaaaaaaaaaaaaaanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacagataaagtgctcactaataaaaaaacttgaccctacaaggcgcattcagcctaatatatgccatgatccataaaacggctagcctgaaaaaaacatggacgaaatcccataaaatggggtagaaaaaaaagtagaggaagatgcctctaaaccatatgaaggggtaaaaactaggggagacgccaacaaaagtgcgccgaataaaacctagttctactcgatggcgtaaagaaaaaggggtcctatccgatcctgtgcagcgacccacatgacct

SEQ ID NO: 498882 - DNA, 333 bp, Homo sapiens
  misc_feature (32)..(32): n is a, c, g, or t
ctcctaatacctttatctcttggcatggtatnaatatacacggggataaatagtatctcctcaagaatctgtgggcacatgacagtggatatgtagagtgagtgcttcagaacagtgctgacatactgtatgatcagcattgttttcactgccagtttacttttgggttacttccattctactttaaagagaaacagaatattctgttacctctgctgctataaaccctggaacataatttaagttactgcttactctttcatactccgttgtaactaacagtgttaaatcagaatgtccaggctatacgcacatttctaggcatgtacattg

SEQ ID NO: 498883 - DNA, 1356 bp, Homo sapiens
  misc_feature (980)..(980): n is a, c, g, or t
gtcctaatggccttacagcggagccgtagtgggacaagagtggcatctgcatacttatccaatacgaatgaggagcactcatgtcacgctcgtacaggccgtcattcgcaaaggcatcagtgctgatcttgatgtctccttcactgctggggagcctgtggtcgtaaccatgggggcacgcctgggaagtcggagtgtgcggacttgaaatcgactccccacggaccctgcaggatattcatcttactccttaaagtccatccagagacacacgccatgacactcgttgcttcgggctggaggacatgcgggacctgcggaggtacgtaccgggggaaactccggaaccttgacatgtttggtatatccatgaaaacgaatgcgttttctcgtggcatgttgtaccctaagtaactgagaggccaccgcttggtaaagaaaggcttcttttcattcgcccttgggaggcaacaaccgtgggtcgcgtcacgactcgttaacaacggggatccgtaggatagttcgaccccaactttgtgcatcccaaaagtggctgaccaatccgttcactacattaggaccggttccttaccataacatccggaccctgattgaagcaccgtgggtcctgtcttggcactggtcaagctcggaaaagcacgtgggcgcctcctatggtctttagcaatcgagcacttggtttttggcgcctgcggccttgtgagactcatcccaacgttccgcaaacttgcgtgcacccgtcaaggacatggcgccgttgctaccccttccccccacagaggtctctttgggtcagataagcacgtcgcacgctctcggggcatcacctccgctggaggccggacaaacaacaactcagttcacaccccgaacagagctggcacttcccacttgtaactggcggggcgaccgtataactcaaccacacttcgtcctattcttgcccaacagagcatccnaactgggggtctggggcacaccgtttgctggagcgcccttttgcaaagacttaggaaccccttcccttcgcacatcgtggacgcttctgcgcgccaaagtgaacgcacactacatttggttggcgtgaaggacactgtggaacccttaaaaccagtgcgtttggtgggacgaacacaacgcttaggacccttggggtttggtatcgggagccgaccccacccccgatgtggggtcacaggtcccctgcgcaaacagggaaacacaaaccgggggtggcgttcggctttgggaaacattaagtgcggcgcgcccagtgttcccacatgccctgggacttcgcacacatggatgatttgcaccacacttaggcccgtg

SEQ ID NO: 498884 - DNA, 223 bp, Homo sapiens
cacacacacacacacacacactacacacacacacacacacaaacactcactaatagagccatgaagataatacaaccctaagccaggcatggtggtgtgtgcctgtggtcccagctacttaggaggctgaggcatgagggtcacttgagcacaggagttggaggccagcctgggcaatgtagcaagatgttgtctctaaaacaaaaacaaaaacaaaaacaaa

SEQ ID NO: 498885 - DNA, 310 bp, Homo sapiens
ctatcaccatatagtaggaagtgcagacgaactccgtcgcagtgatctcagatatgactcctccagtctggaagatgtagcctaactcctcctgtattgcggcaccaatcttgggatcgccaagtcccaagagtactttcttcttttatggacggcagtgtgggtctccaagagcaggtggaggtcctcatgaacaactcccttcagactacggcgttggcattttccaaggcaacctgggatgaggcaaagggacaaaaggccaccagacgaacgatgctgtggaatttgcccagcttgagacacgcga

SEQ ID NO: 498886 - DNA, 354 bp, Homo sapiens
ccccctgccctccgtgccacgggctttcccctacctaggggagcctcccccagacagggaaaccacgccttgccacccttttttttccctcccactttacctggccgggtcatttttggagccccttctttttggcccgaaatgctccagggccctgttgtattttccctgccccagcctgaacccagctatttttggtgcagcctggttcattgtgggaaaatgtcatccaaagcccggggtttggctccggatgtgctcattgctactggggggtcctttcaactgggggagcaagggaacccatttatgtacatgcccccccgcatatgtataccccccgtttcttgggga

SEQ ID NO: 498887 - DNA, 193 bp, Homo sapiens
ttcccccttttccctttttttttttattaaaaggccaagctttttttttccttggttttttaaaaaccggaaaaaaaaaaactcaagacctttgggggggattttggccttttttcccggggaaaaattgggctttttttggcttttttgggggtgttttttttaagttataaagttgaaaaaataaagggga

SEQ ID NO: 498888 - DNA, 475 bp, Homo sapiens
tgggcttgactcaggattaaaaaacgggaacggtgaaggtgacagcagtcggttggagcgagcatcccccaaagttcacaaggtggccgaggacttgatggcacatggtggtttttaaatagtcatcccaaatatgaaatgcttggttacaggaagtccctgtgccatcctaaaagccaccccacttctctctagggagaagggcccagtcctctcccaagtccacacaggggaggtgatagcatggcttctcgtgtaaattatgtaatgcaaaattttttataatcttcgcctattaatactttttatatttggtttatatttggaatgatgagccttcgggcccccctttcccctttttttgtcccccaactggagatgtatgaagggcttggggtctcccgggcgagtgggtggaggcagccaggggttaaccgtgtacacggactggagaccagttgattaaccagtgcac

SEQ ID NO: 498889 - DNA, 1544 bp, Homo sapiens
  misc_feature (902)..(902): n is a, c, g, or t
agttgtcggaaatgtggtcgccaccacagtatgtttgtgtaaaaggaagggcgcccccttctaaggatgtgttgttcatccgtctgttacatagtgaaccacaaatttgttggtcatcgtctcgcttggtttccatctcccgcgatgaaattttgtctcgttaaaaagtcccctacaggatggtgacaagattcaactttttggtctgcttgggggtggtggacatcacaaaactgtggtgtggttgtgggtggtcacaccacccgtgtaccacacagacgtcgtctgagtcggtcagatcatccattgttttgtgggcctccagtcgtggtgcccaacggatgatattttgttccacaaaggcatggttaatcgaccaacgacgagatggggcgcacacgtgtcaaaccacacccacccccttggtgggtgttggtggttatacaacacaccgtttgtttgtggtgatccctccggaaggcgtttgtccccccgcaaacgagtgttggtcgtgttgcatctcgacccacggtgtccgccaacacatatggatgggtcccggaacacacgagcccgctcggtgtggaagaaaactagtctgtggagatttgtcgtttttgtgtctcctcgggttattctcgctctgtcgcgccacgaaagagattagttgcttcggcccgtctcgcgaagaaagcccccgtcgtttgttgattttcatcgctgggggagaaacactgctttcgtgataaatgcgccgcgaaaccacacgtcttgtgggggcccgccgaaaagttgtcttgtggggtaagacacctcgcttattttgggtcgcggtgcacctctccacgatgggagtggtaacctgtgtccctccgaaagatattgttattgtcccacctggngcccccccgctgggaagacactgcttttgtccccccccaacgatggggggtcccccggctcccaacggtgtcacgctttcggctgggtaacactcgatgagtgtgagggagagattttcgcgggaagaaacacacagcactgtacttccctgtcgatacacaagtctggagactttgttaagaccccaccaccacaagcgaagttttttctgcctctcttcgaagctttgtggcacagcacactgtctttatgtctaacactcaaaaggagtcgaaagggtgtattctctcgcgaggttgaagacacactggagagtggctgtcgccactcggagaaggagaagaaaaagcttgccccatgttgccctgttgttggagcacctgagaagggcacatcttgtgcgcctttatggcttctcgagggctattggagggggcctccctgccatgctgtgtttaccacgatgattaactttgctggccgtatatggagcattgcccctgcccaccctgtgcctctttgagggctttttccctgtctgccttgcccacattggttgtcaactaaagggtatgttccctcttgtccccttccctacccttaaatttggggtccttttttaaacaggaaaaaccaaacca

SEQ ID NO: 498890 - DNA, 328 bp, Homo sapiens
  misc_feature (141)..(141): n is a, c, g, or t
  misc_feature (236)..(236): n is a, c, g, or t
  misc_feature (264)..(264): n is a, c, g, or t
gagatggagtcttgctctgtcgcccaggctggggtgcagtggcgcgatctctgctcactgcaagccccgcctcccaggttcacgccattctcctgcctcagcctcccgagtagctgggactacaggcgcctggcaccacgnccagctaattttttgtatttttggtggagacggggtttcaccgtgttagccaggatggtctcgatctcccgacctcatgacctgcccgcctcggnctcccaaattgctgggattacaggcgtnacaaccgcgcccggccggtagcaatagttttaattaaggtcttaaaatcatacaaaaaggaatt

SEQ ID NO: 498891 - DNA, 854 bp, Homo sapiens
gctccccccgccgcggtcgtggtgtggtggtggcctgccctccccgccggcgtgtgggtcgccctgcgtgcgcccccgggggtgtgagtctctgtccttgggagttgccgctgttcgtgtgcggctcggctcctgccgtgtcgcgcgcgtggcgcgcgcgccgctcccccccgcccgctcgcgcgtgggcgggctgtcgagggggcttctgcgtgttctgtgtctttgatggttgcggtggcgcagaggagcgctggctctggtttctttcttgctcctctccccccccgcctcgccgccggtggggcgtggcagctctctctctgtcttttttgtctccgtctctctctatttttgcgctcgctcgcgcgctcgtctctgctgacgcgcaccgctcgcgcctgtagcatctagttggtggtctttctgttgtgtgggtcgttggcgtcgcactctctcttgtctctcgctctctctgtctgtctgtggcctgcgcgcacacccccgccccgccgcgggcgggcgattttttttgcttatatatagttatttctccttctctatcagagttacgttacggcggcggtccctgaggtatttttctaagtggcggctgggggtgtgcctgtgtttgctctctcctcctcttcttatatagtagagttgtcctcctctccacgtcctgcttcatacacaccacctcctctcgttcttccttcctccttcttcgtctcttcaacacgcgcgcgccctgttcttctgaaggggaaagaaaatacaccacccccacaattttttttttttttttttcggcgcctcccccccccaacaaaaaggtttgtttgcttgcccca

SEQ ID NO: 498892 - DNA, 1074 bp, Homo sapiens
gctgaccagcaccatggcggttggcaagaacaagcgcctatacgaaaggcggcgaaaataggtgagccaagaagaaagtggttggatccattttctaagcaaagattgcgtgtgatgtgaaagcaccgtgcgtagtgttgcaagtataagaacatatgggcgaacgagcgctcggtcaccagtgacccaaggtaaccaaacattggcatctgatggatctcaagcggtcgatgctgtttgacacgtgagatctgggctgatttgacagcaatgatgcaagttggcagttgtaggatagaacttcaacgctgacttactgacaggatgttcacgggtaaaaaatcgtgcctgactaagcttccatggtcatggatcttagcctcggtgacaaaactgtgttccagtggtcaaaaaatggcaggacaagtgagttggaacgctcacgttgattgtcaacgactacgcgatggttgactctgcttcgtctgtgtctggtggttggttgtccactaggaaaacgcaacgaatcagatacggaagacctcttatgctcagcgaccaacaaggtccgccaagatccggaagaagcatgatggaagagtcatgacccgagaggtgccagagcaaatgcacttgacgagaagcggtcaataaattgattccagacagcattggattaagacctagcaaaaggcttgccaatctattgatcctctccatgatgctcttcgttagaaagagtcacaccatgccttgaacgaaggcccaatgtttgaacttaggggaaagctcatggagccttcactggtgtaagggcagctagtcttctgggaaaacgccaactgggggaccgagcaacaggcgtggctcaccacgttttgaacggaccttgatgggactattgaactccacccagttcccaaggaaatcctggtttcacacgcttcagcaactttcacatactatgtgggccaaatacaaacagttgctcatctgtgtaccacaaaacgcaacacacacctcccgatggcattcttttgccagggttcacggccacagcgcgctctcgcatgg

SEQ ID NO: 498893 - DNA, 863 bp, Homo sapiens
aatactattagccactacatgacgatgtgggccaagtgagagaaaagtgtacttcagcttactcagtatgaagcctttatgttctgaacgtaacaagtacacctagcgaactgataggaatcatttgtaaaaatctttaaggagacttttaacagtccttcgtgaatagagcaggcgaagaaatacaaacctgtgcattccttgaatcacaggagcactactggattcaaactgccaaaattattgaaaggttttaggacttactatacctagtactgttaagatcatactgaagtaaaggacgttctctcactaaggaccaggtgtcttaaggttaagtgtgtacaagaagtactccacagaacaatctgctttttgcatcattggtttcatgaatttatccatgttgtgcttaagtgcttctgctaagtgttagccaaaatctacgccatttatatttagtcgtgtaaacctagattaaatgctgtagtatctgtggaatgtactatatagcaacgatacagagaaaattgttcggcatgtcagagccttattggttagcagactgcatgtgtgatacttgtttttcttaaagccaatatatttgatgcgaaagaaattcagtttataagataaatctgaaaatcattaatgaattaggagttataacacaattcatagtgatattaatctttcatatttcccattaaggaacactaagcattcataacgttacccagggaaaaagtgtttgctggaaaatatatttaagaagaagggttccagccaatgggttcccaaataagacgttggcttaacaacattctttctggaagggataagaacaaggacaaacagaaaac

SEQ ID NO: 498894 - DNA, 772 bp, Homo sapiens
  misc_feature (301)..(301): n is a, c, g, or t
  misc_feature (311)..(311): n is a, c, g, or t
  misc_feature (391)..(391): n is a, c, g, or t
  misc_feature (642)..(642): n is a, c, g, or t
ccccagtgcaccctgcaggtggtagattcccaaggtcgattgggtcttggcttggtacaggatgtctggtgcatgtgtgtacgttgctgcaagggagcaaccgttcacgaaaagtgtatctcaggattcctgtatggccccagagtcatcccagaggccccggcttcacctgtggcgctatggagactttcgatcttgatgatgcagacgaatttggctacagccggctaaggaggggatccgggtttggcccccagccccgctcacgcctagtccctcttcctctgccgggagggtgttnttcaactccnaaccccagagaggggttgtagattgggtccagctttgcttcagtgtgtggaaaatgtctcgtggggtggcatcggggctncggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccnactgttgattatgtgatttttctgatacgtccattctcaaatgccagtgtgttacacatcttcgctctggccagccccttctgtatttaaagcttttgaggccccataaaatagtacgtgctgtctgcca

SEQ ID NO: 498895 - DNA, 109 bp, Homo sapiens
  misc_feature (19)..(19): n is a, c, g, or t
  misc_feature (64)..(64): n is a, c, g, or t
tggggctggtcaggaaacnaaggagacccccccccccaaccatggacccgggactccgcctcgntgcctcggaagccgtcggtaccttggcagcgccaaatggaccagc

SEQ ID NO: 498896 - DNA, 863 bp, Homo sapiens
cagggtgtcgttcggcgacgattgtagggtgtcgcgttttttttctgcttccctacccccgagggttcggtcccgcccccgttttgcgttttgacgaggctgttagcacagtctttctgctggccctttgtctggctagcccctctactcctggggctgtgggcccctgtccccctcctgtgaaatggggtagccccgtttccgcggatagtgtcaggctttctctcgtttccgcccacccctctggagctctctttttctgccagccgatcctccctgggtggagatgcgtcccggcacggcttgcttctctcgtcacacacgtgccacagagagcgtcgtgcgaccaccggacaaccggtcttcgctggggaaaaagacaggtgggcagacacgagtcttctcgccagaacccctcggtcctcgccacacgaaacactccccccctcgcgaagcgtggtgccccccgccagggcaccccacggctggaaaaaatgtcgaacgcccccacgagggcccacacagtaagtgccaagagcgaccccccccccagcccccccacgagggggtctactgccctcgcccaaggctgagcctctgaaagatcggcgccgcattctttcggtaccaccagtcccgtaggacgagtctgcgccccgcgcccggtgttctccgccctacggggtcgacgggtgatgttctcacgccctggacgtttccaccacgccactgtgcggccctacctctgccacgcggaacccctggctcccccctaatctctctatgacacctgtcccacaagattccggaataaccatcacccctcccaaacattacaaaaagtttccccacgcgtcataaca

SEQ ID NO: 498897 - DNA, 145 bp, Homo sapiens
taatcttagagggtagatacccagttctgctgagatcatatttttaaagctggatacatggcaatgaagagcttgcacagaaagtggaagtgtggttctgccataaagtgtccttgttgttccatgcacactattagcattatct

SEQ ID NO: 498898 - DNA, 1530 bp, Homo sapiens
ataccatggaatactatgcagccataaaaacaggatgagttcatgtccttggcagggacatggatgaagctggaaaccatcattcttagcaaactatcgcaaggacagaaagccaaacactgcatgttcccactcataggtgggaatggaccaagtgagaacacttggtcacagcgcaggaacatcgcacatgtgacttgtgtggggggctggcgggcttgggggagggactggcattaggagaaatacctaatgtacaatgacggagtggatgggtgcagcaaaccagcatggcacattgtatacctatgtaacaaaccttcatgtggtgcacatgtatcctagaattcaccagtataataaaaaaaatcataccagggtctttcctatagaaagatctaagcttgttaaaaaaaaaaacaaaacacacaaaaagacaaagaaaaatgagaaaaaaagcaacagaaaaagcaagaaagagacacagacaacgacacggagcagaagaacaaatgagaagtaaggaaaaaatagagagggcgcactaaaaagaagaggtagagacacagagaagggcgggggactgagagatgagcagagacctcaggcaagaacccgacggggccgacacacaaaagagcgactcgacgacaggaggcccacgaagagagagtgtgagcaaaaactacagacgtacaagcggggaagaaatacagagagatgaagaacgacaagggaggaaaaaaaagcaggagagaacgaggagctagaataagaagagaaaacgcaggacgagaaaagagagacaaaagagagaaagtaaaagggggaggaggacggaggactatagcgcggaacacgtagagagagcactaggggcaaggaaaggggagagaccaggaaaggaggagagggaggagacagatggtagggaagcgcggaagaagaaaagacggcacacggagcgaaggaacgagagcgcggcaagcaaggcaagggaggcggacggaacgagaggaggcgcaagccgagaggaaaacagcaaaggcaagaatgaagacacgtggcgactggagcaaacgggcgacagcggacagagcgagagaatagaagaaaatgaaggagaacaaggaaggagaagcagaaaacgggaagggagacgagagaacgaggaggaagcaaaggaaggagggagggagttaggatagagagaggagcaggagaagaggagagagggaagaggagacaagaaagaaaaagcgaggagagagagggagagaaagagagaaggagggagaaaaacaagaaaggagaggcaggagaaggagcagggagggagagctccagaggagcaaggcgaacaaatagaggaaggaacggaaaaaaggaagagaaagagcaagaggacacaagaaagaagacaacacaaggagggaagaaagaagcagaagaagacaagcggcagaagacgagggaaaaacggaaggagagggagagagaagaaagagcgaaacgaacgaggaagcagag

SEQ ID NO: 498899 - DNA, 174 bp, Homo sapiens
gatctcgaaggttgtttgctcatgcgcacagtcatgaccttcttgccgtagttgcggccgtgcatcatcatggagtttgtgaggcgctccacaatgggacactgagctttgcggaagcgtctggcggcataccgccctgcactggtgatgctatgaccactgtcgaggctagga

SEQ ID NO: 498900 - DNA, 440 bp, Homo sapiens
ttgcaacagaaaacacaagaaagtcaaaaaaagaggcaacaagatgatactgatgaatacgatgatgacaagtctgcagactcgacttcataaaagccacagcctgtgcaacctcagcaaggtgatattcctccaatggcacagacaggactgcaaccagtaccaggagcaccaagaatgcctccaggaatacctcaataaatgccaggtgttcctcctctgatgccaggaatgccaccagttatgccaggcatgccacctggattgcatcatcagagaaaatacacccagtcattttgcggtgaaaacataatgatgccaatgggtggaatgatgccacctggaccaggaataccacctactgatgccctgaatgccaccaggtacgcccccacctataccacgtcctggaattcctccaataactcaagcacaggctg

SEQ ID NO: 498901 - DNA, 204 bp, Homo sapiens
tcatcctgctacacaacaaaaaaaaaaaaaggaaaggaaaaaaattgccctacctataattataaggggaaaatagcagtaggtaacaataaaatattttatagtccttatgtaaatagatgggacacgactattttagaagacaaaacttgaccccacagatttcctaaggggcccccaagaaaattacagcccagtttgaga

SEQ ID NO: 498902 - DNA, 438 bp, Homo sapiens
gctacttggaagctcgaggtgcaatgttccaggtacgtagcggctggggagtccctgggagggatctcatctattttcagactttcaacaaatccgcacgtgtccatggtcgactgactcatcgttcatatttctgtttccaggctatcagcttgtgaccactgctatccaagactttgcaatccctcctacatgatctgcactgaaataacccgatcccttctctctctgtcactatttaacacactacttaaccactagttcagggattctcactaactgctcagactgactcgaacccttatgtgaccccatctgaggcggacaaatttctctgccgcagtgacactgatctaataatcctgcagtgcctacagccctccgttggaagggaaggtaagctgagacagtgctgttcctagagactgaggacgatcc

SEQ ID NO: 498903 - DNA, 113 bp, Homo sapiens
cgttagacactggtaggttcggagacactggcaggttcggagacactggcaggttcggagacactggcaggttcggagacactggcaggttcggagacactggcagtgttcgg

SEQ ID NO: 498904 - DNA, 773 bp, Homo sapiens
  misc_feature (113)..(113): n is a, c, g, or t
  misc_feature (156)..(156): n is a, c, g, or t
  misc_feature (160)..(160): n is a, c, g, or t
  misc_feature (162)..(162): n is a, c, g, or t
  misc_feature (164)..(164): n is a, c, g, or t
  misc_feature (177)..(177): n is a, c, g, or t
  misc_feature (191)..(191): n is a, c, g, or t
  misc_feature (236)..(236): n is a, c, g, or t
  misc_feature (273)..(273): n is a, c, g, or t
  misc_feature (276)..(277): n is a, c, g, or t
  misc_feature (285)..(285): n is a, c, g, or t
  misc_feature (329)..(330): n is a, c, g, or t
  misc_feature (336)..(336): n is a, c, g, or t
  misc_feature (364)..(364): n is a, c, g, or t
  misc_feature (373)..(373): n is a, c, g, or t
  misc_feature (400)..(400): n is a, c, g, or t
  misc_feature (407)..(407): n is a, c, g, or t
  misc_feature (420)..(420): n is a, c, g, or t
  misc_feature (441)..(441): n is a, c, g, or t
  misc_feature (457)..(457): n is a, c, g, or t
  misc_feature (466)..(466): n is a, c, g, or t
  misc_feature (474)..(474): n is a, c, g, or t
  misc_feature (493)..(493): n is a, c, g, or t
  misc_feature (507)..(507): n is a, c, g, or t
  misc_feature (602)..(602): n is a, c, g, or t
  misc_feature (614)..(616): n is a, c, g, or t
  misc_feature (620)..(620): n is a, c, g, or t
  misc_feature (646)..(646): n is a, c, g, or t
  misc_feature (656)..(656): n is a, c, g, or t
  misc_feature (659)..(659): n is a, c, g, or t
  misc_feature (661)..(661): n is a, c, g, or t
  misc_feature (675)..(675): n is a, c, g, or t
  misc_feature (679)..(679): n is a, c, g, or t
  misc_feature (693)..(693): n is a, c, g, or t
  misc_feature (772)..(772): n is a, c, g, or t
cgtcgtcgtcgccgctgctgccgctgctgttgctcctgaggctgctggctgaggccggaggatcgagcggcggcggcggcggcggctgagagggcggcggcgggagcggaggngaacgagggaacgggaggaagcgagcgaggagcgcgcagagcntatntntnccgtccgcctgangagccgaagcagcnccggccccgccgccgccgcctgcccgccggacaaagccgagagcncgcgcccacagccatgtcctcgtcagcaggcagcggncannagcccagncagagccgcgccatccccacccgcaccgtggccatcaacgacgnngcgcantacctaatgactattgcaccaacagccnggaggggangctcttctccaccacaacgggaggaantcgaatnatttatgataganagtttactagttggtatcgtngcaattatcacatggntcagacccnaacctgcnatctgcccaatatcccagnagtaactaacactngcaccttaattgaagactccaaagtagaagtaaacatttgaacaactatgaacaatcacgacaggaaacatgcagttggggatgatgctcagttngagatggacaannnactntcctgcaagatttagaagaaaagcancaacactganacntntgtgcacctgattnggcnaataggatcaacantgaaaagacagaagaggcaataccagcagtacccattacagtctccacctccccgtcttcctctgggtgcaaaatgatng

SEQ ID NO: 498905 - DNA, 84 bp, Homo sapiens
gtgatccgaggattactcttcagcttgtgtgacctgagagtagccctgcactccagcctgggcgacagagcaagactctgtctt

SEQ ID NO: 498906 - DNA, 168 bp, Homo sapiens
aatactataaaatccaacagaaaaaaatagcatttactattaaaaaaaaaaaaagaattagtctttgtgggtttggggcaagcaactgcccttctcagttaggatgggggagttctggacatttctagctaaagcccaggggtcaagggaatgataaactcctcggtc

SEQ ID NO: 498907 - DNA, 537 bp, Homo sapiens
  misc_feature (77)..(77): n is a, c, g, or t
  misc_feature (85)..(85): n is a, c, g, or t
  misc_feature (307)..(307): n is a, c, g, or t
  misc_feature (381)..(381): n is a, c, g, or t
ggaaacatgccccctagcgggtatactctatccaagattctgcaaatgccaacattttaccatggatcacccctggnccatcctnttcatcttccgggactaaggcacgctctgcagctctgcagagctcaagtagtgactggtgaaccaagtaacaacttgttccaggtcaccacagagtggggacaaacttaagctcccttagcaatttagctttagaccacaaaggccaaatctaccaggatatatttagtgctatcgagaccagcacacagcctgtaacagcaacctatcaggcacatgagangagaacatgattttcccaaagtgggggaaatgccatcttgggcagcggggcttcctcacaagcaggcccttgtncttcctgagaagtggaacagacactagctaaccctaatggccctctggtccctgctgttctcctcaactgtagggcaggaggacttgttccatctgcttccctcttcctcttccttctctcttctatttaccccttcctttttgattaagaaactt

SEQ ID NO: 498908 - DNA, 455 bp, Homo sapiens
  misc_feature (281)..(281): n is a, c, g, or t
  misc_feature (357)..(357): n is a, c, g, or t
  misc_feature (412)..(412): n is a, c, g, or t
  misc_feature (448)..(448): n is a, c, g, or t
aattcgcggccgcgtacgacaatgtaataaaaaaaaatgaaaaaaaggtctcagtgtttttaatgcactacatatttgtatgcaagacaagcatccagtttttttctgtaatgcagtgacagtgtggaatgaccactcagccattataaatttgtgtactcagggcccttgtctcacccaactatctctataaactgctgcagtagcttatttgtacaagacacttgtgaaatcagttttcttacattatagtcatgtcacatatggaagttggtcttgantccgtaaagggaatatgtttctacataacaggaataggagaaatcgtaacgttgaatatcttgaaagaaggctaangatgttagtccgtgcctataggagaggacccgtaccagcagagttaattaagggnatcatgctatcagttcatagcacatagtgaccaggngtgtcgc

SEQ ID NO: 498909 - DNA, 1631 bp, Homo sapiens
cccacgcgtccgcaagcctgggtgacgagtgaaactgtctccaaaaaaaaaaaaaaatctagaattctgggaagtacattataattggcccttcagaatagattcccagtccctggtggtggctcacctttataattttaccataagttttacctaattcgtaagtgggcagttttagatagataacattctgggggggtagctagggatttacctttggtcatccttttcctggcacttctctggaattccctttatagatgtacaggttttggctttaacccactggaagatggctggtacaattcataaaggggtggtgatagaatccacatgggctgtcaagaaggagatcttaccaagggacagttgactgactagtctcagatggtttcatatcatttatactggggtaagagtaacctagataactggggcgtcgtggtgcacacctgtagtcccagccactctgaggcaggaggacggcttgtgcccagaagtccgaggctgcaggtgcagctgtgatggggctacggcactccagccggggcaacagataacggaacctccatactctttaaaaacaacacaaacgggccgggggtgacaaaaggcaaagcctgaaaccccaagacacctgggggaaggccaaaggccgcgacggaaccaccgtgaaaggacacggacccttgaaaacacagccgagcgccaacatgtgtgaacaccccaactctctagcacacagtttcgacacaatcgctgggctaggaggcagcgaccctgggggcagacacacaatatgaacagcgaaagagagaaaatccgcgcaccatcgggacaacgggggcaatcaaaaggcaacaagcgcacacaagcagacctagcgccgggcacaatcagagaccgtctccaacgacaaggacgccctagacggacaaatctacatcgcatcggcaacgactcatactaaccacacatgcacggcggcacacacatgcgctcgacaagacagcagcagcatatcaagaaaaagactctccccgttcatcttctgctggtgaataaattacgaccccagccgacaccagacaccaagcacaccacgagatcaaaaccacgccaacaacacaaaaatcacaacgcaccaaagcaccaaaccagcccaccaaaccacacacaccaaacgaacacgcacgacacaacagaaacagcaccacaaaccacatcaacacaaaaagagaccgacactaggcccgacaacacacagcaacaccacagactacaacaaaccaaacaccgaacagcaaaaccaccgccaaataaacaacaaaaggaaacaagagaggcggcgaggacagaagaaaacaccacaaaagcaagaaaccacacaaacgcagagaaagcatacagaaaagaagagaagaaagaacaacaggaaaagagagagaacaaagagcaaagaaagcacgaaacgagaagaaaaaggagaggaacgagaaagaagagaaagagatcagtcatacaagaacagaaaatacagccaggaaaaaacaaaacacatacagagaacaagaaacaaaaagcaagaggagaaagagcgcaaagagacagacacgacaaaaacaccatag

SEQ ID NO: 498910 - DNA, 290 bp, Homo sapiens
agcgcactagcctcatgcttgtctgtgggacggaaaagatggaaggaggcatctgtgcctcagtgcctgagcacagagagggtaggcctcttagaggcacaactggtttccttcgtggggttcacagtctgatgcgcggctggtgtatcgccaccagtgtatctcctcccaggaccctgggggcacggggctgtggaggggaggaactgctcatgcccagtgcctgatactgtgggcacgcattcatgggcatccattgacgaggactaagtgcccagcaggataccgag

SEQ ID NO: 498911 - DNA, 103 bp, Homo sapiens
  misc_feature (19)..(19): n is a, c, g, or t
agaacaaacgaaagcatgnggcacggtcaagaagagacatatagaaaaagtatacggtggcatgcccccttccttaagcttgaatcctttaaagcggccgcct

SEQ ID NO: 498912 - DNA, 239 bp, Homo sapiens
tcctcgcgtccgagtctgactacgcggtgggggtgtgaggatccgaacaggtgtggggggtggaggcggctcctgcgatcgaaggggacttgagactcaccggccgtcacgccatgagggccctgtgggtgctggtgcctctgctgcgtccctgcttgacctttctgggttcgtgctcagacgctgacgatgagatttgatgtggatggtacagtagaagaggatctgggtaaaagtag

SEQ ID NO: 498913 - DNA, 256 bp, Homo sapiens
ccgaatatataataaggggtgggggtggtgttagacttctccctaagaatagtgggcatccattataggatttaagtgtggtgagctgtagtcagatttgaattttcagaagtccactggctgggatgtggagagtacactgaagagcgtaagaagagatgtgaggatcctagctgggaagctgttgcaggaatttgagcaggagatgatgggatggcagtgtcgtagagtaggaggaaagcacagccatttaggt

SEQ ID NO: 498914 - DNA, 429 bp, Homo sapiens
gagacagtaacactatctcacagcagcacccccggagcctgcactgaggagggcggagcgtggcgtcaaaggactgggccagcagctcacatcaccctgtcctccctttttcaggcctaggttcactgtcccccaggcagcttcacggctgtttttacacacctcccattgtagctgtctcaccgggtcatcggtgaccacggtgtccaccatgttaccgagagcttctctgtgcccctggacgagtcctaaggctgtgctgtctccggactttctgcaaaggaccctgtaagtgctcccagcctccccggcctcgcaggcaaccttctctcccccgcctcccggagccggcctcgaaggcaccttctctccccggcctcccggcacgaagactcgtgccggcacgaggatgaagcagacatcgaaaga

SEQ ID NO: 498915 - DNA, 1074 bp, Homo sapiens
gggaagtgaggttccataccacctggactggcctggagcaaaactggtggccgtgtgtgcaaaaatgaactgagctggactgccatctggaccctctgcctggatcagtgtcctcctccccctccaacagagaccccctactacccacagtcatcataccagatatcaggactcagatgaggacgtgcgttcccgcgtcaggcactagatacggcgcatgattaagtcaggtgggagagcattacaacatgaaccgtggaaaaaattgatagtcatgatgacactgaagagactacacaagaagccctgccctgaaaggcatcagaagatagggtccaagcgacggcaggtgggaccgcaacagccagtagcacctgcgagccgtaaagacacgccgaagaagagagccagtccggcccaaggaggagacacagcggcagaggaagggagggccaggcatgggaaacgtaggaagagtgagagaggcaaagaaaggtgcgagaaggaggaagagagtcagggggaagaagaagcagggtgacgcagaggacgtaggaggtgaaggtaaggaagggacgaagtagaaggcttagagacaaaggagaagatagggtcgttagaccacttaggataagagagcagagtgtagatagagagaaagaaggaaacaggataaggcaagaggatatcaagagtgggagaaaaggaagtgaaagtaggtatcgcgagatataaacaagggaaaagaagtaagagggaagggtataggcaagagcacgtactgaggcgctaggggacaaggtacgagaagatcggacctcgaaagacgctagagggccagatagagggtcggagcagagaagtagagagacagaagacgaagaggtacaaggagcgcagtagatgaacaggagcggggatacaagagatgaaaaaatatagaagagaggaaagggaagtgagccggaaagagcagagagtagaatagtcagagagacaagagcagtaggagagcgataggaattgggacatagggaagcacaatgggtaatacaagccaatagaggcagcggg

SEQ ID NO: 498916 - DNA, 303 bp, Homo sapiens
tgcccctgccaaggttgccctggcgttgagtcctggggtccctcccggagtttttgggaaaaagggccctttgtggccccctcccgcacgccaggcccgggttcccccgtgggtttcaaaagcccttgggccccggcccccttttgttttagcatgggccccccatttgaggggtggcctggcctttggggtccccccgctcctttgcgaagtcccctgtgggtgccatcatggtttccgggacctgggccagcgggaacgtgggggccctgggtgtgttgatataaagtcggcattactcca

SEQ ID NO: 498917 - DNA, 692 bp, Homo sapiens
ggagaactgtctcagtttttttttttggtggttcgatctatatctatttttggaagaaaccaatccggggtaaagaaaaaagggaatgaggtttggggacagaggtgctgggggtgcgaaagaagccccagcccctgagtggtgtggtggagggaagggaagggtcacttgtaaaactacatgctccggctcgtccttctggatgacagtctggtatgctttctcgaagtccttggccaggacaatgtagcggttttcacggacagccaacattccactctcctgacagatgggacgttaatatcagttcctgaaatcttatctgggccgggccacatagtcttccaagtcaacctcctcagagaggttcatctggcaagtggatagtgggagaaaatcaagtctcttctgggcggaggtcaggaagtggaaatccaatttaagggtccagccgtccgggccgtacacagggccggatccagggtgtctgctctgttgggggccatgattaccttgacattgaacattctgatacaaatccatccatcggattcaggcagctccagcaggatcccttgaacctccctgtgggcccctgtttgagcatcggaatcctctggggggcaatggcatacaatctccgtctatgacagcatcgatggcaggtgaattctccttggccaggggaaacc

SEQ ID NO: 498918 - DNA, 419 bp, Homo sapiens
tgatcttggtgcactgtaagctctgccgtccagggctcaagcgattctcatgcctcattgctcttgattaactcacattagaggagtgtgccatcacatccatctaattattgtatttgtatagaagagacagggtttcgtcatgctagcccaggctggacttgacgtctcggctcggcatcgcaaagggctgggagtgacaggcatgaggtactggtgccagatcagaattgtaatgtatggtatggcatttcatttcctttccatatgattacacaattatcccagtatcatatgttaactctttccttactgcattggattgctgcgatgcctgaatagcaaatcagatgttggagtaaaggaaaggttactgcagagctctgtattgcagtgatctgtgtctggtccacattacg

SEQ ID NO: 498919 - DNA, 132 bp, Homo sapiens
tggggcgcttcgagctgagcggtatccctccggcccccaggagcgtgccccagatcgaggcgaccttcgacatcgatgccaactggattactgaacgtcacggccacggccaagagcaccggcaagcccaac

SEQ ID NO: 498920 - DNA, 622 bp, Homo sapiens
  misc_feature (160)..(160): n is a, c, g, or t
  misc_feature (283)..(283): n is a, c, g, or t
  misc_feature (286)..(286): n is a, c, g, or t
  misc_feature (289)..(289): n is a, c, g, or t
  misc_feature (297)..(297): n is a, c, g, or t
  misc_feature (317)..(317): n is a, c, g, or t
  misc_feature (346)..(346): n is a, c, g, or t
acgtggaaccgtcacgcaaacccaagaggcggagggccgctgacgtggaaccatcatcacccgaacccaagaggcggagggtcggtgatgtggaaccgtcacgcaaacccaagaggcggagggccgctgacgggggggggggggcccccccggcttgaancggtggaaccatcatcacccgaacccaagaggcggagggtcggtgacgtggaaccgtcacgcaaacccaagaggcggagggccgctgacgtggaaccatcattacccgaacccaagaggcggnggntgngctgagangaggcagtgcactcaagccngagcataagaataaaaccgagtagaacanaataaaaaattcaaaaaacaaaacaaaacccacactccaaaaactaacaaagaataaataaataatataaaaataaaaaaaaaaaaaagggggccaggggttcccaaagatccattttcctctttacacccggggtctccacagggcccagggcggcagagggggcagcagggaagcaaacgcttcccaccgggcttcggggggagacccggggataataacaaatcagcgcccagggaggggcgctaggggcctctcaggcacaacccggggggt

SEQ ID NO: 498921 - DNA, 723 bp, Homo sapiens
agaaggaaagatataatatgtaccaacaacatggttttgcctacctaagcttatttagccatctcaggttcaagaaatagacgctgaggagacacgattaactggagtctttctcagcttctctagttgttttatatgagagtcagccaagactaagaaagaggagaaaaactggcttttaacgaatattttgtgtaactgcaagaactactagggtttgatgtaccttgctcattaaactacgctaggaattccctatgtaaacgctgatgcgtttgccttaacgaaaaaaattttctctaacgatacagaaattgtaacctcatttttaccatagtcaccggcagtgaagggatatatcgggacctctatcagtagtctttgttcttttgagtattgttccctcagggtcctgtgaaaccaggtgcaattatggtattcgttgagtgtctatgttaaatagggtgcaaatttttagacggtcttgcataaaaaaacaaaaaacgttcttctatcggaaaaagccgttcctgcttacaaagccaagatcttgttttgtacgcagttgctctgggattcagattacgtgtttctaagaagcaggtccccctcttctaaaattattccatggcatacctttattattcttctcttctcagccacgttactcttagtagaagtttcttgctagcgcccgctttatcccgaaaacgtcatttcaca

SEQ ID NO: 498922 - DNA, 401 bp, Homo sapiens
cctggctctgaacttaggcacgcagggctagaggccaagtggtatatgagcggcctgtgggggttatgaatagcagagacagactggtgctgtcacagcccagtcataccacaccttcttggaatggctgcatcgccagaaacgcacacagatggttaggccttcacgtaccgttatgggctgcttaattagggaagaggatgggaaatcatgagatcatcccaggagagtgagtctctggacggatactcagagtgatgtcctgatgaagcagagtctcaaagtagccggctaagctgtgtagtactgtgttcacctccacaggatattcctaggtgcaagatcggttgttgtctatcataggatctctgttgggatggctgaaggtcctaagttcagaa

SEQ ID NO: 498923 - DNA, 591 bp, Homo sapiens
  misc_feature (252)..(252): n is a, c, g, or t
  misc_feature (255)..(255): n is a, c, g, or t
  misc_feature (258)..(258): n is a, c, g, or t
  misc_feature (266)..(266): n is a, c, g, or t
  misc_feature (286)..(286): n is a, c, g, or t
  misc_feature (315)..(315): n is a, c, g, or t
acgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggnggntgngctgagangaggcagtgcactcaagccngagcataagaataaaaccgagtagaacanaataaaaaattcaaaaaacaaaacaaaacccacactccaaaaactaacaaagaataaataaataatataaaaataaaaaaaaaaaaaagggggccaggggttcccaaagatccattttcctctttacacccggggtctccacagggcccagggcggcagagggggcagcagggaagcaaacgcttcccaccgggcttcggggggagacccggggataataacaaatcagcgcccagggaggggcgctaggggcctctcaggcacaacccggggggt

SEQ ID NO: 498924 - DNA, 108 bp, Homo sapiens
tctttgctggaaactggatagacgcacctgtctgactacaacatcagaaagagtcacctgcacttgtgctcgtcttagaggtggatcagatcttcgattttgacgcgt

SEQ ID NO: 498925 - DNA, 1126 bp, Homo sapiens
aagctctgggccactcagcatcggtgcatggatgccttcttttgtcccttctgatggacgccaggctgctgattatcgcacgcaactctgcatgttcctggcatggactcgtgttccagaacactgaggatgtacgaaactccagcaagcccagcctggggccagagcggtccttttccacccttaggcaaagcagaaggccctatcacagcacctctggcagcaggccaggacgctggactggcactgctgacatacatacgcgcagcgcccttacacaaccacccatatacgacacggcaaaccggactatgctagatcaaatctacacggactatacccatgaagcacgccacgcatccgccacacaagtacgaaccaaccacaacgcactcaaactcaaacaactaccatctcatcttgggacatcccaagccccaggtccatcgtgctacccatgacgctctttcacgactccccgcgcatagggacgtcactcatttggccaaaccacactcccggcaccctcacatcggcatctcaagacagggccctgaagaacaactcgacctcgcacccactgctgcaaagacaccggtcagcaaccctctaagccagagccacccagcactccaggccatccccagacaccagctgtggtggccctggcacaccacacccacctaatcatacacccaaccgtcccatccacagaatgctcaccaggacgaccccctcaaagcaaatggtccacacacataccaccaccacggccggacaaggcccacgcacactaccccccactccacgggacacagatgggcgggcaactcactaacacctggcacaataccgccacaggacagaaaccaccctgaacaagggagccacagaactgactgcacaggggctgacaccaccgagggagaccccgcaaaagcaatgatacacaacgcgttgacacgacagcgctgcaactggggcgcaccaaacggctaccaacacagaacacaggagggaggcaccacaccacacaggcctgccaatccagcgagcgacacccgcaacgcgatcgtcagcacgcccctccccggccagcacaaccacaacacggtggctgcacact

SEQ ID NO: 498926 - DNA, 429 bp, Homo sapiens
  misc_feature (1)..(1): n is a, c, g, or t
ngccttcccctttaacccccggttcaatgagaacaacaggggagtccttgtttgccatacaaagctggattataactggggaagggaaaaaaaaccgtcggttttcccctttgaaagtggggaacccttcaaaatacaaggtctggttgaacctggccccttcaagggtgcagtgaatgatggtcccctgttgcaggaccatcctcgggtttaaaaactccatgaaatcagccaactgggaatttttgggggcataggcctcccccggggtttatataccctgatattatttgaaaggggccgatttaaaaaaaaaaaaagaattttaacccttcatgggtaaagggttcatgttccctgtgagtgaaaattttttccttcctccatatccctcttgtaagtcatttacttaattaatatttccgtgga

SEQ ID NO: 498927 - DNA, 484 bp, Homo sapiens
  misc_feature (79)..(79): n is a, c, g, or t
  misc_feature (273)..(273): n is a, c, g, or t
  misc_feature (380)..(380): n is a, c, g, or t
  misc_feature (393)..(393): n is a, c, g, or t
  misc_feature (403)..(403): n is a, c, g, or t
  misc_feature (454)..(454): n is a, c, g, or t
  misc_feature (468)..(468): n is a, c, g, or t
  misc_feature (479)..(479): n is a, c, g, or t
gagagtgggagtagacagaagatccctagacacctggagtatctctcacttgttatctttagtgctgcataggaatttnagaaatgagagaatcagtaaggcattgcatctgaggggacaagctctgggcagaacctcctggacacatactccttctttggcctccaaaccactatgcatagaaatatttcttcttacatttggggagtggggagaaaaaaagaacgtgaagaggacccacctaagatgaccctttgatcaaagccttgaggntccaagggtagtgcccccggacaaggagaaccccacatcaaaccaatactttgcccttgatgaggccagggttgactcccagaagaggactttgtgataagaatgtngaaaaagaggatnaaccccaggnccacttaagcattagctgtgctcatgttttgccacacagttaggttacaancttagtttacctgnatttccctagnggttt

SEQ ID NO: 498928 - DNA, 315 bp, Homo sapiens
taagatagatggccaagagttatggaaagcacagtgtaacgtgtctggaagttgaacagtacatcagagcctccaccacaccctgggagggaacacagtgtacagttgatgctactgagcctgtgttactgccccactagacaaaaacatggaggcttggcctgcagacctggacacagcttagccacaaaacacatccctctcgtcttaaaagtgtaggacgttctctaagggggttctccttcctgacctcattttcgcctctccaaaacccgatgtgataaggaagtagacattatgattctcatttgatag

SEQ ID NO: 498929 - DNA, 183 bp, Homo sapiens
gaaacctaattagggtttgaaacctaattacggggacatggtggccctgggcagagatagagggataatgtattcttatgtggtactcaatctttccatgaagtggcacttgtcattgactttatgaaattttacacttttttacgcatgcatgaaaaatatactatgaaatgtttcaaattg

SEQ ID NO: 498930 - DNA, 330 bp, Homo sapiens
ggaagatcctggtggtgatttgtgagtaccaacttaaaaaaacaacaacaaaaaaactttgcgggcgcagtggtgaacgcctgtagtcctagctacttggcaggctgaggcaggattgcttgggcccaggagtgggaggtcagccggggcaacacaggaaaaaaaaaaaattggccaagaggaaaaaatccttatgtaaggtgtccttatcgcaaaaagtaacataaatagagccagaggaaacttaaaaaaaattcagcattacctattaataaatgaaaggagaaatcaggcgaacctaacactttggtccggatcaccaccagaatg

SEQ ID NO: 498931 - DNA, 844 bp, Homo sapiens
gacagggggagctggaagtcaactacttccttaagatcatccaactatggatgattatccgaaatgtttcattgtgggagcaggacaatgtgggctccaagcagaatgcagcagatccgctatgtccctgcgcgggaaggctgtggtgctgatgggcaagaacaccatgatgcgcaaggccagccgaggacaccgtggaaaacaaacccagtctctggagaaactgctgtcctcatatccgggggaatgtgggctttgtgttcaccaatgggaggaacctcgactgagatcaggcacatgttgctggccaataaggtgccagctgttgcccgtgctggtgccattgtcccactgtgaagtcactgtggcagcccagaagactggtctcggggcccgagaagacctcctttttccaggctttagcgtatcaccactaagaaatctccaggggacacacattgaaatccgtgagtgatgtgcacgcctgatcaaggactgtgacgacaaccgttgggatgccagcgaagaccacgcggctgaacagtgctacaagatctcccggcttctcctttgggcgggtcatgccagcaggtgtgcgagcatggcaggcgatctacaaccctgaaggtgggttgatatcacagaggagaactctgcattctcgcttccgtggagggtgtcccgcaatgttgccaggagtctgtcctgcagattgggtatccaactgttgcatcagtagccccattctatcatcaagggtccaaccgagtcgggcgtgtcgtgggcagggttaaccttccattggtgaaacggcaggcctttgggggcccacccctgggggtgc

SEQ ID NO: 498932 - DNA, 505 bp, Homo sapiens
  misc_feature (44)..(44): n is a, c, g, or t
  misc_feature (131)..(131): n is a, c, g, or t
  misc_feature (142)..(142): n is a, c, g, or t
  misc_feature (181)..(181): n is a, c, g, or t
  misc_feature (240)..(240): n is a, c, g, or t
  misc_feature (244)..(244): n is a, c, g, or t
  misc_feature (251)..(251): n is a, c, g, or t
  misc_feature (255)..(255): n is a, c, g, or t
  misc_feature (259)..(259): n is a, c, g, or t
  misc_feature (270)..(270): n is a, c, g, or t
  misc_feature (283)..(283): n is a, c, g, or t
  misc_feature (307)..(307): n is a, c, g, or t
  misc_feature (326)..(326): n is a, c, g, or t
  misc_feature (344)..(344): n is a, c, g, or t
  misc_feature (389)..(389): n is a, c, g, or t
  misc_feature (398)..(399): n is a, c, g, or t
  misc_feature (408)..(408): n is a, c, g, or t
  misc_feature (414)..(420): n is a, c, g, or t
  misc_feature (422)..(422): n is a, c, g, or t
  misc_feature (424)..(424): n is a, c, g, or t
  misc_feature (432)..(432): n is a, c, g, or t
  misc_feature (442)..(442): n is a, c, g, or t
  misc_feature (444)..(444): n is a, c, g, or t
  misc_feature (505)..(505): n is a, c, g, or t
aaacaatataaagaggaaggcttctgacgccaaacatgcaagtnataacaaaggaacagagaaaaatattaataacaaaaagaaaatcattaaaaataaaaaaacaaagtacttcacatttcacagcagtnctttggcagtnctggcaagcatttctggtcaactgcttccaacagcaggnatatgaagaaacccccagatcttagcaaaagtgtaacaacattttctccctgacagctnacantccaagncagnccanaccataccgcnccactccacagtnttataaacctgatcttaagatgtnactaggtaatatgtgtgcncacaataaaaactaactnaaaacaaatcagagggtagcagacaagtaaacaaagtttccagtnaggcatcannagatcactnctggtnnnnnnntnantttaccancataaagaantnttgatttttatttctcagcaaactcaatattcagaagctttaccagcagactcagttaaan

SEQ ID NO: 498933 - DNA, 490 bp, Homo sapiens
  misc_feature (1)..(1): n is a, c, g, or t
  misc_feature (110)..(112): n is a, c, g, or t
  misc_feature (143)..(143): n is a, c, g, or t
  misc_feature (160)..(160): n is a, c, g, or t
ncgtaacctcaaactcctgggctcaagcaatcctctcatgtcagcctcctgagtagctaggaatgcaagtgtatgccaccacgcccagatagaatttgtagagatggggnnntgctatgttgcccaggctggtctcaaactcntggcctcaagtgatccntctgccttggcctcccaaagctgaaattataggtgtgaaccaccatgtccagccttacttttatcttataccaacatttgagtaaggcttactttgctggttttacagtctatgcatatgtatttatttacccatgcagtcaaggaaaaaaatatgcgtcatactaaggataggaattttatatgtcattttggataacaaaaagttccatttttacagaacaaaaatcatactgtgtgaccttctgtactattaagtattttgaaaggctttctgtgcttttgcaactattggcataaaccacatcctctttctagttgtgccaggtaa

SEQ ID NO: 498934 - DNA, 407 bp, Homo sapiens
ggtctttaaaaaattatccaaaggggtttaaaaaaatgtttattctgtttgtcagggacaaaaatatttatgaaacatggatgacttgtttaagttattaacattttttttagccttaggtaaagcatgaaagcccatgtttcagggcccctcccataaaaagggcccgggaagtgttagctattattgtctacttgaggtaccactttttaaaaggaaggtgaagtctttttctggaaatgcagatttgttgattttgcatttgaggattttttatattttgaagctgttaaaagcaaagtcatgatttttgggggaatgttttatcaatttttgaaaattgcctttgtttcaaaaaaagcttttcaaattgaactatattttgtttggtattaaaaacttcccag

SEQ ID NO: 498935 - DNA, 615 bp, Homo sapiens
cgggcagtttaaaagagaggcgagtcaaacagatgatcggaatactaaggacaaaggaaggatgaaggactgaacaggcaagcaaccagaggaaaatcataaggaaaatcacacagcataggaagaatccactaaagtttcttctttggattactggacagtatgattaagtaaatgaaatccgcaccaaatggaagaatcatgtgagtactgacctcaatactatagtaactgtcaggcgtgggtgtcgaagttgataggtttctcatggacagttattgtaaattagcctttactgtggtacaaattctttataactgacttagtcatttgccgcttagcagtttcatatcactgaaatgaacacacatctggtggggcacaccagtgactttagattatgacactcacttcaaatgaactctatttaaaatggggtcctattttggacaacaggaacatcacgaatgtcacagtccagacagccttgaggtaaaacagtgtgctttggcttagaagggatccagtatattaattacatcttttattatgatcgtttatttctaagaatcatttctggctttctcaaaacaaactactactactgcgtccttc

SEQ ID NO: 498936 - DNA, 455 bp, Homo sapiens
  misc_feature (455)..(455): n is a, c, g, or t
tcgcccaggctggagtgcagtggcaggatctcagctcactgcaagctctgcctcccgggttcatgccattttcctgcctcagcctccagagtagctgggactacaggcacctgccaccacgcccagctatatttttttatttttattagagaaggggtttcactgtgttagccaggatggtctcgatttcctgatctcgtgatccacccgcctcggcctcccaaagtgctgggattacaggtgtgagccacaacgcccggccgatttttatattattaatatcattgcacaaagctctcagttgcaattggctaatcaattttattcatattgaaaagggacccacaattccgccttaaactttgcacagtacagctcagtgttttctactcagacaattctcaaccataatgttataattataccattttctcagcggcatcacccacatactn

SEQ ID NO: 498937 - DNA, 558 bp, Homo sapiens
ggatcccggtggaggggttctggaaaggggaagtattggtgagagcgggagaccttgggggtggcttggtttctctggtacctgaagataaagaggaggtcatatgtcagagctgattttacactgattccctccttgccatttcagggagagaagagagggccaggtgacgggaagaatccaggcatgcagttggtgttgcctttctgcaaacacatctacgtggggtgccggggctcggcttgtggagaaaaccacaaaaagcaaggcaggcacgtgtgtggtccagacaggaaacggaccagcaggggaaggaagactggcggattttcccttcgcgctaacctgacaataacaccctcgtgtcagtctctgggttccattcacccagggagagagggtggcatgaattcatcaatgaattcttttcacagcttaccagggtttgcgtgacgcagagccgtgatcatcagagaagctgaggttcttatttcccaagagaaataagtcacaggcaggggaataaaacaggtacccaaggtcaaatcgtggagggat

SEQ ID NO: 498938 - DNA, 256 bp, Homo sapiens
accccttcccccacatgtggagatcagttatatctaagggataacaggtagtttccaacgctgctcggtgaacttttatattctaagtatagactgggatcaccatattgcatggtctcgtactcctcacctcagttaatacaactgctgtggcctcccaaagtgctgtcattacagtcttcatccattgtgcctgtcctttatattgttcttcttgctctgtcccccaggcttgattgcagtggtgccatctcag

SEQ ID NO: 498939 - DNA, 814 bp, Homo sapiens
agcggttgcacacggcggccggcatgcgtatctgaaagtgtaatgtctggttagcaggccatctatcctagatcgcggagatgatgtacgtccagcctactgatgtgtgtggctgatgctggcatgaaagctgttgctgaaaagtagtcgatagaacatatcttctggcataacacgaaacgtctactatgccttccgcgcgtgaacgtcgcctcgccggatgcgggcccaggtcctgctcctgagtgtcccaagcggatagtcacatgtcaggatgaggagaaggtctcctggagcctatcactctatgagatgagagcttatcgggttgtatcgccttgatgtgctgaggaagaagttgtgatacaatctgaaacagagggcgccaaagcgtaatgtctaatacagtgaagctaggatcggtgcacaaatgattcatatgcagtctaacaggtacagctgcgaaggcgcgtatcaatcagtgatgtcaagacagccaactattgcagtcatctatccgcagtcccgtcttggcgttgcgaacgggaagcgggtggacgagacagatcgtacagcaatgtctgcaacgaggatggtggaccaccggaacgatgctcttaagaataatctcctggtgaccacgactagtatgtggcgtcatgaaaataccactttgggtactgggacctgccatgagactggactctgtcaactgaccggcacttaccatgcatagtgactgaaaacctctttgcgagaagaaagaacaacgtacataacagaccattttccgccacgacacaaaaaatcatac

SEQ ID NO: 498940 - DNA, 273 bp, Homo sapiens
gagtcaatggcagcgtaggtattgctcgacctcaacgaccaccgatgcagagccggccgatatcaccagatcacgtattttgctgcgcttgccatccaccgctcccaccaggctccccctgtacgggatcaacacgaggtacgaagctactcgctattcgcttcccggcgatttttacgctgagacatccttcaacgggtaccggttcttcgccccggccgagcactatcgctcggccgatttcagcagagccgagcgcgacttggtcgacgc

SEQ ID NO: 498941 - DNA, 118 bp, Homo sapiens
cgttatcaattccatctcagaggtgctcagcgcggagcttcctgtattttccaaaggctttaaatagcttaaaaccgtttccatacaaaaagggctccacgacatttatccgcgcaga

SEQ ID NO: 498942 - DNA, 216 bp, Homo sapiens
  misc_feature (194)..(194): n is a, c, g, or t
cccactctttcctgcacggaaaaacaacactccagagaaaatacacaagactagaagcagactaaacagaaactcattaaccatcagagaaatgcaaatcaaaaccacaatgagataccatctcacaactgagtcagaatgactattaataaaaagtcaaggccgggcgctgtgactcatgcctttaatcccangcactttgaggaggccgtaggc

SEQ ID NO: 498943 - DNA, 369 bp, Homo sapiens
tagagaatcaaagcaaagtaggggaggctcgcgggggactgcttctggtggaggatgggtaccgccttgcagacacacaggaagcaagctcaggcacgagaggtcacgactcatcgttctctgctggggcacatagcgatgcagccggaaacaggtatgagctcacgttgagtggaggacgggtgcttgagagctagaactggccggccttatacaactccagggcatgggggagccactgtacattcttgagcaggcgatgacttcacccaaggacttctcaaaggttagtcctgcaacagaagacagcgtggattggactggaagagtgggagggcaggtggagaaggcattggtctgcaagtgggg

SEQ ID NO: 498944 - DNA, 379 bp, Homo sapiens
tcagcaggaggcagcacctattacatgacgtcggggataggaaggacccacactcaccttccctaggctatactgacgtctgtacataaggttataattgaggtatacccaccctaagtaacatctgattgaaggcatgtacttgcttgagatccactctcagaaacaggtttagagggcaaaagaaacagactactgtgagcttctaggagtaagaaaagggcccacagaagcaaggggaagctgggcctatagcagtccagcatgctatggggccaacagttgccttctaaacaggtaatgggttagcacagtcatccttatatcatgtccgtgagatgctgaattttctctcagctaagtacacagtttctatttt

SEQ ID NO: 498945 - DNA, 201 bp, Homo sapiens
tcatgcatgtagacaacactgatccaacactcatgcacgggcacaccgccatgcgcaaacacatgcccactcatgcatggtgccgcaaactcatcacacaatcctcacacactcatgcacaagcacacacatgcacgggccaacactgactcacccgtatgcacgggaacaaacccatgcacacacacatacgcacactca

SEQ ID NO: 498946 - DNA, 165 bp, Homo sapiens
gcaacacccaccacggaaaagagcagatgattaaccttaaacactacacgaaagtttcactaagctatactaaccccaggattgatcaatttcgtgccagccaccgcggtcacacgattaccccaagtcactcgaagccggcgtaaagagtgtttacgatcaccc

SEQ ID NO: 498947 - DNA, 761 bp, Homo sapiens
agtgctgtacgcctccggattacgggatgctagtgggactgagccctgatggtggagtgaggggagactgagggggtgctggcatccgtccacttgccagacccctgaccccccatgctgcagcaagccctctgcctgggacagcctgaggcaagcccctcctgggagtcgctccctgggctgaagactaaggaagggagaacccagaagcatggcgttcccagggtgcggggaagtgaaaccgggactgagggacgggaggttagccacttcctctacccaccccaaagcccctgagtagctgctccgggagctgtggtgccctctccttctccctttggctcctctcctgctgcacttaacagatgaccccagagacccggctaaggggcatggacttcacctcactggtccctactcttacctcaggtatggcgttgacggtggatgtggaccgggacagcagcccatgagggctatccgatatcacaggggtaaggggataaaccaacacgccgcaatcatgggaggactaaagggtggccgacgcgcgggccaaaagcacaagggaccgctagacactccgggggccttggaggacccataactccgtgggccactcaagcggaggaacacgcgcggacgggcattgcgtgcattgccagagggaccatagagcacaggatccagcagagacccctagccccctgagagctgcatggtggaccaggactcaggctacggtcatccagggcgacaca

SEQ ID NO: 498948 - DNA, 153 bp, Homo sapiens
ggcagaaaatccagccagcccacacagcaatactgcgcaagttagaaacaggttcctcaggccaggcacggtggctcacgcctgaaatcccagcactttgggaggccaaggggagtggatcatctgaggtcaggagttggagactaggtcgac

SEQ ID NO: 498949 - DNA, 288 bp, Homo sapiens
gccgacttggcatccaaacgcgctgggatttacacggcactgatgccatcgcacccggcccgagtgtacatggttcataacattattagccaagaacaccatgtcaatgctgatgcctaccacatcgaataaactcacagtaatcgtcacacatcagcccgtagatgtgtatttcccccgtgtgcatttcgcagatcatcgctgggattggacaacggtgccattaacggcatgtcaagggtatccagtagcgtagtacgtagttaggtggcttgcgattctggacac

SEQ ID NO: 498950 - DNA, 761 bp, Homo sapiens
ctcccgccaccctgcgcgcccgacagatgccgacgcttgccccgtcatgggtcgactgaatggagctggtgtcccgctgcggggagatgctccacatcctgatatcggctgctccgacaggcgctggccgagtgcctggggaccctcatcctcgttgatgtttggctgtggctccgtggcccagtgttgtgcgtcagcctggggcacccacggtgtgtttcctcatcatcgaacctggcctttggctttgctgtcactctgggcatcctcatcgctggaccaggtctctggggcccaccgtgaaccctgccgtgacctttggcatgtgcttcctggactcagtgagcccttgtgatcaaagctgcccatcgtacacctctggcacagacgctgggagccttctatgggtgcatggaaatagataatacgggctggtatcatgatgcaatctggcaacttcgctcagacagaaccagacatttacgatatacgaggccccaaatggtcacagccggggatcttagctacctacccctctggacacttggatatgatcaatggctcctttgaccagttacataggcacagactcccttatcgtgtgtgtgctggccattgttgacccctacaacaatcccagttagaacgaggcctgaaggccttcaaagtgggcaagagaaagaacctgtgtcataggcaactcctatggatatcaaatccggatatgccagacaaacctgacccgggaacttaggacccag

SEQ ID NO: 498951 - DNA, 127 bp, Homo sapiens
gacgttgtagcatgagagacgaccggctcctgctcaaagatctcagagaaggaggaggtgaccacgcgcgagggtgagtggcatcaacggcgcgtgtacgagatcggaggctggccgactgcccgga

SEQ ID NO: 498952 - DNA, 579 bp, Homo sapiens
  misc_feature (14)..(14): n is a, c, g, or t
  misc_feature (17)..(17): n is a, c, g, or t
  misc_feature (23)..(23): n is a, c, g, or t
  misc_feature (35)..(35): n is a, c, g, or t
  misc_feature (153)..(153): n is a, c, g, or t
  misc_feature (185)..(185): n is a, c, g, or t
  misc_feature (527)..(527): n is a, c, g, or t
  misc_feature (541)..(541): n is a, c, g, or t
aaagaaaccccagnagntccagncagaacatctgnactgctggccatattccttcttgtatagcatctgtttgagacaacaaaatcccgaggcagaaggtcaaccgctccttaggttcattctgatgggctcagctattcgcccgaggctggntccccgaggctggtgtgctcgcaagtcgtggnctggcagggttgccagggcttgtctgcaaaggaccaggggggatgggttttcagctttggggggcacacctggtctcatcacagctgctcaccacggcccttggtcatgacaggccagcacgtggggggcctgcaggctggtagatgctcactgaagatggaggttcctagatttgtcatgtggcacaaaatatttttttgcatttttttctgtcattaaaaatcatttaaaagccattctcagttcacagctgtacaaaagcagccagcaggtttctctgggcgccgtactttctaacctcaatgtgagtgaatttacttcgatcttaaaaggcttgtctntagcattcaggttnactttcttagaacatactatttaaagacatgtgggaag

SEQ ID NO: 498953 - DNA, 145 bp, Homo sapiens
gcggccgcctactactactactactgctcgaattcaagcttctaacgatgtacggggacatgaggaaagctgctgccaagaaagactgagcccctcccctgccctctccctgaaataaagaacagcttgacagaaaaaaaaaaaa

SEQ ID NO: 498954 - DNA, 189 bp, Homo sapiens
acttgttgtcagggggcccttctcctcgttgcgctagctccaagccctccaagtccttctggggctccccttcaccctctgccgtttccaggcaccccacactgtcctccatctactttttcatgtcagcacctgggcatggagggtggcgatctgcttctccagtgttgtgcatggactcctcctcct

SEQ ID NO: 498955 - DNA, 975 bp, Homo sapiens
  misc_feature (448)..(448): n is a, c, g, or t
tattccggcctaggagcatgcaaccatgtaggacccatcagcggataccgagactggcgcgccctactgagcctgctgaatgccgatttcgtaatgtagctcgcatactgcacgtgcacgaaccctactgtgggactcacgtactatcaaccgtatcagaagatagctacattttctcatacatttactttggagaaccgttccttacttcccgagattatggctcgtgcggatgtagcatgtaacaatcacatcgtatgttcgaaccagaattcacaacacgactctccatgtgatctcaacagagtctagcactacatcctcgtaccatgtgattatcccgtagaatgggtcagatcacaagcatcaggggcatgctgcggtctggaatccggtatgcatataatatgttgaaatcgcgtaagtcccgtggaaagagttcgtgaantcactctgccccctgttcttagccaagacacatcccatctacctcttcattaggctactaccatccgaggttcattatgagagcgaaacgctggggtttgaccttcgaagctgaatcgtcactaagttggtaggactgggcctgtccgggtagccccactgactgccgaaggcgacagggtcacgtgtataggagtccacttttggcatgcccttttaaaactcattgtggggctcggggtcatttgagttgagttccaacaggtaagtgcaccgaatcgttgggcgtcatccatcgtctttagactcgatgtgcacaatgtcgtagtcgtgacacgggtctaagaaacgtgctgtgtggatttatccatagttttgacaggaacatggacctcttatgggcctgcctttagccttcattgattttgtcaaatgccaattttaaactcaaccccaaagggtcgtaaatatacccgattacgtgccatttggataggacacggcctgcgttcgtaatcttagtcaaca

SEQ ID NO: 498956 - DNA, 186 bp, Homo sapiens
gaggagtgaggtctgcggtattttatggtgacacccatcctgcttatgaacgtgactctccttcccttccctgcacattgagctgcactgcttcatcagagaagtgccctccagttctcctgcctggtggtatgtgcacactgtgacggtgggtgtacgtaaatggtacctgagtataggggtctc

SEQ ID NO: 498957 - DNA, 504 bp, Homo sapiens
agtgcaccggatgctgcacagtcgatgtctagaggcatctctctattcacgggcagctgcggatcatggtgtagaacgtcagagctgtgggtggacaagaagggcacgtggcatgggtgaggaggtgtaggcaggcgccgccgaggacaagaaagagcgttccaggatgagaagggctttcgtgcacccaccaggggagaaaagcagtgagaactaccagatcgtcaagggcatcctggaaaggctgaacaagatgtgcggggttggggagcaaatgaggaagaagcagcaacggctgctgaagaacatggatgcccacaaggtcatgctggacctgctgcagatcccctatgacaagggtgatgccaagatgatggagatcctgcgctacacgcaccagttcctgcagaagttctgtgcagggaaccccggcaaccaggccctgttgcacaaaaaactgcacctcttcctcacgccagggctcctggaggcagagaccatgca

SEQ ID NO: 498958 - DNA, 276 bp, Homo sapiens
aggttattacgtagtcaggcatatgtgttggagatgagactagtagggtaggcccacgctgcttcgagggcggaagactagatggccataggcacaattggtaaagggatgggtgttgagggttatgagagtagctataatgaacagcgatagtaaataccttctaggcatagtagggaggatatgaggtgtgagcgatatactggtattcctagaagtgagatggtaaatgctagtataatatttattgtaaatgccaatcacctgaatgttcag

SEQ ID NO: 498959 - DNA, 167 bp, Homo sapiens
cggatcttatatttgcggctgcctttccttaggcaacgtatggtccccgctcccgggagtcaccatattgatgccgaacttagtgcgataccgatcgggatagcgcactacagccagaaatacctggactcaagcgatcctccagccttagcctcccaagtagctgg

SEQ ID NO: 498960 - DNA, 804 bp, Homo sapiens
  misc_feature (64)..(64): n is a, c, g, or t
  misc_feature (69)..(69): n is a, c, g, or t
  misc_feature (119)..(119): n is a, c, g, or t
  misc_feature (122)..(122): n is a, c, g, or t
  misc_feature (144)..(144): n is a, c, g, or t
  misc_feature (150)..(150): n is a, c, g, or t
  misc_feature (167)..(167): n is a, c, g, or t
  misc_feature (182)..(182): n is a, c, g, or t
  misc_feature (217)..(217): n is a, c, g, or t
  misc_feature (223)..(223): n is a, c, g, or t
  misc_feature (229)..(229): n is a, c, g, or t
  misc_feature (231)..(231): n is a, c, g, or t
  misc_feature (237)..(237): n is a, c, g, or t
  misc_feature (241)..(241): n is a, c, g, or t
  misc_feature (244)..(244): n is a, c, g, or t
  misc_feature (281)..(282): n is a, c, g, or t
  misc_feature (288)..(288): n is a, c, g, or t
  misc_feature (290)..(290): n is a, c, g, or t
  misc_feature (296)..(296): n is a, c, g, or t
  misc_feature (299)..(299): n is a, c, g, or t
  misc_feature (305)..(305): n is a, c, g, or t
  misc_feature (314)..(314): n is a, c, g, or t
  misc_feature (317)..(317): n is a, c, g, or t
  misc_feature (339)..(339): n is a, c, g, or t
  misc_feature (368)..(368): n is a, c, g, or t
  misc_feature (390)..(390): n is a, c, g, or t
  misc_feature (409)..(410): n is a, c, g, or t
  misc_feature (457)..(457): n is a, c, g, or t
  misc_feature (483)..(483): n is a, c, g, or t
  misc_feature (487)..(487): n is a, c, g, or t
  misc_feature (490)..(490): n is a, c, g, or t
  misc_feature (505)..(505): n is a, c, g, or t
  misc_feature (515)..(515): n is a, c, g, or t
  misc_feature (540)..(541): n is a, c, g, or t
  misc_feature (545)..(545): n is a, c, g, or t
  misc_feature (551)..(551): n is a, c, g, or t
  misc_feature (557)..(557): n is a, c, g, or t
  misc_feature (561)..(561): n is a, c, g, or t
  misc_feature (576)..(577): n is a, c, g, or t
  misc_feature (584)..(585): n is a, c, g, or t
  misc_feature (594)..(595): n is a, c, g, or t
  misc_feature (604)..(605): n is a, c, g, or t
  misc_feature (618)..(618): n is a, c, g, or t
  misc_feature (660)..(660): n is a, c, g, or t
  misc_feature (678)..(678): n is a, c, g, or t
  misc_feature (680)..(680): n is a, c, g, or t
  misc_feature (740)..(740): n is a, c, g, or t
  misc_feature (782)..(782): n is a, c, g, or t
catgcccctattcccaagaagagggcatgtgggtcgtaccagctgggcaggcagtgggtctgcntcccnggagagggacccgaaactgggagacttggagattttatcagggctgtggnggncctgcctttcttctcctccagngatagntgactcattatccagcnacacagaggtcagcnccgacctcaccagcagcaggctcacaggagtggcnggggcnttgggngngtgggnggcngcncagggtcagctctttcacgaaaacagagaaacggggnngctctngngtgggngtnggggcncagagaacnggnaggaaaggcggccggcgaggtntgatatcacaccagctcccactgtgggcncccaaacccaagcctcctgggnaagtctgggaactgttaannatccacacctcagcatcaccctgccaaggggtggggtggggtatgtncacatccccatcattccttgattganggcngcnggagagtggagttcntgccaaggcncttgagatcgaccatggatgccgcnnggcngaggcngagganggcncgcctatccagagannggcaggnnaggggtggnnatggggccnngggctctgtggcngtgatacagggacctgggcaggcacagtgtcagtcagaggtncagagacctgaaggtganangggcgggacccttgaggttcagggaaagagcctcttatactttttccattttgcagtganttggagatttgtccacaccagtgcacagagacgtgtcctccnttttatttcttttaacagccgc

SEQ ID NO: 498961 - DNA, 755 bp, Homo sapiens
  misc_feature (64)..(64): n is a, c, g, or t
  misc_feature (69)..(69): n is a, c, g, or t
  misc_feature (119)..(119): n is a, c, g, or t
  misc_feature (122)..(122): n is a, c, g, or t
  misc_feature (144)..(144): n is a, c, g, or t
  misc_feature (150)..(150): n is a, c, g, or t
  misc_feature (167)..(167): n is a, c, g, or t
  misc_feature (182)..(182): n is a, c, g, or t
  misc_feature (217)..(217): n is a, c, g, or t
  misc_feature (223)..(223): n is a, c, g, or t
  misc_feature (229)..(229): n is a, c, g, or t
  misc_feature (231)..(231): n is a, c, g, or t
  misc_feature (237)..(237): n is a, c, g, or t
  misc_feature (241)..(241): n is a, c, g, or t
  misc_feature (244)..(244): n is a, c, g, or t
  misc_feature (281)..(282): n is a, c, g, or t
  misc_feature (288)..(288): n is a, c, g, or t
  misc_feature (290)..(290): n is a, c, g, or t
  misc_feature (296)..(296): n is a, c, g, or t
  misc_feature (299)..(299): n is a, c, g, or t
  misc_feature (305)..(305): n is a, c, g, or t
  misc_feature (314)..(314): n is a, c, g, or t
  misc_feature (317)..(317): n is a, c, g, or t
  misc_feature (339)..(339): n is a, c, g, or t
  misc_feature (368)..(368): n is a, c, g, or t
  misc_feature (390)..(390): n is a, c, g, or t
  misc_feature (409)..(410): n is a, c, g, or t
  misc_feature (457)..(457): n is a, c, g, or t
  misc_feature (483)..(483): n is a, c, g, or t
  misc_feature (487)..(487): n is a, c, g, or t
  misc_feature (490)..(490): n is a, c, g, or t
  misc_feature (505)..(505): n is a, c, g, or t
  misc_feature (515)..(515): n is a, c, g, or t
  misc_feature (540)..(541): n is a, c, g, or t
  misc_feature (545)..(545): n is a, c, g, or t
  misc_feature (551)..(551): n is a, c, g, or t
  misc_feature (557)..(557): n is a, c, g, or t
  misc_feature (561)..(561): n is a, c, g, or t
  misc_feature (576)..(577): n is a, c, g, or t
  misc_feature (584)..(585): n is a, c, g, or t
  misc_feature (594)..(595): n is a, c, g, or t
  misc_feature (604)..(605): n is a, c, g, or t
  misc_feature (618)..(618): n is a, c, g, or t
  misc_feature (660)..(660): n is a, c, g, or t
  misc_feature (681)..(681): n is a, c, g, or t
  misc_feature (752)..(752): n is a, c, g, or t
catgcccctattcccaagaagagggcatgtgggtcgtaccagctgggcaggcagtgggtctgcntcccnggagagggacccgaaactgggagacttggagattttatcagggctgtggnggncctgcctttcttctcctccagngatagntgactcattatccagcnacacagaggtcagcnccgacctcaccagcagcaggctcacaggagtggcnggggcnttgggngngtgggnggcngcncagggtcagctctttcacgaaaacagagaaacggggnngctctngngtgggngtnggggcncagagaacnggnaggaaaggcggccggcgaggtntgatatcacaccagctcccactgtgggcncccaaacccaagcctcctgggnaagtctgggaactgttaannatccacacctcagcatcaccctgccaaggggtggggtggggtatgtncacatccccatcattccttgattganggcngcnggagagtggagttcntgccaaggcncttgagatcgaccatggatgccgcnnggcngaggcngagganggcncgcctatccagagannggcaggnnaggggtggnnatggggccnngggctctgtggcngtgatacagggacctgggcaggcacagtgtcagtcagaggtncagagacacccgggttcactnagcaggcgggttccggggaccttttggcttccaattgcgcaggttgaaaccttgccaccgggtttgagctncac

SEQ ID NO: 498962 - DNA, 245 bp, Homo sapiens
attgatatttcatgttcatcaagttctacctggtgtctttgggagaactgagttcctgatttcatgtgtgcagtgtgccctctcgtcttcctctctgcctagagcttttatgtcctgcttcctcccagagcttatggagttacctccctgcatccttctctaagagcgggggagtggtaccttcttagctggtcttccaccctcctggagttggtttttgggtatgagatagaaacaaaaaaaaa

SEQ ID NO: 498963 - DNA, 965 bp, Homo sapiens
ccctgtccgcatcgcagcagtcgcttgtgccagatcaaacaagaatgagggcttggacttgatcaaccgagagacggtccacgaacgggaggtgcagaccgcaatgcagatgatgcccactcctggagaggatacagtttcagccatgaagtgacatagctgacagtggaagtaaatcctgcctcccccaagcgtcatcgatttcattcctgtgtcaccaggcacctgtcagcccatccgtcgtggggaattgagggagagcagtgtgattacgaccatccgttgcaagagttttggtatagtagcaacggattgcctccaatgccctattccctagtccctatcggacccgatttaccgatcctggagaagctcaggagtccgccatcatattgctgttagatcgaagtgttcttgtgaccattgaatagacgatacatgtgaacatgggaaactgaattatctagccgaaagtagatttttccgagggcatcaacctaactatgctttacttcttgacgttgcatcagctgtcgagatcctggttgtgtgtgtatcttcgtgataacccattggatggagaagctagcacgtcatgtgcccggatcttcttgtaactcaccagtcgaaaagtcagcattaccaccgacttctcctgtgtcacctggccaagcggcttctccatttacttccacgtagatgaagcgttcgtctaagtgattcagctcatcctgagactttcttgttgctagggcgagacgagagaataagctagttggggcaaacactgaaactttgtcgaattcatttgaggcctatttcctatttgagccccttttcttttttgaaattcccttgaaatgatgtattctagagaacttcctatgtcagggttcctttggagttcccttggaattcacgtgtaagtactaatttcacggacggtttccccaataaggtgtgta

SEQ ID NO: 498964 - DNA, 579 bp, Homo sapiens
tggaaaaagtcatggaggccatggggttggcttgaaaccagcttgggggggtccgatcccttcctttttggtctaaatttatgtatacgggttctccgaatgtgtggtagggtggggggcatccatatagtccctccaggttatggagggtcttctactattaggactttccgcttcgaagcgaaggcttctcaaactcagtgaaaatttattaattattactgctgtcagaagaaattgaagtgagcctacagattgataggagtgttccatggtggtgtatgcactcggggatagccgagtaacgtcggggcatcccggataggccgagaaagtgttgtgggaagaacgttagcatttaccgccgatgaattatgatagtgaaacgggattctgggcgtaaggttgggccctagggtgtacgcctgagaataggggacactcacgtgcaagtgaagccccctatgatggcaaatacaggtcctatggaataggcaccctcggtggacgctgacgctcacaaggtattaccgagtcgtggtcgcaaacgacgtgtcctacatgctgagcttgcaccac

SEQ ID NO: 498965 - DNA, 140 bp, Homo sapiens
cggatgctccatccggtgggaggttctacattaaaacatgattactttggccataaaagaaaatattacccttaaaatatctattggatatgtacaaaccacatttttattcggacaggtcacagattcggagcaagtgc

SEQ ID NO: 498966 - DNA, 165 bp, Homo sapiens
ctgctatttgcaaggccaagttggtcagagcgcgagaagctgcggttgcacatcccggcactggaagtggcttgtgcgcctgatgtgcttctcggtactgtcggatcagctcatccgattgcgccgcaaattccgaataacagactcctccacgtacagttgatt

SEQ ID NO: 498967 - DNA, 234 bp, Homo sapiens
tccagtacccgagcatgcttgcctgcctgcgggtcgacgtgtattcagctactgcggtgcatgcctccctgggcgagtaccgtcgagacgtgagcgccgcgctgagcgtccaaatctctgtttcgctggagcctggtcgacgtgtattcaccactgcggtgcatgcctccctgtacaagttctgtcgacacgtgagcaccgtgctgacctccacgtatcgttgagctggagcct

SEQ ID NO: 498968 - DNA, 200 bp, Homo sapiens
cgtgggggtatctagaggatccggctcccacttggtgctgcaatgccatcagtcaatgagtggataaagaaattgtggtatatatacatgatggaatattactcagccatagaaaggaatgaattggtcctgacatattaaagtaaatatataggccaggcatggtggtgcacaccttatagttccagctactcaggagg

SEQ ID NO: 498969 - DNA, 125 bp, Homo sapiens
acctctctatatctacagaaatcctaaaatgtcagtctcacaatcttataggtaaattaccaaagtaaaaatgaagggaggaaaagacgatagagaagataatataaatatctttaagtaccatg

SEQ ID NO: 498970 - DNA, 177 bp, Homo sapiens
agtgcttataacgcactgctcagaactacgggctagttatgcttcaggaaggacataggacaaggtacgagacatatcctagcgcataggtagcagtagccgctactagtaggacgggcatgctgtggctatctagtgcacccgctgagggggatacctactacgagtacgacctag

SEQ ID NO: 498971 - DNA, 136 bp, Homo sapiens
gcttcaacggagattacaaggccagcaacacaaggtgacagagagtgagtgcaatatgtggccccatgtccatcatgtccagcaccttagttcttggggggaccatcagtctttctttttcccccaaaacccaagg

SEQ ID NO: 498972 - DNA, 162 bp, Homo sapiens
ttgatcccaacaacataagcacatgcatcgagggcacctggaaaacaaccagctctggagaaactgctgcctcatactcgggggaatgtgggctttgttgttcaccaaggaggacctcactgagatcaggtacatgttgctggccaataaggtggcagctgc

SEQ ID NO: 498973 - DNA, 561 bp, Homo sapiens
tcggatcctttggagaccaggctgagcgcagcgagctgttggagtgcagagcccaggccagagcctgctggagaggaggcagactgaggcagcaggcccgcagcaggcgaagcagggagatgtcagactggtacacggagctggagaagggagtcattgtcctgggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccctttactctcttctccctccagaccttcctctgacccttgctgaactggggtccctttgtgagtgtctcagtctaagaggtacctcct

SEQ ID NO: 498974 - DNA, 524 bp, Homo sapiens
atggggagtggtggggactgcggctcagacccacggattactgccacccagggactcgggtccagagatgccagatcttctaaaattccaacaggaagtgccagtgtacagatttatatctctacatgtcagcagtggattcacattttggaagaaatggcattaagttaacaaatacgcactgggtctatctagatctgttcatcaggcaggacagctgtggtgggattaataaccgattccaaaggcatcaggttctgatgtctggaacccatgagtctgtcaatttccatggtcaaagggactttacagacgagattaagttagagaccctgagacggagagtgcccttgatcacccaggtgcaccctgaatacaatcaccagtgtcttataagagagaagcgggccggacacagtggctcacgcctgtaatctcagcactgtgggaggccaaggcgggtggatcaccaggtcaggagttcaagaccagcctgaccaacatgatgaaacctcatctctact

SEQ ID NO: 498975 - DNA, 496 bp, Homo sapiens
tccccacgagatttttcaccagttccacctctctgactctaaagcatgctagcattttttccaagtgaaatcctgcatccggacgtagttctgttaacatcagacaacgtactcagaatttactcactacgtgagccgcagacacccactaacgtgataatactttcagaagccgacgagcaaagtctagtactcaataaaggaagcgcgtataccgcatctctagtagagacagcagttgcatttgactttgggccattggcagcagtcccaaagactctattcggacaaaacggcaaagacgaagtagtggcatacccactgtacatcttatacgaaacaggcgagactatcctgacatacatcagtctgctacacagccctgggaatactggaaagctgttgaatccattgccgatgcatcctgcggctgaagataactatggatatgatgcgagtgctagactctgcttaccctgcgtccccaacatcttag

SEQ ID NO: 498976 - DNA, 255 bp, Homo sapiens
ctggccccccttttttccttggctccgggggccttttccagtgccgggagggccacctagttttttttttcttcccctgccccttttaggggagggaggggtggggggggggccagctttttgggaccctggtcctggccctggcccttcccccccgttttgggtaaggccggagcttggaggggggggagggggagggggaagtgtctccctttttgtccctttttttgaaaaaaaagggaaagcctttctgga

SEQ ID NO: 498977 - DNA, 208 bp, Homo sapiens
actctagaggatcttcgtgacggtacccaacagatgataggatgtttcagtgtggtgtatgcattcggggtagtccgagtaaggtcgggggcattcctggataggccgagaaagggtggtgggaagaaaaatgattaaggatactagtataagagatcaggttcgtcctttagtggttgggtatggttatcaattggtttttgaggtt

SEQ ID NO: 498978 - DNA, 435 bp, Homo sapiens
ctgtcctggaagggaaatcatggtatgagatgcacagatcaggggactggaggttactaccccaaagcatgacccaccaggaaatcagaatcagccagtcccacagaatcaggaacaagatcattgcatgagaggcgacatcagacagtacccataagagacaagtccagtaccgaatctgaaccctgagttcgtttgattgtacatcccttcagggatgtgcgtgtgtgtgtgtgtgtgtgtgcgtgtgagtgcgtgcatgcatgtgtgtactatatggaaatatactttgtgtgactcatgtaaacactcaatagtaaatatagatcactttccctcatccatacaaaattagctcatcctgcctcagatgccagaagcattagggtttcactgcagggccaagtaattggggttgctgtaacaagagtgtat

SEQ ID NO: 498979 - DNA, 106 bp, Homo sapiens
ctagtgaggagagctggaagaacccaggaacccactctaggaaaacccattgccagctagactacacacttgagaattagtgataccctatactagtgaacaccta

SEQ ID NO: 498980 - DNA, 610 bp, Homo sapiens
gtacggaagtgttggtggcggcttctttcggcgctgcggtggtttgggttggggcctggctagttgggttgcgcgccggagttccggctccccatgtggtcgtggggcgccgcctcgttgtcgtacgtgctctcctttgcgtacgcctccgctgtcatttaatggttgctctttggctagttcctccgtcacgtgtgtgggtgagtagcaccgttgcgcgtgtgctgtatgctcgcgtgggtcgcctctttgtcgtaggtgtatgtgcttaccgtcgccgttatgtggtagtgcgccctctgattggcgcctgattttaaaagtgtctacgccccacgcgcggacttgctcattcaatctttttgttggtaccaccactagtcaccacccctgggtaatgacgtgacgtcgggtgagggcgcgcctactcgacgactcgcttatacagtggcgaggcgatacgtctttttttgcgacacccccgcatgggtgtcgcctcttactctcgacgtctgttgcccggagtgttctacgtacgtcccaagcccttggggtcctcgaaccttttattataccctatttccctgcccaacaacacatcccaaaaaac

SEQ ID NO: 498981 - DNA, 191 bp, Homo sapiens
gatactgtatgccttaacctaagactcacaacaaaataactaatactaacatctcagacgctacaagaaatagacaccgtctgaactatacgcgtggccgaccatacatcctagatacctacatcgccctacccatccctaacgcatccttatacataaacagacagaggtacaaagactccctaccctta

SEQ ID NO: 498982 - DNA, 396 bp, Homo sapiens
  misc_feature (30)..(30): n is a, c, g, or t
  misc_feature (157)..(157): n is a, c, g, or t
  misc_feature (196)..(196): n is a, c, g, or t
  misc_feature (199)..(199): n is a, c, g, or t
  misc_feature (202)..(202): n is a, c, g, or t
  misc_feature (206)..(207): n is a, c, g, or t
  misc_feature (212)..(213): n is a, c, g, or t
  misc_feature (216)..(216): n is a, c, g, or t
  misc_feature (218)..(218): n is a, c, g, or t
  misc_feature (250)..(250): n is a, c, g, or t
  misc_feature (258)..(258): n is a, c, g, or t
  misc_feature (262)..(262): n is a, c, g, or t
  misc_feature (268)..(268): n is a, c, g, or t
  misc_feature (275)..(275): n is a, c, g, or t
  misc_feature (277)..(277): n is a, c, g, or t
  misc_feature (308)..(309): n is a, c, g, or t
  misc_feature (327)..(327): n is a, c, g, or t
  misc_feature (352)..(353): n is a, c, g, or t
  misc_feature (370)..(370): n is a, c, g, or t
  misc_feature (374)..(374): n is a, c, g, or t
  misc_feature (392)..(392): n is a, c, g, or t
tctttcattttctgtcacccaccctgtccnaccacgttatgttggccatatcaatatgtggcgttagaacatatataaatctatatcatatatttatacacacaaacacattctaccagcactgtgaagacacagactaggctttactaggcttggngcctctcccatgccacttaaaaatgagcacaggtttgcnctntgnaagnntttcnncancnttggtctggccatcagtctgcaatttccccgngataaganaggntgacanaatgggncngcaactttgaagtgaggtcagtccaatttgnntatcatagaagaaaaganataggatgtgctaggttaagcctgnnatggtatctgggaaatntccncttttttgttgtgttctntaag

SEQ ID NO: 498983 - DNA, 167 bp, Homo sapiens
gaagtgttgagtttaagtcaaaggcctttccggcaaactggaaggagctagagctcgggctagagttactggagagtcaagtactaaatctggagaaaacattcgtggcttagaagcgactgtccgtcagaaactgaagtcaaagccatcacctgagtgatggacca

SEQ ID NO: 498984 - DNA, 805 bp, Homo sapiens
tacaaaacacatgtattttgcaaaaaaaaaaaattgaagaccatgagttgaacagtggtttccttaacccagtggcttatttagaattctttggccaaagaattgacaatgatgcaaaaatgggaacagttgggattttaattagaactgtttaggagtgatgatgtgtaaaacgtggacttctctttggcattggcacagagaaattatattccttacttcatggtcagtttatggtcctaaatctttttcactggaattttaaaaatctggttaaatggccattaggcaccaacttaaagagggttggtacaaactttttaaaagtatatcggtaatctggtatctggtggctggtctttggtaagtgattactgtgttatgaccattaggtggttacagttgccaaatttatttttaaatgggtcaaaaagaagagtgctatttaaacattctgtcttaaacaaaaactggtcataacttttctttttccttttcccattaggagaactttctagtgggtaacaatttcaaaatgtgcttgacacctggccttaaatagcacagacctatggtgcccattctttcacactcatttcagctggcagaaaagatttacttttaaaactgaaatcagggactcaatacaaagattatcctgagctctttctaacctcggggggcctattggacattcggtactcctatttttacgaacccgccctcttgtaaaccagaccaggtttcccggggccagacctatgaggaacttgtcccttgatgtcccaccgggcacctggcctta

SEQ ID NO: 498985 - DNA, 126 bp, Homo sapiens
ttccccccccaacagttgctttgggggggttaaattatttttattttgtagagagaatttatatttgtaggggttcggggcccagcccgggtccttatctctgtgtataaactgtacagaccgtga

SEQ ID NO: 498986 - DNA, 394 bp, Homo sapiens
ctgcacctatctgtcagaaacccactgcccacccagagcccctgactctgaatgatggcccagtgctttctgaagacagagatgggacctggtgctgagagacaatccattcctttcacaaagactgtaagccttacccaagcattaattttgatgcataggcgaccagatctcccccaaagcactgaataagaagaaaaggggcccagataacccagcagggcctggcagacaacttatagatccattgccataaaaggtcccaaggaatgtggagacattggtaggggacaggaagggtatggaagagacggattttttcctctaagtctataaaactataactctctgtcttatactctatctctcatagataaaactgtgaatttgtaaa

SEQ ID NO: 498987 - DNA, 138 bp, Homo sapiens
tgggtatctgccccgtggccctgacagcactccaactaggagcacatacctgagactggtggttggcctgggtctcctgcagcaatgggcacggagatgtcctgttacggttcatggagtagtgaggcctgttacaga

SEQ ID NO: 498988 - DNA, 225 bp, Homo sapiens
cactgatgagcggcacagatgatataggctttcgcgtggagacccccaatgccctagccccgtttttaggggacgaacacctacccctattatccccatactagttattatcgccatcatcagtctactccttccacttatagctctggccgcacgcataaccgttaacattagtggaggccacctactagtgcacctaattggacgcgccaccctaacaataac

SEQ ID NO: 498989 - DNA, 371 bp, Homo sapiens
  misc_feature (29)..(29): n is a, c, g, or t
  misc_feature (34)..(34): n is a, c, g, or t
gtagcccatgatattgtagcacaatgcantaccncatgcggtgattgccaagtgtaaatgctgccttacccagtcatataaatgtatagcacaaggggccaggtggggtggcttatgcctgtaatctcagcactttgggaagctgaggggggaagattgcttgagcacaggaatacaagtctagcctggttaatgtagggagggcacgtttctacaaaaactaaataaaattagcctggcatggtggcatgcacctgtagtcccagctactttggaggctgagacggaaggattgcttgagccctggaggttgagctgcagtgagccatgatcatgccactgcactccagtctgggcgacagagcaatccc

SEQ ID NO: 498990 - DNA, 464 bp, Homo sapiens
tcctaagactcctcggactggatggagtaggagatctgtgtgttagagcagtacacatctcatatgcaactttaaggaggcgcaagatgtcaggctcaatgttgatggattgaggaaggtgcggctgtagcgtcggaagggctctccctccggccctatgaggaacttctcaaagttccaggccacatctgagcggcgcacagggctccacatgatgagcttgggatcggtcatgagggaaaatgggtcatcataagggtaggggagcttgtccttcaggtaggctaagacaggatgctcgttctgcccattcacctcacatttttggacaagggtgaaggtgggctggtatccacccccaggacggacatacttgagactgttcaggatctcctcattctgacagttctcctgatgtccaaattggttgcaagggaagccaaggaccaccaggcgcctgggaa

SEQ ID NO: 498991 - DNA, 193 bp, Homo sapiens
gacaagtacttcgtcaactggtcggcgaggcgttcgaccggcgtctgcttctccaccagaccgagcagttgcagcaggccgcgaccgacatccagcaggccctgcaccgtgctcttgaccagggtcttgagggtggcgataaagccttcctggggcggtaccctggacagctcgtcgaggtattgctcggcta

SEQ ID NO: 498992 - DNA, 799 bp, Homo sapiens
agcggattgtcgtctctgaatacaggctgctacacatcatctttccacactcactataatacatgtgaatgctcaacgagtgaatcaatgtctctgacatgatgggttctgcctatcgagctgaacatgagtttccagatgaatcatagaacaggcactgaacataagtacctgactggaagtgtgcacgtgagtcagtgtggtgtaggcaatccaagggcgaccaggcttaggtttcacttatcacggggcacataacttccacgctatagtgcagttgtaggaactacaaatgggtggcgcatgattacacatatttctagtattctctctctaaattgtcctcgtgcaaggtttccgtgtgcttaagacaaatatacccatggagtttctagaatgactccaagggaaaggtagaagacttacagtcacaagaactatcttatcagtcggaccacatcgagataaccatctgtcgagaaatcttccatctctaatttcctacgacctttgattccatacatatgtgtatgcagagaggggggaattccttaatgagagatgggggtatgtggacatctccttacgactcagccagacatatatttgtgtcccgtgatccatgtgcacagagactttggcattctgggtgacggaagaaagaagagaatatacatggaaacccagggaatgagactgagcatggtaaatcagtatttgcttcagtggggatccagaacagcattctgaggaccggatactctcgacatggcatagaaaaggatctaacgtacccctc

SEQ ID NO: 498993 - DNA, 128 bp, Homo sapiens
atgtgtggcgaacgcgcgggctactcaaactcatgctagtaggtatcttgcttgcaatcgtcaaccagacgacaggcgttaataccgtgatgtattacgcgccgaaagtactggagtatgccggtatg

SEQ ID NO: 498994 - DNA, 540 bp, Homo sapiens
tattaggtacgtccaagtgcacttcccagtaacactataccagtgtccacaggactgtgtctcctctatataaatgcgtaggggttttagttaaatgtccttggaagtatactgtgaggagggtagacgggcggggagtgtacgcgcttcagggccctgtgttcaactaagcactctactcatcagttaacggctaaatccaccttcgacccttaagtttacataggggctattcgatagtttccgtggggatagaaaagtgtagcccatttcttgtgaccacctcagtgggctacacctttgacctaacgctctttacgagtgggatactgtgcgctatacttgggtacgcctacacatcagggcttggcgtgaacaaatggcggtatataggctgagcaacgacgcggggtcgcggttagcaccggggtcaactcagataacagcaacagggcccctcctagacgggatatggaacgcaccgcacacggacccctataagcactaacacacaacccttgtggcgccccgccacccttg

SEQ ID NO: 498995 - DNA, 414 bp, Homo sapiens
aggcagtggtggcaggctcgatgggtagagcaggggtgtccatgactcttctccctctagaactggggtctgaagcggtgtgtaccgtgggcatagtgaaggaaccaggacagggctgtggacagaaggtggtctcagtcatggtttcactctcagaaatatcctgaggctatggtttaaggcttcgtggagcatgaagtggaccttgtggttctttacaaggctgggccatagtaaagcattgcgaatcatggagtgaagaggatccttggagatgagctgtttcagttcactcctctgatccagcataggaatacataatggcccagagaggagacatgtgcagtgcctggtcagacgtgggacctgaacccagcccggtgtctgactccctgtcccccagtcccaccgctg

SEQ ID NO: 498996 - DNA, 153 bp, Homo sapiens
gaccgacacagagggacacggaaatcatgcagacagaagagaaacaggaaaaagagaagaagagaggaaccaagataagctaagtggctatacgtgtccaaacctcttggccatcgcctgtgtgactaggagacagtacccaacacgactacg

SEQ ID NO: 498997 - DNA, 273 bp, Homo sapiens
  misc_feature (264)..(265): n is a, c, g, or t
ggacaacctaattatagtgtagctggtgatcgtacggcatggcaccgagagtatcagaggcaaggaaaagatctaggaaaaagtaaagcagcgataaataagagataagctaatcacgtagacaagtattacagaccactagaacatacggatacgtataaggtaggacgtaggaagtagtaggaatagacataggacaaatagctacggtaaagtacaggacccattgcaccaagcctaccatagaatttactaggactaggnnaggaagat

SEQ ID NO: 498998 - DNA, 522 bp, Homo sapiens
ggatcagtttgacttggaggtcgactttgatatctcgaatgtggatcaggccaaaattcaggaactgcacgagcgcttggaacatgtcatgcttcgacggctgaagcgcgacgtggccaaagagcttcccaccaaaaccgagcagattcttcgcgtggaaatgtccgcgatgcagcagcgcatgtacaaggccatcctaactcgcaactattcccgtgctaagtggcacccattcgacgcagttctcgctgctcaacattgctatcgagttgaaaaaggcgtcgaaccatccgtacctcttcgatggtgtcgaaacgcccagggcgtcgcgtgaggaaacgctccatggcctgattatgcacggcggtaagatggtgctgctggacaaactgctggcgcgcctcagggcagacggacaccgtgtgctcatcttcagtcagatggtgcacatgcttgaccatcatttccgactacctatcgcttcgcggctatgtgcaccagcgtctggatggcaccgtgtcg

SEQ ID NO: 498999 - DNA, 934 bp, Homo sapiens
gtgccaactctcgcaactactgtatctatccgcacgctccgccgtcgctgtttctctgccggtcgcaatggaagaagagatcgccgcgctggtcatatgacaatgtgcatcctggcatatgtgcaaagcataggtttatagctaggcggcacgacgctccaccgaagccagtgatttcctatccatctgtcgagtgcgcccgcagaacaccagtggacgatcataggtgggcaatgtaggccagaaggacatcctacgctgggcgacagaggaccgagagcaatgcgtggacatacactgaccctgcaagtaccccatctgagcatggcatcgtacacctacttgggacgaccatggagcagatctggcaccacaacctatctacaaccgagactgcgcgtgtgccctggaggagcaaccagtgctgactgaccggaggcaccacctgaacacccaaggccaaacagagagaagatgactcaagattctgttagagaccttcaacagccctggacatgtacgtggacatcccaggccgtgctagtaccctactaatgcctctgggactgcaccaattggacatatgtacatggacctctcggagtaacgtggagctcaacacgacaacgggatgacccaatcataacggaatgagactacgaccgcatcaacccgcaaggcgcatccctgcacggatactgagaaacactggacatgtgaccggagaaaccttgaaccgtaactaagcgctcagtggccaagccctccctacaacgttgcaggcccgacgggcgtaacagtgcgctacaacccatcaagaggcgccggacagcaggggaacgaagccagctgactcccgaccctcaccagggtcgcacagccttgtgtcctcagcggttagcaccgcctggagacgattagccacacatcggag

SEQ ID NO: 499000 - DNA, 649 bp, Homo sapiens
gctgcctgaagccctttggaggcccccctgggactgagctcactacgcgtgtgagcctttccacagcactgagctagaggacgacgccatctattcagtgcacgtacctgctggcctttacctggatccggaaagcgggtgtcttgcctcagatgtgcccttcactccctcctcccctgatgctgtcactgctcccagtgagggaatgcctgtccacactgagcaagctttcccgccactggaagtgggagccgacagtgactatgagaacacgcaaagtgtgggacccactgctgtgggcttggacacgtggaagaggtttctagagctgggcaaagaggaagacttccgacccagagctgggaaaggccctggcatgggaggacctagatcctgggctatacccacgaaacagagagatgtcatcttgaaagaacatgagcaaggtcacaccaacgaaaatttcaggaaactgtttgcgggcaagccaggagttcaagagatgacaacttcgctgcctgctcaagagactcgatccccatttggcttgtgacctgagatgggctccctcttcccaaaggaggcagccctgcgaagccagtgctggaggtcatttggtgaggtgtcaaacgcaagatgcctaaccggt

SEQ ID NO: 499001 - DNA, 922 bp, Homo sapiens
ctcagtagcagacaggggatttcacccatgattcagccaggcatgtcccacgtattatttcttcacaatgacacatcatagtacttataacccagcaaatgacagtcttcacttctgcgcagtccagcaacacacaatattcagtcataacagctcatcattctctgcatatatatattacacaattcgcatcaccaagttcagcatcaccgttccagaattcacctcacagttcacacgtctattctgccacaaatgcctactctccactgaccctatatatatcgtacaagctctactgcagttttacttagcttgctacagcctactacgatctcgctgtagtaggtatctctactacctctgacgcctgttttcgggaccactggaggacaatacgactaccacgactttaccactttaacgagagtgttgtacacacacagcacttccaccttcgtccacttgtcagggcaccaccgcagtggacaactacacggttcattgttcacaggccgcagaatttacccaagcagagcgcccgatgtattcaccccacagtcacccacagtaccactatcacgaacaacgctgacgcgacacacgccccctcccaactccctgaacagccatacggcgaacaaatttccaggtacacagggggcacaacacaaatttttccccttaccgaccaagctccgttggggacttacacaacatcgggcggacaattccttaagctgggcaaaccgcacaacacacccatttgcgggtatcaagaccaattcctcatttcaccctcttaccacattgtggttagcaacagcgggcaaccttggggacttattacttcttgcccccaccacgccttgagacaggccattccacagaagacagacgaccaacgtgcacatctcatcag

SEQ ID NO: 499002 - DNA, 207 bp, Homo sapiens
gtatctagcaaggttcataatttttgctccatcaacatgcgtgatctcccagcatataccatccactgaggcaatgtcaggaaaaagccaaacaagaatacattatatgatgttaccaacaatatttgacccaagatggtattctacctaaaagatctgtaaagtgtggatgggattactgaaaacttccaaggaggatcaagacag

SEQ ID NO: 499003 - DNA, 391 bp, Homo sapiens
caaaggattttaaaggtcctgtggccaaatttaaagtgacctaagatcattctggacaacaagcattcccaagcctcgtaagtttgtcgcttcaaccaataatcctcccactatttgcctcaatagccggtggccctttaaccggttctaagaaacctcgccggggtccggggttttaagcttggcctctccttgcaaagtaattccaagtaaatccataatccagaaggtataggggtaagtcctggcaatataagcctgggtaataattttcatcctttcccttccggtcctatatctatggcgccaggtttcaatttcatcggcctatactttatttgggtaaatggtttggctaaggttgtctggtagtaaggtggagtggtttggg

SEQ ID NO: 499004 - DNA, 364 bp, Homo sapiens
ttcgatgtgggactcagagcaagactcgtctcagaaaaaaaaaaaggaatttgggcggggtgcggggggttcatgcttgtattgtcggcattttgaaaggccagggaggaagatcacttaaggtcaggagtcggaggttgaggaagaaaattcctttaaacttggaaggtgaagtttgtggtgagttgaaatcgcgccatggccttcaagctggggcaggcaggaaaggaattccggtctcaaccaccaacaacaacaaaaagacttgggcctcttgatgaattagggcccacttgtttcaaatccccacatatgggtgtggcgccagtctctaaagatgccgagcttcagtcccctctttctc

SEQ ID NO: 499005 - DNA, 128 bp, Homo sapiens
ctgacgctcaccaatcaactgtacttccccatctagttttggttgctctagttgcttccagacagctctgcctcttctcttaatctaatcagtatatagacttctactaatacttattgaacagaggt

SEQ ID NO: 499006 - DNA, 358 bp, Homo sapiens
gcagggaagagcaacaaagggcacaggtaatgtggttcgctagcctcgaggagtttggattaaaaaaagattacctgggccgggcaaggtggctcacacctataatcccagcactttgggaggccaaggcgggcagatcacgaggtcaggggatcgagaccatcctggctaacgtggtgaaacgccgtctctactaaaaaagtacaaaaattagccaggcatggtggcggacgcctgtagtcccagctactcgggaggctgaggcaggagaatggtgtgaacccaggaggcggagcttacagtgagctgagatcctgtcactgcactccagcctgggtgacaaagcgagactccgtct

SEQ ID NO: 499007 - DNA, 541 bp, Homo sapiens
accatcctgggttgccaggaatcccgtgcactgggatgcttggtcagccagtcatgagcagaaggatgcctgggtgcgggactatacatcttaccggtagtcctgggccgtgtgtggtgccgtgggcttttgtgccgtacgcggtgacgcataatgcgtgatctgctgtttgatggaccaagaggccgaatggcccgtagctgactgctggttgcatgatacttgtggtgcaagcttgattgccgagtggtcttgctccagatgacttatgatgagcatcacggtggccgcaataagtggtacgacatgttccaatagcacgatgttcagaagacgatcctaaaggacaagtcctggcgacggccaattgtacgaatacgcggagcactgcgtgtggcaatcgggtgtgtggggcggaactgagcccgaggtgggggggcctatccatctctatgtgttgtggattggcgccagtcgtcggtcggtctttcgcttccggtggtgttcccgtttggtccccgaggaattgtgagcccggggg

SEQ ID NO: 499008 - DNA, 249 bp, Homo sapiens
tcgcccaacaccatgcgatatcagcaccaaatgtaagaagtaaagaaagagaaaagaaacatgaaaagtggctcaacagtcaaagacaagtttattttggagaataaacctgagaggggcttctggacaattttttttttttttttgggtataggagtgcttgctcctatggactatgagttttaatgggtttaagggtgagagagttaatcacaggcttggaatgtgtcggtgtgggggataaatgtt

SEQ ID NO: 499009 - DNA, 663 bp, Homo sapiens
ggggacagttttttttcttcatcgagcgcggtagagacagcgcctacgcacgtgaaaccctcccggccactaaacgactctcttcctacttgcggaaaaataattaaacattggcgaaggagatcctcacacactaactggctaaatgtcttcccataccttttttgtcctaactaagcaggtgggagcatacaaaaaaacccccacatgcttctgtcaacttatcatagataaggaagaagcccttagaaaagtggatgaccatgtatgctatctacatacgacactcggaatacctagcaaaagctgccttggccagttatgatagaaatacgactccctatatacatcccaaaggggacacgttaaagaagtttaaggattccaatgcacccaacatgcctgcttcgacctttttgctcttatgatctgagtatagcccaaaaatttaaggagaacaccctgtcctggccataagataatgctgaaaaaagctcagagaaatgcccaatacacttctgcagatgacacgcatccttataaaagaaggttaacatctgattgataaaaccaagtggtattgctggtaaaccgcttaaggaacccctgggccgaaaaaaggcagtctccaggctcacaaaaaaagattggaatgtaaagcgg

SEQ ID NO: 499010 - DNA, 804 bp, Homo sapiens
cgtggtggctctcgcctgtaatcccagcactttgggaggctgaggcgggcagatcacaaggtcaagagttggagaccagcctaatcaacatggcgaaaccccgtctctactaaaaatacaaaaattagccgggtgtggtggcacgtgcctgtaatcccagctactcaagaggctgaggcaggagaatcgcttgaacccggtaggcagaggttgcagtgagctgagatcgcaccactgcactccagcctgggtgacagagggagactccatctcaaaaaacaaaagaaaagtggcaagtcacactgacagtatgtatggatgaaaattgtacttatatctctgtggtactttctctccgaaacgacattaccccaatataataacgagaaaacacatgagcacaaatctcaactgacattctacaaaacacctgagcagtaaccctcaaaactttcacgagcatcaaaaaacaaggaatgtctgagaactcatcacaatcaagaggtgcctaaaggagacaggactactcaatgtaatgtggtatcctggatgggatcctggaccagacacaacgcatatcagaggacacaatgacgaaatgccattcaaagtatagcctttagtacactaaagctatcaatatacagatgaaggaattcataacgaaaggttgacaatagtaatctacagcagtttagtaataaatggaagtggaaaaataagagaactacataaggggagaaaatcatgcgaattataaggataaaaaaaaaggtaataaagaagagcaaaaaggggtaaaaa

SEQ ID NO: 499011 - DNA, 116 bp, Homo sapiens
tactggcttatgcatggctagtctccatctaaaaaaaataaaaagaaacggaaatcaaattcctttaagttcaactagtttaaatttttactgtattgcagccatttgcactccgg

SEQ ID NO: 499012 - DNA, 695 bp, Homo sapiens
agatttattaatggtcggttggacagacagggttaacatagcataccaagatgaattaccatattgggctgatagcacatcattctacattataacccagtggcttctgctagcacattggaaaggcaagtagttccggatgctaggcatcatctcaaaagaggcaagctacttctttctttggtcctaagaaccgactcctctacttactgcgagactttgagctagtcaccgcgagacttgaggacaatatggtgggtgggggcgggggtagccttccacacatgatcaacgagaactgtctctctactagagcagatgcctaggaaaaaagcaatgtgacgctctttcgacgaacaggttacttgtccaagcccacgaaaggtgctctgggcgccaactcccggttcaactaagaggctcttctcgtttgcgaaataaccccaaaatctcgtagatttgggggctcttctcatgaaaccctacattatttagcaaactccgacggttgcgctcaaaagttttcaatgggcagggttggaagaatacgccaaactttacctttggcggtaacaaccagaggtttaaattcgaaaagttattataagcgaacttcccagtgaactgccccttaaacttatagagccttggatccaaaaataaaaagatttcttgtatggggggtctcaagtatc

SEQ ID NO: 499013 - DNA, 108 bp, Homo sapiens
ggcaccacccgctggagcctccaggtcagtgtccggggtcccccggtgtgctggtgctgatacctcatacccgtggagtctgacgaacctgaacaacaagctgtacat

SEQ ID NO: 499014 - DNA, 191 bp, Homo sapiens
cacgagggggaacgacgcggcacgaagtgataagtgtaaatggattgctattcacatgacccggataaccccacgaaatcacgcaaatcaaaaggttcgaaacttcgggttcactttaataacactcgtgaaagtgctcatgacaacaatggtatgcatatacgaacagtcacaaggtacctgaaagatgt

SEQ ID NO: 499015 - DNA, 548 bp, Homo sapiens
ggagagcgcctgcccaaggtggggcttgtattttgctgtctgagtgacccctgggatgcatgacgggcttctcaactgtgactagcgggcagcgccttctgctgagcgagtcatggaccgcatgcataactaactgtgcctgcagccttcactcttacgatgctgccccggtgggcccactgggccacgatgtggcttgacgcactgctgaccactcatggtctgttcaagccttgagggccaagctctttcaagaacctgaccctgcaatgcttcgcgggtgtgagcaccacctgtcacgtaaagcctgagcaccagatgctgatctataaagatgacgtgctgctttacaacatatactacatgaagagcacagagagctatcttattcctgaagtactcatctatgactcaaggacatataaatgtactgcgattgtgaacaacacagagaagaccactgcacatgaccagcttgtggcgtgaggaaagcccagagacactggtgtcacttgacaagaagaaggccttcggtgccacgtgagggt

SEQ ID NO: 499016 - DNA, 84 bp, Homo sapiens
tggaaagtgttctttggtttaactctaaacgcccatgatagtagtttcaaatgggaaatagcgaaataaaataactcagtctgc

SEQ ID NO: 499017 - DNA, 1724 bp, Homo sapiens
  misc_feature (269)..(269): n is a, c, g, or t
  misc_feature (375)..(375): n is a, c, g, or t
  misc_feature (417)..(417): n is a, c, g, or t
  misc_feature (447)..(447): n is a, c, g, or t
  misc_feature (469)..(469): n is a, c, g, or t
  misc_feature (476)..(476): n is a, c, g, or t
  misc_feature (488)..(488): n is a, c, g, or t
  misc_feature (510)..(510): n is a, c, g, or t
  misc_feature (745)..(745): n is a, c, g, or t
gtgctaagtgggccgggcatggtgtagacactggtactgggctgctgggctgacatgcctccatcgtacgtacgtaggtagtaaacatgcgtcatgcagctggcctctgcaaggtcgagcgtcaatcacctgtgtgggcgaagtggacgcaggttcctggtagtcgcggcgaggctgcctgttactcagccatatcactttcgcatgagagtaatcacgcacatctatgcgggtcattcgacgtagcatcccaagctgtcgagacgccntatcatgcaaagagtgtactggtggaccagttcgcgtccagaagcaccttgataatggccaaccactgcgtgcggtgtcgtgcgagtgtcgagtcagcgatagatnattcgcatgggcagaattcgtcagttaccagagttagtgacncagacagagaggacgcctctcactcagtgncactctgtgtcgtctccagagncaactcnatgtgacaagcnagtcaaagacataccatacagncatcaacgcgcggagaatgcctgcaaagcataacctctgggtgttgagcatcgcgctgtgcatcctgagtctggtgagccatccatggtgcttcccagcttttcccccagtgcggacgcaaaggctgtccaaatttgaccttgaacgccatagcggagataacgtcatggacagagtctcggagcccactggtctcccactcggtttccacacacgggtaatcactgcttatccntatacactggcgccactgcgaaggttatagatcgccgttctatccaactctatgtgcctggtcgagaagaagggctcaagatatggaacgtacataaggccaacattcacgaagctcgcctcggggcaaaacattcgcgacccaacgacctgggaacttgtcctgaaatgcttccaaagggaaacaacttggaatagagtcctaggccctgtcggaaccacagcaggaactaggtggctcgagaataagccctttgagtactgttggaattagtactaggtcatctctgcggattggggtccgggaactggttcgcacttggcaaaggagacatgtggttcagcacctatatggtcacttaagtagacgtttaaaccgtttggcaaccacacccttatgggaatccttggcaacgggttagagtctcaagggggtgcagctggggagttctccgcgcgaaacaaatctggtcctaagagaacaaagagtcgcggtcttggaggcacaattccccggagccttcgggtagtggccgtacaaatgaatgtgacgaaagggcacacgcccataccatgtgcggagactaggaagaaagccccatccatgtggaacgcctttcaaaggcagcagtctttcgggagcaaagacacacggggcaagaggtacccgaccctgaaaagggcgcgcgaccgccacggcggatacgaaggacaacgccatgtgaacagaatcgagctacccgaggaggagaacagcaacacataggcaacccgagcattagatacactgagaagacagcaacgaccaccggagacaaacaggatctcgaaaacaagacccagcagaacacagtgagccagaacacaaggacgggacccaacagaaaaacgacacacgcaccgacagcgaggacaacacgtgcaaactactgtacaacgaccagcccttacgcacaaaacgcagccagcgacttcacacc

SEQ ID NO: 499018 - DNA, 740 bp, Homo sapiens
caccacgagcgattgtggccataccaggatgtctgagtgtggccctctcctctgaccaccggcagaatttctctggatctcgagatttaccctccagctatgggatacgctgggtgtgtgccaataccctgtcccggatgagagcccctccgagtgggttcttgtgtccgcttttcgccccaccgccgccaccctatcgatcggtctcctgtggctggggcaagctggtcaaaggtatggaacctggctaaactgccagctggagacccaccacccttggccaccacccggctaatctgacaccggtgagctgtctctccacgatggagtccctctgtgcttctggaggccaggagtggcccggccctgttaatgggagtctccacgaaggcacaacaccctttacacgctatgatggtggggacaatcactccacgccctgtgcttcagccctataccgctactggctgtgtgctgccaccacggccccacgcaatccagagtctgggagtttatgagggaaagatcacttgtagatgaactgaagccagaagttaatcacgtaaccacagcagccaaggcagaaccccccccgtgcacctccctggcctggtttgctgatggcccagactttgtttgctgggtacacggacaacctggtgcgagtgtggcaggtgacccttggcacacgctagaagtttatggcagagcttttaccaaattaccaaaaaaactggcca

SEQ ID NO: 499019 - DNA, 552 bp, Homo sapiens
agcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaaggcaagtcactgtttaccggaaaccactgattccagccaaactgcctgaagagcaactagctgtcatatcttatcaaaatctcatcaaatgagagattgataagccaaagtatatatagtacattcgcagcctacccattctctgctttggcttcagtctcatactggtcaacttcacacataaaggtgttgctgatgtgttttttcttcagtactgtattcttttccccttgtggcttttctcagccaagtgttgcttatgtgtataagactgaggtgttaagtttgctctagttgaccttttaccacagctacttcatatatttgaaaaaaaaa

SEQ ID NO: 499020 - DNA, 134 bp, Homo sapiens
  misc_feature (28)..(28): n is a, c, g, or t
  misc_feature (67)..(67): n is a, c, g, or t
ttgaaatacgtcttttaaaggtgctggngatcgaaactgtggctttggttccgctggcggtcgtgtngccacgggtgccatcaccaatgcccgcgtcgatgggttgcgctggttgtggtccttcctgctgtgct

SEQ ID NO: 499021 - DNA, 1240 bp, Homo sapiens
  misc_feature (20)..(20): n is a, c, g, or t
  misc_feature (37)..(37): n is a, c, g, or t
  misc_feature (41)..(41): n is a, c, g, or t
  misc_feature (48)..(48): n is a, c, g, or t
  misc_feature (54)..(54): n is a, c, g, or t
  misc_feature (58)..(58): n is a, c, g, or t
  misc_feature (1240)..(1240): n is a, c, g, or t
tcgtgttccttgtctaaaanagaatgatgagtataantttnagtaaanaaattnattncagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaacaactttgcctttacccaaccttccaccactgcattacttggatcaacataatcagaactgcctttatacagaattaattcggacagagattcacgatcttcaccatgaggacacttatctctttcagtggtcctcccaagacattcatcttaacaaactgacacggaccgcatttgattacaatcttgcacgaggtcttcagttatctatatttggaacaccactgtaacaatagtacaaaaaccaacatagtaggttcctagtactgacaggagccccctctagctcatactctaacactctgaactctgctactcatactacttactacgtacccttaaagcgctccaccaaacatcgccctcccttattcactggtccaatgttgccctcctcaacccaactgcacttggccattgcacaaccttgctctacaaccgtcacacgccaccactcgcccacacgcgtcacggacacacgctccatcaaaatgcgaagcgggccacactgcgaggagagacacataaacagcgcacacaggaaaacacttgaactctgcgcacagcgacaccgacgtcacgaaaagcacggcgaacaatagctacgagcggccgaggccgagcaatgagacacagcatacgaacgagctgctagtaactctgacagacaaagccgcacaaggaagaccagtacgcgcagtcttctcgtgctccatctgtgtn

SEQ ID NO: 499022 - DNA, 1162 bp, Homo sapiens
  misc_feature (317)..(317): n is a, c, g, or t
  misc_feature (355)..(355): n is a, c, g, or t
  misc_feature (481)..(481): n is a, c, g, or t
agcggggaggaggagtaggtgcgggtgaagattgcggacagccgagggcgagatctgcatcatggaggtgtcctggtggccaggcggaaagcagtgagcaatcccatacgctgaggagacagtgacatctcagacagatttacttactttgcacctcctcatcgccacacttggcgtccatcctacgaggcatgcattgcttgcacatggcatccgatggctgcgctacccttccaacttacactgcaagcgtccattgctttcaatagactcaggccacaccatcgtatcacaggtactaacgggtgcgtcgcgtnggcacggctcagtgcatacgggtggcaaacttctggcnatcgccttcgtgactaatcgtctcgtcggtgcaccaaaagagcgcgtgaggcgcgctgactagaggggtctagtccgggtggatcacgcagctgcttcccagtttcatcctcagtgagttgatgcnggctgcaatgcatcggatcataggagcccaagcaacagttagtacgcaacagtgagtggaaccagtcaatctacggcggaccgggtgcgaggacggtcgtgagctcaccgaccgttgtgggaaagggtgggacagtctagtcattctacgacgagttcggatggtgcttacgtgtctctcttcatacgaggtccgattgctccatgactctgtgtctcgtatgtccctgggtatcccgtggactgagcggcaccgaatggcactcagtcttctccagaaacgcggccactgctgtagtgtgaccggtcatctgatgacccggccagtctacgaagactacatagtatccactggttgggagaacgtgtagtggtttcgaatatgtctggctgtcaaagcatgttgggccatgtaaagggatgccactgaggtggattgtacggatggacccccaaaagaagttgggtcaccccaagtcctgggctcgattaggcggagggtgggaacgttctagtactcgtcaagggtggagagaccgtgactctttcaacctccccggtgctgtcgtgcaatgtgaatgcgagaaatggactactttgaacgacccttggtgggctatatccaacatcgaggttcaaaagcctgcccaagagggaggcgcctctcagcagccctgatccc

SEQ ID NO: 499023 - DNA, 101 bp, Homo sapiens
  misc_feature (73)..(73): n is a, c, g, or t
gaaaagtagctggtcctcttaaggctttggcacttttatagtatttgaaattggtggtttgtttgtttatttntttatcttatacattttctcgctctgtt

SEQ ID NO: 499024 - DNA, 1277 bp, Homo sapiens
  misc_feature (1277)..(1277): n is a, c, g, or t
agcgatctcaaaatagaactacagaaagccaaacaaacggatccatatcaggaagacaatctgaagagcagagatctccaaaaactaagcatttcaagtgataatatgcagcatgcatactgggaactgaagagagaaatgtctaatttacatctggtgactcaagtacaagctgaactactaagaaaactgaaaacctcaactgcaatcaagaaagcctgtgcccctgtaggatgcagtgaagaccttggaagagacagcacaaaactgcacttgatgaattttactgcaacatacacaagacatccccctctcttaccaaatggcaaagctctttgtcataccacatcttcccctttaccaggagatgtaaaggttttatcagagaaagcaatcctccaatcatggacagacaatgagagatccattcctaatgatggtacatgctttcaggaacacagttcttatggcagaaattctctggaagacaattcctgggtatttccaagtcctcctaaatcaagtgagacagcatttggggaaactaaaactaacaactttgcctttacccaaccttccaccactgcattacttggatcaacataatcagaactgcctttatacagaattaattcggacagagattcacgatcttcaccatgaggacacttatctctttcagtggtcctcccaagacattcatcttaacaaactgacacggaccgcatttgattacaatcttgcacgaggtcttcagttatctatatttggaacaccactgtaacaatagtacaaaaaccaacatagtaggttcctagtactgacaggagccccctctagctcatactctaacactctgaactctgctactcatactacttactacgtacccttaaagcgctccaccaaacatcgccctcccttattcactggtccaatgttgccctcctcaacccaactgcacttggccattgcacaaccttgctctacaaccgtcacacgccaccactcgcccacacgcgtcacggacacacgctccatcaaaatgcgaagcgggccacactgcgaggagagacacataaacagcgcacacaggaaaacacttgaactctgcgcacagcgacaccgacgtcacgaaaagcacggcgaacaatagctacgagcggccgaggccgagcaatgagacacagcatacgaacgagctgctagtaactctgacagacaaagccgcacaaggaagaccagtacgcgcagtcttctcgtgctccatctgtgtn

SEQ ID NO: 499025 - DNA, 852 bp, Homo sapiens
  misc_feature (135)..(135): n is a, c, g, or t
  misc_feature (338)..(338): n is a, c, g, or t
agcggaggaggtgaggctccggcgcacacccaaagcgggctgcgcccgctccttccagggccccggagcatggctgcctccaccgggatgacgctaggccagtcctggtgcgtataccagagtgcggacctcggngcgcgcagggggaccgagcatgggtcgcccccgatcgggtttggcatttcgtgaatgacatctggtgcgtgtagcttctcatggatgtggattctatttcgttgaggactcaagacattggaacgaagaatgtcggatcctcgagtgcatgcagctgtcataagccttctttcgcaggcgtgccctatgccgtcctctcgggnatggcttggccggacgatcgtccttccatgggtgccaagcgacatagcgctgttcgcaggtcttcctctctagtcccttacactcgttggtggttgccacggtgttgtgcgcctgtcttgtgcgccacctcgtagggctctgttccgaccgtccttgtctacgatcctcttgtgacctgtctggtctgcaagctcagtaggctagtcatgatacccgcaaagtgaggctcaacggagttctctgcaagtcaagaagctgtgtcaacgaggagtgaaggctagcgcctccgactaatgttcccgaggagcattacccgtcttgaccgaaatgtgctcaattgcgccatttgtcctggcatgtgccaactcctcctgtgcccatgagctggtgagtcagccatcatccacatgtggacatggcagcctggacttccacgtacgctcctgcaggtagatgtcgccagttccaaccgtgctgcttcacgcaatgtggccccctagtgcagaggggcat

SEQ ID NO: 499026 - DNA, 699 bp, Homo sapiens
cgcagtggctcacgcctgtaatcccaacactttgggaggccgaggtgggtggatcacctgaggtcaggagctcgagaccagcctggccaacatggtgaagccccatctctatcaaaaatacaaaaatttagctgggcgtggtggtgggcacctgtaatcccaggtatttgggaggctgaggcaggagaatcccttgaacccaggaggcaaaggttgcagttagctgagatcgcaccactgcactccagcctgggcaacaagagcgaaactccgtctcaaaaaaaaaaaaaccctattgtaaaccattggaccttggggtggtaacagatgtctgaattgtaggctccatcaatttttaacaaatgtgttaccactttccgggggggatataatatactctggataataattataccttgagaaaatcctttcatttccggataattctaacaaattcaccaattctgaacttacttttcaaatacaagggccttagggtccatcagagatcctcttttaagcgaactatctaagtgcccaaatggattcacttacacagtgaactttcaaaagtacttaaagggtcaagtccacaaatctggatgctctagagaaacgttataacgcagttcacacgggggaccattactaggacagaacacaaggtaccgggaaatgccattaaggtaccaagagaac

SEQ ID NO: 499027 - DNA, 208 bp, Homo sapiens
  misc_feature (11)..(11): n is a, c, g, or t
  misc_feature (70)..(70): n is a, c, g, or t
  misc_feature (109)..(109): n is a, c, g, or t
  misc_feature (198)..(198): n is a, c, g, or t
  misc_feature (208)..(208): n is a, c, g, or t
ggaggggaggnggaacggagggagggatggaaaggaagggagggagggagggagagggagggcgggaatnagggaaaggtgggaaggaagggaggcagggaaaggaagngagggagggagggagggaggctggctatgacctaatattgacacagtaacacaagaggacagattttgagagataggacaaaaggacanaaataagcan

SEQ ID NO: 499028 - DNA, 134 bp, Homo sapiens
aggatacctcagataaagcatctctaatctcctcccgtactgctttgacccagttcattcaaaagcatggagcatagttttcagtatgtccctgcagttcgcatcagtttccaacccgttcgcccaccagttcg

SEQ ID NO: 499029 - DNA, 145 bp, Homo sapiens
agaggggtcccccaagataccatttaggaacaagggcaagcttgaggaaaaaagccagtaaagacatgagctccatcagctgatgacccacggtatacatgtgcccacattgctagggtaccgaggagctgagggtcaacaggcg

SEQ ID NO: 499030 - DNA, 106 bp, Homo sapiens
tgatctagaggatctcgtataagagatcgggttcgtcctttagtgttgtgtatggttatcatctgttttgaggttagtttgattagtcattgttagcgcgtgctgt

SEQ ID NO: 499031 - DNA, 603 bp, Homo sapiens
agcgtgtagtcatttcctgtgcagccctaagcccaggccctaagcaagcactaatctagttcccatctctatagatctgcctattctgaatattttatataagatgaagattacacgatcattgtggtctttgtgtgactggacttctttgcaacgcgaccgacaattgctttagaggctcatccattttgcgtatccttgtgtcacgtggttctcattcataagtaatgtgcttgaataaatagcctccattgtcatgggcgtcagaccagcagcattaatacgaagcattgtgagatattggatcccagtgatacacgacggattagcgtcttgcttctggcttggcgcttgtgctgggtgtgcacgaggagaatttggagttgtgcacgtaagtgattaggcgcgcaagggaccataagcgtcgtgtccaaaagcgttccccgttggcggggcattccaaggaagtgaaaggtctccgttccgcgttgacgctattgcaagagcaccattacgcgcaaagaggagttactatagaggggacggaagccgtaacaaaggggatggagagatttggccccatactttgggaagtcccctata

SEQ ID NO: 499032 - DNA, 343 bp, Homo sapiens
ggaaatatgctataaagtcctatgtacagtgctatattctcatatgtgtaggaaaaatgggtcagagaatttggctcgcctcgatttaatttactttatatttcagtgatagatgagtctttcacacttactttcctgaggtgatatattaacacttaccctagactctgtaagtttgaggaactcttatgaccagctacatacactataatttcttggctaacccaaatctttggccaaaccacaactcttagatttcatagtcagtggtgcacaaaccttcgctagatgatgtattcatgaagtctagtcaccaagaatgtgctctttggtctctgggcct

SEQ ID NO: 499033 - DNA, 892 bp, Homo sapiens
gaacaagaggaacaacaatggctatggatcaggctggtgtaagtggacgaggccagaacgtacagatagcaggagggcttgccgagggcttcgtgcgcgccctggccgaactgcacatgccagaacacgctgcccagtcgtcacgtggcggcgcagccggtcaatggggcaggcatggtggctcccgtggtaggcctcggtggcaggaggcagcggcagcggtggcttcagcgccagtcctgcactagctgagccgccgggtctacgcaaaccctctagcaacttcaacaccaggcgcgctgagcagctggctggcggtgcgccctccatactggcagcggccgtgccatggccttttcccgctggcaaccctagtcatgcagctagcagccgtcgcaggcagctgggcccagcagatgcccgtgcagcacccgcgcgtgatgctggccctgaaaggaggagcctcagtacagtgcccagagtatgccgccggtcgaagactagcgcgcacccatgtccctcgcgatcagacgaatgtggagtccccacagagcggatctaaggcggagaggaagcggcatgatggaaccagcatcgcgttgctccatggttgtccgtatgcaggaagctggaggagaatcgccctggcttggtaggagagaagagtggagaaaccccttttgaaagcctcgaggaaaccgctcggaagccgtggccggttcccaccaggacgccgaaattaaattggcctccacagggggggaaaacccaggggtttggggcccccaagggcgtttaaataacggaggcaagggtcctagttgaaaccgcacggttagaccacgttggggtgcccaaacctcaagtgttaaccggcaagaagttggcaaac

SEQ ID NO: 499034 - DNA, 320 bp, Homo sapiens
tggggatcacactacctctccaagtgtgcacagctccatgattatccagacaggattctctgtgatgactccaatcagcttcgcaatatgaggatggtcaaagtgacgcattgttactaggaaaaaagttctccatagttattctttcttattatttttttttttagacggagtctcattctgtcaccaggctggagtgcagtggtacaatctcgactcattgcaacctccacctcctgggttcaagtgattctcctgcctcagcctcctgagtatctgggactacaggcacgtgctgccaggcccagctaattttcgca

SEQ ID NO: 499035 - DNA, 195 bp, Homo sapiens
  misc_feature (27)..(27): n is a, c, g, or t
  misc_feature (29)..(29): n is a, c, g, or t
  misc_feature (84)..(84): n is a, c, g, or t
  misc_feature (125)..(125): n is a, c, g, or t
aggctctcctagcagcatccatcgccncnaccctatcttcactggcttcaccttctccttctctcttcgttgctgagcgacaanttcctagcgctatgactgtcgtctccgtcccgcagcgggancagctcgtcctgggtggccgccttgcccgcttggttttcctcccgaggttactttggggccctcccgatg

SEQ ID NO: 499036 - DNA, 354 bp, Homo sapiens
gttctttgattttaagtggggttaagggaattttttcaaatgttggaagggggggggtttttccccccccccccccccttttggaaaaatgaaagcaaatgtttaaaagaatcccttttgaaaagctgtgtcgtgttccctgtaaaactgaccaggggtgtgttggcgcgctaagtcccccatgcttgtgtgtaaggaagaagggggcccccccggctccgcgctgttgggcctgtgacccccccctgccccccgcccctgttgccaccagcccccccggcccccctttgtcaaatacttggcatccctgtcatactcccaccttcgtgaaaaaagttgtgtgcttttttcgta

SEQ ID NO: 499037 - DNA, 806 bp, Homo sapiens
taagaaggcctcattcccagactccttgtggagactcgccgccgtgatgctaggctggtcactactccgagccctgtgacgtgtgcgggagtccaggccgttcgaccgaatgtcctcacctgaataacgtctctggagaaattgcagacaacgctgcagtgggagaaaatccggggtaacctgatactgtgccatacggtgaaagagtgactcggagcgtagacatatttgctagagacacaatcctgttgtaacgttcatgttggcaccctaataaattggtgagcatacgacatacatgattattctaagggtgtctgggaccagatatttgaaccatccaaaagccaagccgtacggtcgtttggaatatacatatggagagaagagcaaaaggggcatcagtcatcagccaaatagaatatcgcttcactttcgtggacactcggtggaggaaccttctttattgggacttagttcagacatacccatcaccaggtgatcgccttatggatgtcaactcttgatctcgttctcgccactctttcagaatccgtagtgatctcgtggcccaccatggtagaatctctgtgcaggccacaagaagccatgtaggaccaacgtgatgagtgaaactggggaaagaggaattgcgtaaagcctgtctctgaaactgagaccagaggatctggaataattatgccgaggatcatgctgatcatgaatttattgaaccatttccggtacctctggtcatgatggaagtaggatgagttgcaggatttgagttggaaaaaaccgggttg

SEQ ID NO: 499038 - DNA, 218 bp, Homo sapiens
aattaagacattaccaagtatcagtggcagtaagggcaagctgaagaataaatagcactgagttcccgggcaatgtcttgtcctccaacgacatccaaactgcgttcaggcagctgagacaggcttctttcccagcgacaagcatatgtggtcagaaatacatacgatggtaaatgaggctactacataggcccagttaacaaactcctcttctcctc

SEQ ID NO: 499039 - DNA, 175 bp, Homo sapiens
tcgcatctgtacctcagctgtatggtcttctctgacctcagccgcttgccttactctgacctcaccctgcctggccttctctgagactctacaatggttttcatccacaccagcaggtctagcacttgcgcaagatggaggatctcagaggacctgtttggccttgccctgtcca

SEQ ID NO: 499040 - DNA, 121 bp, Homo sapiens
cagcaccccgactctataggatcacctctacgttggggaaggaacataaacactgagatcactccagagatgcagtggacagcctaagagtgcatctcacaatttacagcctgttcttaag

SEQ ID NO: 499041 - DNA, 700 bp, Homo sapiens
ttcatgccatgcagtgacctgatgctgcctgctgtccccttctcgctcctgcgtgtggccccagctgtgaccccttccgcgactggtaccctgcatagcctgcctcttctgaccatgtgccttctgggctgcccctgtgctgcctggatggatgttggtctgcatgttgtgttatgtgctgtgcatgcatgcttggccatgtgctactgtgctgcccccttgcccccctgcctgccatctgatgatgcccctgcattgtgtgcctgctgccctgccttaacatgcctgctgctgctcatgcctgtgcaaactcatgcatgctgtgtggtctctgtgaggagtcctgtgcacagcattgctgtgacctgcttggctgctgttgtccctttgtgatttgtcagaccagctatcatgcccctgtgactgaatgccttgactgtgtcaatgaccaatggattggctgttggtttggatgaatcaccctgtgcaaatgcactgatgtgagtgctgtgcaatgtgaacctgaatccattgtgctaacatcatcccctgtgttgctatcaactgctgggagaatacactgcttgccccacctgtgtttgtttgtgacccccacgccaaacgttttccgtaccctacccttgtcaccccttgaatgtgtgcaaccaccttttgaacccttgtcgtccatgtgcccacg

SEQ ID NO: 499042 - DNA, 888 bp, Homo sapiens
  misc_feature (1)..(1): n is a, c, g, or t
  misc_feature (79)..(79): n is a, c, g, or t
  misc_feature (92)..(93): n is a, c, g, or t
  misc_feature (134)..(134): n is a, c, g, or t
  misc_feature (155)..(155): n is a, c, g, or t
  misc_feature (160)..(160): n is a, c, g, or t
  misc_feature (180)..(180): n is a, c, g, or t
  misc_feature (183)..(183): n is a, c, g, or t
  misc_feature (196)..(196): n is a, c, g, or t
  misc_feature (236)..(236): n is a, c, g, or t
  misc_feature (276)..(276): n is a, c, g, or t
  misc_feature (302)..(302): n is a, c, g, or t
  misc_feature (326)..(326): n is a, c, g, or t
  misc_feature (345)..(345): n is a, c, g, or t
  misc_feature (387)..(387): n is a, c, g, or t
  misc_feature (418)..(418): n is a, c, g, or t
  misc_feature (429)..(429): n is a, c, g, or t
  misc_feature (464)..(464): n is a, c, g, or t
  misc_feature (482)..(482): n is a, c, g, or t
  misc_feature (598)..(598): n is a, c, g, or t
  misc_feature (663)..(663): n is a, c, g, or t
  misc_feature (674)..(674): n is a, c, g, or t
  misc_feature (717)..(717): n is a, c, g, or t
  misc_feature (725)..(725): n is a, c, g, or t
  misc_feature (739)..(739): n is a, c, g, or t
  misc_feature (748)..(748): n is a, c, g, or t
  misc_feature (753)..(753): n is a, c, g, or t
  misc_feature (757)..(758): n is a, c, g, or t
  misc_feature (769)..(769): n is a, c, g, or t
  misc_feature (774)..(774): n is a, c, g, or t
  misc_feature (787)..(787): n is a, c, g, or t
  misc_feature (800)..(800): n is a, c, g, or t
  misc_feature (809)..(809): n is a, c, g, or t
  misc_feature (812)..(812): n is a, c, g, or t
  misc_feature (856)..(856): n is a, c, g, or t
ngggatcttgagtcttggagctcctagagggaagcttctggaaaggaaggctcttcaggacctcttaggagccagtgcntaggaaagttgtnnccttgaatgtaagtgtgaaggtgaaggaggaagcagatgcntgttcatatggaaaaaaaganctggntgtgaagaggggaggcgganacnaaagtcctgaaanttgggcgggaaagaattgatctagaagaggacgttgtcanagataaagagccaggctcaccagctcctgaagaatgaatnatgacaatgagaaaaaaatggaaaanagacctcagccctttgtgcggtcntgctcctcgtcgtcgccanaccgtccgtaaatctccatcgcgtcaagagcaaaaaatcgtnatcacgcgagaacaacacaaaacgatcgccnactcgccatcnagttgacgaacgcaccaaaagcgaccccctcgccncctccccaacgccccccnacgtcgttccccacgcacgctaaacgcacgtcgtcccacgcattcgcgaacgtcgaccctcgcgccacgaccgtcgcgaacgtcgccacctcgatatcgcgaaccgctcgacgctntaatccctcgtcgtcgcgcctcgcacgcccgctttccccccaaccttccacgcaatccctcctanctcgcgctcgnggcaaatcgcgttccctttcaatttcgacgcaccctccccacngccccganctcgtccgcgaccngcgacgcanccacncccnncgaaccgtccncgacncacacgcgtaccncacgcctcgtcgnaacgcgccnttngcgtcgctcgcgacgcacgctcgaaccccctcgcccctcgcaanacgcaaccaaacatttcctccctcgtcgtcgc

SEQ ID NO: 499043 - DNA, 207 bp, Homo sapiens
ctacgtagcctactaaaatataagatcatgagaacaggaacatgggtgttcttcactagaactgctccagtgtcctgtgtttcagaccgaagacactaaacagtgtatgaatacatagtcaattacatggtaaggccatactgtcacttcccaggtttgtccaatgtaggcatgatgatttctaggttatctttgatgtagaagggg

SEQ ID NO: 499044 - DNA, 89 bp, Homo sapiens
tgtggattagaggatcccagttctgggtccccatcccttctacttttcatcctcctccgttggcttcaaaaaagggaaattttcccttg

SEQ ID NO: 499045 - DNA, 173 bp, Homo sapiens
gccggcccctgcttgtaaggtggctctcagtctatcccagaagagctacctgtgcccatgtgatttctctcccttcccataccccatcctgatgttgcttccgacagctccatgcatcctgttttgttaatgaacagaatcgcttctttaacttcattaattccagctcttca

SEQ ID NO: 499046 - DNA, 411 bp, Homo sapiens
tctatacatattataaaatattcgcttactaaacgaataaggactttccaactgcgtttctgagttctacagatgggaaaactaacgccaaaggataggagcggggttcacacagctaattctgaagggaaactggaagcagcaaccacctatgcacctaacctgggctaagaggggtttaggacttgggccaccaaactctagggcctgtccctcaagtgcaattgcagctgctcctaggctatgccaacctctgccagagagcaactgcgagggtgcgagcaaagacaggaacagctgaggccagtggagggagtggcgaacaggtccaagggacctctcgagcttgacctcttaggcctgaaacaatccgtgtgagtgtgcgcatcccctttccccccaaaatctttc

SEQ ID NO: 499047 - DNA, 401 bp, Homo sapiens
tgtgatctaagcatccgcttactcatccagtggcactccatgtctgataggtgggacactcgtggtcatgagtcaagaaccagtgagggccaggcgcagtggcttgtgctgtaatcccagcatttgggaggttgaggcgggcggatcatttgaaatcaagagtttgagaccagcctgaccaacatgatgaaaccctgtctctactaaagatacaaaaaattagctgggcgtggtggtgcatgcctgtaatcccagctactcaggaggctgaggcaggataattgcttgaacccgagaggcagaggttgcagtgagccaggattacaccattgcactgcagcctgggcaatggcgcaagactctgtctcaaaaaaaatacaaacaaaattagccagacgtgg

SEQ ID NO: 499048 - DNA, 540 bp, Homo sapiens
  misc_feature (366)..(366): n is a, c, g, or t
aaggctggtttttgtaatagctgtttgggattgcaagtttggaccagcgctccctactcaatgatggtttgaaagctggactacctaacttcaaatacactgatgcggggtaggtgccttacaacagggatgtaaatcccgcgcttgatcttttgtaggcgtgcgcataccactttatctgaaaggaagatcacaaacctcgatctaagaatccaggctagacgtctcagaatccctacttattgaataatatagggtcaaatcgcgagcaactacaaacgtgtttaatccgatacagcttaaggaccagacgcactacgtgtgctcagaggttgctaggaagatgagggctgaaatataaatccnttctcatagcctacacatagggctatgcatcctacagatcaaaacacggctcacggagcactatggctctgtgaggcaggccctgggcttcgtacttttattgatcattggccacatgactccctactgtttatgcataccatacaccggctgtgccatgcattgcatagccag

SEQ ID NO: 499049 - DNA, 195 bp, Homo sapiens
catgatggagttcattgcctacaccaggtctttctagactggtttactccttcctataaaagaaaatccctttttacctaccccttgagagtttgtagatttatggcctggagtgttctccctgtttacagagtcttaccaccctcaccagccccaaactcatcactgttcaaatatgtggcaagtgagacccat

SEQ ID NO: 499050 - DNA, 181 bp, Homo sapiens
  misc_feature (5)..(5): n is a, c, g, or t
tgtanatttcactgtcgtcccaccccacttctatcacccacttcttccttcaactacatgcaagtactatccttacctgccagccagatagatagacagatgggaaaggcaggcgcggccttcgttgtcagtagttctttgatgtgaaaggggcagcacagtcatttaaacttgatccaac

SEQ ID NO: 499051 - DNA, 344 bp, Homo sapiens
  misc_feature (41)..(41): n is a, c, g, or t
  misc_feature (132)..(132): n is a, c, g, or t
  misc_feature (145)..(145): n is a, c, g, or t
  misc_feature (306)..(306): n is a, c, g, or t
  misc_feature (312)..(312): n is a, c, g, or t
  misc_feature (337)..(338): n is a, c, g, or t
aggctggtccttctccctaaatgtccaggctgccctataanaattggaagggggagccccaggcgcagtggctcactcctgtaatccctagcacttggggaggctgaggcaggtggatcacctgaggttganagtttgagaccancctggccaacatggtgaaaccccatctctactaaaaatacaaaaattagctgggtgtagcagtgggcacctgtaatcccagctactcaggaggcggaggcaggagaatctcttgaacccgggaggtggaggttgcagtgagccaagatcacaccactgcanctccancctgggcgacagagcaagtctctanntcaaaa

SEQ ID NO: 499052 - DNA, 114 bp, Homo sapiens
  misc_feature (114)..(114): n is a, c, g, or t
agaaactcactcaaaaccacaaaattacatggaaatttgacaaccttcttcttaattacttcttggttaattattgaatttagggcggaattaagaggttctttgaaaccattn

SEQ ID NO: 499053 - DNA, 104 bp, Homo sapiens
cagcgcctggaggtgcccgtagagatgaacccagagggctacatgaccagccgcacggtccgggaggcctcgggcctgctctccctcaccagcacccactacct

SEQ ID NO: 499054 - DNA, 446 bp, Homo sapiens
gaggctgtgttctgagtttggtttgcccttgttgtgaaaaatgtggtgagtctcacatactcccagctgtctgctggttgtcatgcagcagacatccagaagggcattgggtagtattgagtgagtaggaggagacaaagaagcctggctgttgggtgagcagagggtgaaatacttaatcaggtcttgaaaatttttatgaaaagtctaactccagtattttttggaaatttcgatgatattggtatcatccaatttgtataatccaagtctaacaggtcttgctgctctctgcttatttaagaataatgtatttaaatacgatcaagtgtgataatcttaactatcaccttctttatctcttatcaccctgactaaggctatggtatatcacataagtcatataccataaattaaatgaataaaaaataaagaaatactataat

SEQ ID NO: 499055 - DNA, 270 bp, Homo sapiens
ggtcggggggagggcttcggccgcaaactccccgctagagccaacgaggccatggctttattatttttctggtacattcgtctccttaaggggaggagttagaagcactaaacatcccagagatagtaactgtcttcttcagaactttttccaacaaatcactccattggctgatgaaaaagaagatgactgaaaagggttatacttcctggagttccactatcttgcgctgtaatttggggggggggtgatgtggcttgatatgttcgc

SEQ ID NO: 499056 - DNA, 160 bp, Homo sapiens
cagagtaacacccggggaagaattcacataatagaacacggactatacatacactacattactataatagcctaacaaactcaaactacgaacgcactcacagtcgcatacataatcctacacatcaaggcacttcaacactctactacccactaatagc

SEQ ID NO: 499057 - DNA, 194 bp, Homo sapiens
agctcggacctcatcgaaacctcatcttcaacttctgcatgcccgtagctctccagttacatcctcttataatgtgacattgggattaggtcatctcccctgattactcccagtcccattagactagatgcctgtagaaggcagggtcctggcaaaatatcaatgtattcaattgctttttttttttttttgga

SEQ ID NO: 499058 - DNA, 526 bp, Homo sapiens
  misc_feature (65)..(65): n is a, c, g, or t
  misc_feature (76)..(76): n is a, c, g, or t
ctgggttgtaggatgctgagtaatgtaacctctctgcacatgatctttaacctccaactctaggnaggctcaatanactcctgatctgtgccctggttgtttcattgtctctactgcttattactatcgttttgcctcaatatgtcatagatggctcctgaggcacaatatccaaagtatttttctgacctcctgacatcctcagtttggtggacattctcatcgatgatccttatatttgctgttgaaattatggaggaaaaattttattaaattcagacaggacactgttcttgtgagactactatgtggattaagctatacacacatgttttgttccattgattttttttctacaagaatggattttatattatttgacctactttggagataaagaactggtttcagagtaatttagagtaattagactctaaagtgaacagatgcaagaactgcatgtagaacaccagatgttgcttccttcatagaaggatttgtcgacgtggccgcgaatttagtagta

SEQ ID NO: 499059 - DNA, 818 bp, Homo sapiens
tgtgttagtctttttgtaggtgtatgagagattatcatgcttcacatactgatgatcaatgttgattgaatgcagatactggatggcatcacagatgctcttcatgatctcggatgcttctctttctgtgaatgcctggtctcctcgattctgaattcggctaaagagttctccaccgtccaaacattccatgacaatcagcatgcacttcatccttgtgtacagattctcgtacacatccacgatcagtatgatgtgcgggcactgggaggcccgccagtgcagctccacctccctgcgggccttggggcagtcctgaagcattttgagggcgaatttctcctgggtcctcttgttgaagatctgcaaaactttgccgttgatgcccagccccaggacctggctggtgaccttgtagtcatcgatgatggcgttcttcttgatctgcaggccggacttgacgtggaactgcgggaactgctgcgggggcggcggcggcggctgcgccggggggtgcggcagggcaggggtcgggggctgcggcggcggggccggggcggggaacggcaccggcgggctctggccctgggagttggacagcatggtgcccggggacgccggggcacaggcgggggtgcccgcggccgccccctcctccggctccgggccccctccccgccgccccccgacgggctgcgaagttcgctccgggctggagccggcttccccgacccggcccggctccaggctcggcgggtcgcggggctccgtgggtcccaccgcgcgccgctggctcccaccggcccggcgcccccgct

SEQ ID NO: 499060 - DNA, 270 bp, Homo sapiens
gcacactgcatattaaagttattagataaggacagtagttgtatgatttacgaaggtgttctgttcttgacggtttgacgaaggtgaagtggagagctttcctgagtgtgtgtttttagtagaataagacaaattggtgagatgttaatacttgtctcttgggagagaatgaggctgaagatcttaaatattccttggccacatcattcagtatctgatgctatttataaaagcatagaacagtcagacaagaatacctataaaattaaa

SEQ ID NO: 499061 - DNA, 198 bp, Homo sapiens
ttctagagtgatcccccagcatccaggctgtccgacatgcccaggttcacgataatccaaccgttctccagctctgatcagcagatatttggcccggcgctgcacgctgagcaccggccgatcgctcagcgtcaggatctgctcggaaaccggccagcgcaggcgcgcgttgcgcaccaccgcatactgaatgctgtg

SEQ ID NO: 499062 - DNA, 317 bp, Homo sapiens
tcccttgggcgcgggcgggtggtgggggcatgggggtggccccgtggggccccatggcgaggttatgttttggttttcggagcggggcggttgttggggtccgggggggtttttgcgtgtgggcgggtcggtgttggtgggggggggggggggggggttggggggccttccccccctcccttcctccggcccccccccccatttccagggggtttcccccccctgcctcccctgcctggtccccagccggtgggcccgtttgggaagtggtgtccggttggcttccctttaggcggcctctttttggggcctggggg

SEQ ID NO: 499063 - DNA, 747 bp, Homo sapiens
gcgagatttaggacaaacctctgccgagtgagcctctggttgggactatgtctgagaaacacaaactggcaaggcgttagtcaagcaaagctgacggcacgaggaaatttgatatctggctggagtctagaggatttaactgcaccactacaagatacctctcgagggcagcgtggcaaaaaacgacctaccaacttcccggtggtcacagccgtttgagaacgcgatgctttctgagacttgtacgataactaggagcctgtgtttgaactatccaggctcacggacagcctcttgaccacacaacaaccttttctacttaaccctaacaccgccggacttttgacgctgcggatcttccattcccctagcatcgaacttcacgggcaccaccaacgctatgggacacgacacttcttacaccaactgactgtaaccggggacacctgtctacccttatacagaccttattccctttctctacactcgacttgacctccctaaactcttagagacgtacgagtacgctccgatgctcacggtgagctccctgggacgctcattgttcgaacaggggcgcaacacctcagagagactattccttgcatagcaggcacaaaccgcggacggcgccaaacaacggccgcgccttcccgcggacttctaagacttgcagagcttcacttcgacatacacctggtgcaaagtccacgttgcaccagcatgcccttcctcctgacagctcct

SEQ ID NO: 499064 - DNA, 141 bp, Homo sapiens
agagaccacagtacttcatatggaggtcattgtggacgaaatgcacacgccgagagtccatacgcggagtctccatatacttcttgaggtcagtgtggagaagttgtagcaggtacgatggaggaagttgttgcggggaag

SEQ ID NO: 499065 - DNA, 968 bp, Homo sapiens
ggccgcaatgcgacgcctgcgccggtgcagacgtaaacgcagccgggcgaagttttaccgatctgtgtaccgcggacccggccgaggctgagtcttcccgagggtcatggatcaggctgctttgcttgagtcccttttgtgtgcctgccatggacaattccgggcaaggaagctggaggcgatgtgcgctgtttgtgccgagggcggagcgcaaagtgaagaactcgacagtccttcttactctgtgcctcttttggaggctcatccaaaatagaggaagcatgcgaaatctacgccagagcagcaaacagtgttcacaaatgtgccaataaactgtgatgtgctgctggaaacgcgtactgcccagggctgcacagcttgacaacctgcaggctccaggatgcaagcaacggacgcagcccaccttgcttctgtagggaactggcttggccacagcgcagattacagaggagacatgcgcgaaccccccaaagaagtgaccatataaagcttggtctgtgggactgccgaggcaatacggaaggatcctaacaggcagggaaccacattgcgggccccctggaattttccaccgggaagttgggccggggccccacaatgccctacacctcaagccaattcagcttccgactaattagtgggcctttgcaagcgacatttcctcaaagagtgggaacggacacccagtgaacggcaatatatggcggacagctcggggcgagggaacaccccaaattctcaccggtgaaaaagacgtaaacaagacgtggggtgggtccccacccaaacaggttgtaggtacggcacccgcccgcccaaaaggcctctcttcaaacatcgctgtgaacaagaagagccccacaacaaaggtcaatcttcccctagtttggtggacacacacaaacagtagcaaaagcgccgaagtgtaccgcccccgtcttgaaact

SEQ ID NO: 499066 - DNA, 294 bp, Homo sapiens
ctactcggtgaagtgcaagatgagagctgggcaggacagagcagatcaacaagggagcaggcacttacacaggacaccaaggaacagccagccaaaatgtaaggtactgtagaaccaagaaaatagagtttccacaaggagggactgaggagcagatgactcggagtgtcaggacacttggggacagatgtgtccatgctattctctaaccccaagtctaagcctaagaggaaatcaggattcagggaggttgtatttggtttccagcaactcgcccaccaagaatttcaaaat

SEQ ID NO: 499067 - DNA, 451 bp, Homo sapiens
cccatgtgtgccactaataggaacactcttctctccactagataaacattctgatcaatttttaagaaatgtatgacatgttatttaagatgttccagatgcatggaaaaaaaaaacagcaagcttagaaatcctttcttaagaagcctaaaatgagtaacaaaacttaaaaacgacccaagaaaactgcaaaccagcttcacttaagagtattgatgaaaatttccttttttaaaatgaacaaactccaggccgggcatggtacctcatgcctgtaattctggcgccgtgggaggccaaggcaggtggatcacttgaggtcaggagttcgagaccagcctggccaacatggcaaaaccccgtctctactaaaaatacaaaaattagccacatgtggtggcatgcacctgtaagtctagctactcaggaggctgagaggcacaagaatcac

SEQ ID NO: 499068 - DNA, 155 bp, Homo sapiens
ccttactccacacctcaggctcagtacacaccggaagcaatatgaaatgatctgctgcagtagcatactgagccctaggattacatcgtttcttttcaccgtaggtggccctgactggcacttgtattagcaaagtcatcactagacatcgtact

SEQ ID NO: 499069 - DNA, 128 bp, Homo sapiens
ccagatacggggtctgtgactctgggcagggacccggggtctcctggtaccttgacagagtcagctaactccgagtagcagtgggcaggtgtccgcccctgaggcttcacgtccgggagtaagccacc

SEQ ID NO: 499070 - DNA, 908 bp, Homo sapiens
gtacaaaccacaaatgacattggaacactatacctattattctggcgcatgagctggagtcctagtgcacatgctctaagcctccttattctgagcctgagctggtgccagccatgtgcaaccttctaggtaactgaccacatctacaacgttatctgtcacagcccatgcatatgtaataatctatcttcatcagtaaatacccatcataatctggatggcttttggcaacttgactagttcccctaataatctggtgccccctgatatggctgtttcccctgcataaacaacataagcttcttgactcttacctccactctctcctactcctgctcgcatctgctatagttggagtgcctggagcagtgaacaggtttgaacatgtctaccctccacttagacagggaactacatccacaccctgtgaagcctcctgtagacctaaacattctatctccttacaccatagacagtgtgtctccatctagtacttagtgggcccactcaactttcatcacaaccaacttactcaaatatacaaacccccattgaccataaccacaaataccaaacctgcaccctcattcgtcttgatcctgtacctaatcaacatgccattccatacttactcctaatctctccacagttcctagacttgctgtgcctcaacatactactacactaaacagaacctcaaacactctaacaacaaaacttcatttcaaaccccctgcccttcacgtgatgtgatgaacacacaatatctatataccaaacataccctaattccttgagttactacagggtcacaccccttgaaaggtttcatatttcattattcttaacacagtgcacaacgaacttcaatctcatcaatatttggaaccgttaactagcaaccggga

SEQ ID NO: 499071 - DNA, 416 bp, Homo sapiens
tatgctgtctcacagccctatatataaaaaatatagttctccaaagacaaatatttttatcttcataaatagaaatgtcattaaaatagtctaaccaggtcgatcacttatagaaacgagacaaccaattaaacaaccagagtttttacgatatgggttagaatcacaggacatagtaagattctatgaatccagatgtctatgagcaacatataacatttgtaagaactgtataatctatagaaaataagcgcaggctgatatgccgttataactaaatacacagctactatactagcacttatgatgtgaatgctttcagttctatatctaatacaggacaggccctcttactcagaatgtaatacgctctgcagctgcaggggagagagcaggagcatctcttctcatcttac

SEQ ID NO: 499072 - DNA, 351 bp, Homo sapiens
cagaagcctttcctttgtgaaccccactgtgttcttgtatcatcgtccttctccttttactatgttgtaagttacggttttcattaggccccatcacatcttctttactgtaaaattattaaaaggctgtttccaagtggggcagctaatgaagttctaattattgcagacatatttttgagatgtaaaacactttaaagtgaaatgataagtctcttggaggcgagtgaggaataacatggatgtaaacatttacatgggatgcattcggattctgctgtgtgtattgtcttttggttgaaacaaattatgaacagtgactaataataaaaagtcaatactcaatgattt

SEQ ID NO: 499073 - DNA, 1008 bp, Homo sapiens
gcgcgcccgccgtggttctacgcgcgccgaacctctggttgcctccctcgtggggggacctccccgccccgtgtgtttcctctacggccccggcgggtgtcttttgccccccccgggaatgtgtgttctgttgttgggacaacatgaggccgttgtgccgctgcaagatattttgttcttgcgcgcttcgcccccaaatggtttccgggtagagctgtgcacccactggttgcctccccccttactgtcccccccgctggggaccccctctcatcggggcttcttctaaaggcccaggggggtataatagacaccccgctttcggccccacacacacgggggggaaacgttcaccatttggctttattactacgcccggaattactacacccgtggtttctgaccatgtaagggggtgcccggaaaaaccaccaaccactttctccacgacggcctgctggccccccgaatttcgccgctgcacccccgtggggaggagcaaagcggcgccgcgcgagctgcgggagccacgcggccctcaccagaacctccacacagggggcgcacgcacaagacacggaaaacaggtgggcacctccagagcatcttcaaaagaacaggctccggtgcccgatgggccgccaccaccgagtgtcccccccccgtgggcgaggcgcacacaaacctggggtggcttcaccgagactccggggaggcaccacacgcaccccccgcccgccaacatggtcaggaccccgcgtgtctgtcaggagggagccgacacgacgaccaatcgcgcccggtggtcactcgtgagccgaaaacagaccccccgtggaggtgcaaccctgctgatgacacaccttatgacctcccgagcatcagcttaaaaaaccaccaggaggggacaagggaggagcaccctgagacgacacggaggaagagcccacccctcccacacaaacgccccgggggccccagccaaccaccccccggccaaaaataaca

SEQ ID NO: 499074 - DNA, 679 bp, Homo sapiens
tttattctatatatagttctttcttttttttgagacagtttcactctttttgcccaggctggagtgcaatggtgcgatctcggctcaccgcaacctccacctcccgggttgaagcgattctcctgcctcagcctcccaagtagctgggattacaggcatgtgccaccacacccggctaattttatatttttagtagagacagggtttctccatgttggtcaggctggtcttgaactcctgacctcagctgatctgcctgccttggcctctcaaagtgctgggattacaggcgtgagccaccgcgcccaggctctatttataatttcttaagttacctaaaatggtacagccaggtattttcccgtgtttctgatgatgagttttgggtactaaaaaagtttgcaggtaataattttgttctgctcttaatgaaaagaaggggaacttttattaacattctaaatctgatggggaagcatctttatatctttttctacttatattccttacattttttcctgtttcatcttttcatttggcttttctttaaatcgtaactagcttgctttaatgcgcctgaccttcctctagaaacaagcaagctacaatctaccagactgtagcatctacatgacttgattcattactccaaatatttttcagaactcatctatcctac

SEQ ID NO: 499075 - DNA, 143 bp, Homo sapiens
tcaacgcagatggtgagcggttatgtgtccaatattacaaaaggagaggtcaagtgccaagagggtagaaggacgggtcttactccgtagtccatgtgagacttcttacttgacagtccatgctctattacaccaaacgatct

SEQ ID NO: 499076 - DNA, 191 bp, Homo sapiens
gccctacccggtaaggctgcagtgcagtgatgttggttcgctgtacctctgcctcctgagtagctgggactacatggcgtgtgccaccgcacctggctaatttttcgtatttttagtagagatgatgtttgactgtgttcggccagtgatggtctcgcaactcctgtacctcaacgtgatccaccgtgcct

SEQ ID NO: 499077 - DNA, 142 bp, Homo sapiens
gaaagaagctagagggaagacaggagaagggtaacagggaggatgcaaagcagacatctaccctggtcaccccaggatcaggaaatgggtccttgtttgcatgtatggattcaaaattgggtctccattagggtttggaggt

SEQ ID NO: 499078 - DNA, 853 bp, Homo sapiens
gtgattgttttaatgctgaaatgactggctatccaaagcttctagtctagaggtctgtcggtgaaggcagacatttccaagtttgttgaaagtaatacgaagctgactagctctacgtgaatgatgtagccctcatttgtattaggcatgaggacctcatttactgcagtactattagatactcttcaacccaaaatgcttaaaacttagtactggacataaaactggctgatattaagacgggttccaaaatatattattcatgatatagaaaaacacattctgagataaaacattttataaattcacaacaaaagactaaaggatggacaagtggttggtatgaaccgaaatgtaaattttataaacattgaatgctatacgggtaaagccttacgaattgtctgccaaatttaatgtataaagagaagtacggaagtaccgtaaagaacgttaacattggataggaaattactgaggaggaaagaaaatggtaatatggcactggggaaagaaaagtaagaagattaacaggaagaaacctgcgcgagcaaaacgacgacacagcatataccccaacaagtaaaaacacaacagagcaaaatacaagcaacaagtgcaaaacagagacaagacaaagacacagaccagaaacgaacagggacaaaagaaaagcgagaagagagaacgaacactgagccacaaacagggcgacatccgcaccaaaataaaggaagcagcaacggattcacacgcgtgcgaccaaacagcggagtgcagtgagaacagacacggaccctaggaccacaacacgctgcgagagcagagaagaagacgaagacagagagacagg

SEQ ID NO: 499079 - DNA, 395 bp, Homo sapiens
  misc_feature (352)..(352): n is a, c, g, or t
ggtaatagactgacacgtcctgcgtgcagtgctattttgtcattaggctccgacagagggctcagggagtttggctcgcctcgactcaaattactctatatttgactgagtgctacatgtggcttccgcccacacttacctgagtggggatcttgacggacagcctatactctgcaggattgcggaactcttatgaccaagtgcatacactatatacccttgactgacccaaatctattatattcagtcccaatgtgttcatccaagcgtgagagacctgctgatgctgaccagaccacgctgtcagtatcatagtcagcgtggacgaacctgtagatgaggactatgacgncagtgaccatggtgagctctagatgtggttagctggtctgtac

SEQ ID NO: 499080 - DNA, 1072 bp, Homo sapiens
ggtgtagatggcttggttccagaggtgagggggcctggctgctgccatcctggcctggtgcgaggttggaggagactgtagtgagagctagtgatgtcgtagacttagaagaactgtgggccacatacgcagcagagcgactggtgtagagtgtgagcgcaggagtgctccgggatcacgcaccgctagacccaatctcctttcgcgtcatgctggcgcctgcgaggtgaatgcacgctttgcgatggtgttaatttagcccacagattgtgatagctaatacgggtaccggcaggctgcgtagctggcgttttgatccatccctcgcagttagggttgatttggagtagaagcgcgagtgtgcgcgtcagaagtgccccgtgatgttcactcgcttacacagcatcgcgttccaatttttagcgcccttgacctccttgtcgggagtcgtctcgggaggaggcgcatagcttacaggaaaagcatatagggtttgctgaccgataccccactggcagtgtgccttgcactgctgtgtccttttacttactgaaacaaaccgggcaccaggcggctatgcgggcatctctagtggtgatcaggaccgcatcttggtggccgcatggcaagaagcgccctggcgccattgattggcagagtcaagagctgcgacaggaactggagtaggcatccccgtggagtcgggcgctgactcatcgggtgcttccggctgtgttctcgtgccaccgtgccgccctgttagggccggtatgtcacttcggtccctcgctgttgaggccctgccgacgctgagggcttgcgttccagtgcttgtagcgcccgcgtggcgtcggcacgccgctcatgcctcgcatccacccagtccgcacttggggcggcacgcggcgattattcctcgaacaccggtggaggggttcctctcccgggcactccgttcccctgcgtgtccctggtggaccgggcccagagctgtgccctggcgccttgttgttgtggcagcctcacctagaccgcaggggcatatcgccccttctccgtcgtctttccattg

SEQ ID NO: 499081 - DNA, 160 bp, Homo sapiens
ccctccgactagccgacagcaagcccttttggctctgcgctggggtagcctgctgtgtactgctgctggagggagctcacggcgcgttgccagcttaccaccagcctctactttgcctgttgtcattggcccgcctccaacatcctgtcggctagtcggg

SEQ ID NO: 499082 - DNA, 101 bp, Homo sapiens
aagctccaccagaggtctatacttttaatgaattgactttcataaatttggtatgttggtgggcagttcctttagctggaattgtaattcctcctgaaatg

SEQ ID NO: 499083 - DNA, 362 bp, Homo sapiens
caccattgggattcatatctcatatacgcaacctatggtcacagacactggatcctgaagtaccgagtgcaaccaagccataaagctctcagtagcaaattcgtgtctcacagaaagacattttcaacttgtgctccagctgttgataaaccaattcatgtgttatagcttgactccagacaagcacaacttgttccttcatacctctctagagaaaaaaagaagttgttagtagatcctaaaaaaagtgtatgaataatgtgagatatttttcctaaaaagatcccttgacacactttaggaatatggagggccatatgctcagtatgctagtaagagtacagtgtgctgcactcgtgccg

SEQ ID NO: 499084 - DNA, 494 bp, Homo sapiens
cttttctgaggctcattcaggtctggtcccaccctggagtttctcctcacagaactcataagaggagaccagagatttgggaggtggcttctgctgcctctccagagcttatgctcacaatattctgaaacccaaaagcagataaattagagcaataagctatatattttgaggtcttaacttctttctttttaattaaaaccagtgcttgtagagacattccatcccagtagttactccacaagtcacaagaaagtaaaagaaacacaataaaaaatccctttaaactgcacttaaccctttcctttctgtatccctcccatctgtctacatttatcacttatgctatacatttttaaaaaaaatcagtgagaggccgggctatgtggctcatgcctgtaatactagcattttgggaggcaaggtgtgcggatcacttgaggtcgggagttcgagacagcgtgacaacatggagaaccctgtctctactaaaa

SEQ ID NO: 499085 - DNA, 346 bp, Homo sapiens
aggaggattagtgaaagaggaaggcctctttgcagttgagtataagaggaaggcttctgtctccggctcatccctggaaatggaatgtctcggtgtaaaacccgttcgtatgttctatttactgcgataggagaaacccgccttatgcctgaaggtgacacatgctggcgccaatactgctctttaatgcactgagatgtttgtgtaaagtcaaccttaattctggcctatgtgcacctcaaggcctgctgaccctctccccacctttcccatatagtcctgccacatccctctctccgagatggtagatatagtgctctatatatgcagagagacccgcgcgcct

SEQ ID NO: 499086 - DNA, 1011 bp, Homo sapiens
caaatacaaaaattagctgggcatagtggcacatgcctgtaatcctagctacttgggaggctgaagcagaagaattgcttaaagccgggaggcagaggttgcagtgagccaagattgcactactacactccaggctgggcaacagagcgagactccgtctcaaaaaaaaaaaaaaaaaaaaaaggggcgggggccgcaggttgacttcacacctggttaatctcccaagcactttggggagggccaagggcgggggggattccaccaagggttcagggaagattcaaggaccatctccggggcttaacacaggcgaaacggccactcccttatcttaaaaaattaccaaagaaaaaaaaaaataaaaaatatttttcgcccaggggtgtgtgggggggggcgcgcgcgctctgtgtagtgcgcccacgaggccagttcggggggagagcgagctatgcgagcgccgcagagagacagaatggttggtgtgggtgagaccgcgccgggggagagggcgagagagaccagtttgcgagcaagtgtgaggcgcgccagagaaaagttgtggttgcgccaattggggatactccccagaaccgcgtggggggggcggcgaagacaaataaaggaccgggagaaaagtattctccccctcttcctacaaaaaaaaagacatacaatacaaaagtactactacaacaatcacaagcacaagagcgtggttgttgctctctgggggggggcggcaaaacagagggagcggcacacctcttttatatctctctcgcgcgaggtggggattctctatctaactaggctatgtctgatacttctttacagagcgggcgacgcgccctctaattaagaacccgatcttgtgtgctaacaaaccagcggggggggggggcgcacaaccccacggagcggagacacgtttttttttttttttttctcccccaccgcgatagtttttttccacgcccgtgtggtggttttgcggcccccctcttg

SEQ ID NO: 499087 - DNA, 185 bp, Homo sapiens
ctacaggatccttagaggagagagaactgggtgtggtggtgcattgttaggaattgaagaagcagttctgccaggaaactggccccagccagaagactcaggggcaggccaagaacacaggcctccccctttctttaaggctctctgaagtttccattgttcattgctctttggctggctgatag

SEQ ID NO: 499088 - DNA, 359 bp, Homo sapiens
  misc_feature (294)..(294): n is a, c, g, or t
tcgagtcgtgacccccgctggccaatggatcagtgtaggtactgccctttctttgctattctttgtttttttttataaaaatggggtctcactccatcactttggaaatggagtcgcccaggctgaagtgcaggggtgccatctaggctcacggaaacctctgcctctaagatccaagcgatgctctggcctcgagcctcttgagaagctggaatggcgggtaccggccaccacacccggtgaaattgtggtatttcaaggaagagaggggtttcaccatgtgggccaggtggntctacaactcttgccctcaggtgatcctctaacctaagcttcccaaagtgctaggatcccggggg

SEQ ID NO: 499089 - DNA, 101 bp, Homo sapiens
catggatttgctggtgcagtacaactaggctctcgaattcgagctcgaattcgaggctcgaattcgagctcgaattcgagctcgaattcgagcttctaacg

SEQ ID NO: 499090 - DNA, 209 bp, Homo sapiens
gccaaagccctttggtgactccctgagtaccatggttttgttttcctttggagattttgcacggatctgttttcctcccccatgaactaaaaaaccccttactcccagaattcaggtcgggcttgttagtactatatccccaagtccattcatttaatgatccaaaactgtaatgttgccctgtattccaaataaagggtaaaaacaga

SEQ ID NO: 499091 - DNA, 206 bp, Homo sapiens
aggctgagttcagtcgagacatggaacggtcaagtgctatcagcacagcaatgaacatccagctgtgttcatgtgacccttagctcaatgtcaccagttaacggccttgtgactactgtgacatctactggggcttgttgcagtgcacaaatattaacctttacgctggttaaagagccaggtttgccagtgcaaaaccttggacg

SEQ ID NO: 499092 - DNA, 495 bp, Homo sapiens
tctttcagccaccctatcatcctaccgccagggccgcccaggcccgcgccgaggccgtgtcggccccggctcttggccctgcagtctggcccgggccgccggcccggaggggagggaggtgacggctctcccggggcggaggcagttgaggactccggagctccaggcagccctagctctccggagcgcggggccggggacagcgatggggcgccggggcggcgagggcttcggccgggtggcgggggatgggtcgcctccgccccggccttgtctggcgagggcggcccggcggctgctgcctgcccctcctggggcggcggttcctccgccccggctccggccggtccggccgcttctggggctttggggtcccccggggcttctggtcttcccccccccccccccgctccgccctgctcccccgccggccttcccctttcttccctcgcccctgcttctctccccgcctcgcccttccctctctcctccgcg

SEQ ID NO: 499093 - DNA, 858 bp, Homo sapiens
  misc_feature (529)..(530): n is a, c, g, or t
  misc_feature (642)..(643): n is a, c, g, or t
  misc_feature (647)..(647): n is a, c, g, or t
  misc_feature (649)..(649): n is a, c, g, or t
  misc_feature (659)..(660): n is a, c, g, or t
  misc_feature (735)..(736): n is a, c, g, or t
  misc_feature (750)..(750): n is a, c, g, or t
  misc_feature (755)..(755): n is a, c, g, or t
  misc_feature (763)..(764): n is a, c, g, or t
  misc_feature (775)..(775): n is a, c, g, or t
  misc_feature (781)..(781): n is a, c, g, or t
  misc_feature (791)..(791): n is a, c, g, or t
  misc_feature (796)..(796): n is a, c, g, or t
  misc_feature (799)..(799): n is a, c, g, or t
gagggaagcctgcaaccggaagtgaaggcagatttccctccttcgtcgctgttgctgccgccatacgcgctctccctgtttagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcaatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgtttnnttggtggtctgtctatcaagaaggatgaagaggtgctgaagaagaactgcccgcatatcgtcgtggggactccaggccgtatcctagccctggctcgaaataagagcctcannctcnanacacattaanncacttcattttggactgaagtgtgatacacgatgcttgacacaggtcgacatgcgtcggggatgtcccaggaaanntcttcgaatgaccnccaangagaagcnngtcatgatgtncagggntaccttgagncaagnganaatccgtccagtctgccgagattcatgcagatccatggagatacttcgtggttgcacag

SEQ ID NO: 499094 - DNA, 1372 bp, Homo sapiens
  misc_feature (1043)..(1044): n is a, c, g, or t
  misc_feature (1156)..(1157): n is a, c, g, or t
  misc_feature (1161)..(1161): n is a, c, g, or t
  misc_feature (1163)..(1163): n is a, c, g, or t
  misc_feature (1173)..(1174): n is a, c, g, or t
  misc_feature (1249)..(1250): n is a, c, g, or t
  misc_feature (1264)..(1264): n is a, c, g, or t
  misc_feature (1269)..(1269): n is a, c, g, or t
  misc_feature (1277)..(1278): n is a, c, g, or t
  misc_feature (1289)..(1289): n is a, c, g, or t
  misc_feature (1295)..(1295): n is a, c, g, or t
  misc_feature (1305)..(1305): n is a, c, g, or t
  misc_feature (1310)..(1310): n is a, c, g, or t
  misc_feature (1313)..(1313): n is a, c, g, or t
tgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttctgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggaaaagaggtggtgaaggctgtgctcgtgattaagtcctgctttttttttcccccctccagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaagtccagcatgagtgcaatccctcaggccattctgggaatggatgtcctgtgccaggccaagtcgggcatgggaaagacagcagtgtttgtcttggccacactgcaacagctggagccagttactgggcaggtgtctgtgctggtgatgtgtcacactcgggagttggcttttcagatcagcaaggaatatgagcgcttctctaaatacatgcccaatgtcaaggttgctgtttnnttggtggtctgtctatcaagaaggatgaagaggtgctgaagaagaactgcccgcatatcgtcgtggggactccaggccgtatcctagccctggctcgaaataagagcctcannctcnanacacattaanncacttcattttggactgaagtgtgatacacgatgcttgacacaggtcgacatgcgtcggggatgtcccaggaaanntcttcgaatgaccnccaangagaagcnngtcatgatgtncagggntaccttgagncaagnganaatccgtccagtctgccgagattcatgcagatccatggagatacttcgtggttgcacag

SEQ ID NO: 499095 - DNA, 669 bp, Homo sapiens
tgaccctcatctatcacccttgactgatggctgctgagttaggcatccataacggtgggattataatagggaaagcggagtcttcctttgaggacttttcaggactctacttgtcatctccattttccactttactaagttattagtcatattttaccttttattatctattctatttcctcactgttactttcagatcaagaatttataagttggtcttccccttccaacttttctggtttctgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggaaaagaggtggtgaaggctgtgctcgtgattaagtcctgctttttttttcccccctccagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggtctaataaccttttgactgtggggatctctctacatcgtgcctggagcgtt

SEQ ID NO: 499096 - DNA, 289 bp, Homo sapiens
gtgaaagcgccacctaatgcataggtctataaacgtaccagcgacatgctgtttaagtatcagaggctacatagtatgtataaatattaggctaagactaggccctgctcagaactcttctttccctgtgtattcctagctatatgcgtgtagtatttatccataaagaactttagcgtcaacttatctggtaccatcgaaaagcatatgtagggtgttaatagggtgaacaataaacctctttctctcgtctcaggtagaagtgatctctttgctggctgtctagtct

SEQ ID NO: 499097 - DNA, 241 bp, Homo sapiens
ccgctgccgacagtatgattgagatgggggctagtttttgtcatgtgagaagaagcaggccggatgtcagaggggtgccttgggtaacctctgggactcagaagtgaaagggggctattcctagttttattgctatagccagtatgattgtatgattggaagtatgggttatggttcatggtccggagagtatatggtagaagaggatagctatgagaaggattatggatgcggttgctgg

SEQ ID NO: 499098 - DNA, 413 bp, Homo sapiens
ggggacaaccttagccaaaccatttacccagataaagtataggcgatagaaattgaaaaaaaaaaaaaaaaaaaaaaaaaaaaaaaaaaaaaaaaaaaaaaaaaaaaaaaaaaaaaccttttggcccgggattttaaaaatacttccgggccaaaattttatggagaaactccccctttgaaaaaaaaaaccatcccggggtaccttggcttttggacccatttgggaaccctaaaaggtttcgggaatattggcttttcaaaatttaacccttgggggagaaaatcctggtttggtgcccagggaacccagcttacaaagccaataaaatccattgccccttaatacccaagggggtttccaacttctacccgaattttattaggggatcccctgtttgtttatgtggccct

SEQ ID NO: 499099 - DNA, 151 bp, Homo sapiens
agacagagtcttactctgtcacccagacttcagttcattggcgaagtgtttgctcactgcaacctacacctccaaggttaaggtaatgctaatgcctaaacctccaaagtagctggagtcaagcatcacacacgcaaggctagtgttgtgt

SEQ ID NO: 499100 - DNA, 501 bp, Homo sapiens
aatgctttaagatgtatatttttatctggcttctcccatgtgcagcaggattgtaaatgtcctgcaatccaatctgaaaagcgtaagtttgttttcagagatattctaaaaatagttcactatagctaagtaagtcaaaaattcctcacaatgctattttactttctttttcctgccttaggatcttgttttggtctagcagatcgaggcaaactgaaccaccatgggtttgccaaaaagcggatttccattagcttccgctaagggctggttgctgctgcttaatcattaggaagtccaatgaaagcttgtcctttcatacgatcttctttcatcaaacgtatatcaaacatgatccgctgtgtgtctgatgaaaagtcgacctatcttccaaaaatatattttaggtccttttcttgagcatgtttagctaaattctttacatgaattctacagtagggttcacccggttcataacttctgaaaactggaagtgtttcc

SEQ ID NO: 499101 - DNA, 622 bp, Homo sapiens
tgcgagctgagttgcatacgcagagcgagctgagttgcatacgcagagcgagctgagttgcatacgcagagcgagctgagttgcatacgcagagcgagctgagttgcatacgcagtgcgagctgagttgcatacgcagagcgagctgagttgcatacgcagagcgagctgagttgcatacgcagagcgagctgagttgcatacgcagtgcgagctgagttgcatacgcagagcgagctgagttgcatacgcagtgcgacttgagttgcatacgcagagcgagctgggttgcatacgcagagcgagctgagttgcatacgcagagcgagctgagttgcataggcagtgagtggattcgcatacgcagtgcgagttgagttgcatacgcagtgcgagttgagttgcatacgctgtgcgagttgatttgcatacacggtgtgagttgagttgcatatacggtgtgaattgagttgcatatgcagtgagttgatttgcatatgcagtgagttgatttgtatatgcagtgcatgtttccagcaagttgtttaccatctttaggaatgatctagcctgagagggacggtctagcccccacagcaagaccccaggatgaaaatgtaccc

SEQ ID NO: 499102 - DNA, 144 bp, Homo sapiens
aaaggtcttggtaggtgccgccatttatctgtcctcattctctgcgcctttcgcagagcttccagcagcggtatgttgggcagagcatccggagttcacacctctgtggtcgtagagccactatgaggaggcctgggaagaatt

SEQ ID NO: 499103 - DNA, 345 bp, Homo sapiens
tgagccgtagatcccgtcgaaaatggtaaagggagactcgaagtactctaaggcttgtagaagggtaaaatagactattagactatggtgagctcaggtgattgatactcctaatgcgagtaatacgaatgtgtttagaagtgggacttctaggggattaagcggggtaatgcctgttgggggccagtgcccccctagttggggggtaggggctaggctgaagtggtaaaaggctcagaaaaatcctgcgaagaaaaaaccttctgaggtaataaataggattatcccgtgtcgaaggcctttttgcacaggtggtgtgtggtgcccgtggtatgtgctctcgtg

SEQ ID NO: 499104 - DNA, 335 bp, Homo sapiens
tatctcttctaacgcaggtttattcctagatgtcgaatagagctgtgcctcttttggactaactgttaattttacaaggggatttacagggttctgtgcgcaattttatagttgatctaagattctatcttggacaaccagctatcaccgaggctcggtaggtttgtcgcctctacctataaatcttcccactattttgctacatatacgggtgtgctcttttagctgttctgaggtcgctcgtctggttccgggcgtcatagcttcctcctttctagcaaagttatttctagttaattcattatgcagaaggtataggggttagtccttgctat

SEQ ID NO: 499105 - DNA, 1247 bp, Homo sapiens
gctccctgaaccccgacgcaaagcagcgccctggccgggccaagcacggatgcctggcatcatggattccttcaagagctagtgctggaggggccagcaccttggggacttccggtctgcaacggcgggcaacggacttcaagtgtgcccctcatccatttccctggctcactcctgggggcaaagcggcgcaggccggagctggcctgtgcggtgactgtgggctggctgaggcgagtcggatgcgcgagacatgcgcggatagccgtcagcgacacgatcgcacatgctcagaacaagatccgggcctgcggggagcgcctcaggcctgggccgtcagcagtggcccaagccggttcagagcaaacgcggtataatggccgtccgccccacgcactgtggatctccttccgcgtgtacgaccttttgcacccaagcagtctccctcaatcaagatcgggccggtccctcttggggcgcccaccgaccggttgacaggggcccgacaggcagagatggacagtcgcatccgatgcgcgtggatcccagatgccaagcaagcaggaggactgagtggcagaaccaacacgaggaccttggcgagactgcggccgggagacaggtgcaatgtcgcagtacacattcctgacatccattggcccatccatcacagtgcacactgaagttcagtgcacagacccggattgacggaagcaacctcgaacgaaacatcaatgccatgggtgccccaggggcaggaaagcccccgagggaccaagactcaattcgaacgagccacaaggaagccctggggcctggcccataaccgggccgaaagacctaaccaggacgcacacggaccatgggggccaggggacaccagagggaataatgcccggggcacagaaagaatccccggggagaaaaaacgaagcaacaaggtggaatgaaccgggaagaaaacaggccgggggcaagggctaaagcaggttgtaagtaaggtgagacctacgatatgttagaatagtaaacatacatgaaagaggagtacaaacactgtggggagacgagaatctgtagaaaaatccagggtgaggcaccaaagagaaaaaggagaacaagaggaacaaacaatcgatgaaagtagggcaagaagacaacacggaagagatgttctaaactaggagagatgaacaaaagagagatgtagcgactgaaagggaagaatgcggtataacaaagaacgg

SEQ ID NO: 499106 - DNA, 150 bp, Homo sapiens
atctgtgaggcgggcctcacctgtcagcgacgttagcgttcatccgtgtaaccgctcatcactggatgaggttctcctgtcctaaatgtccaaatcaagctagtggcttcaaaatagagaatcccactttctatagcagtttggtaaaat

SEQ ID NO: 499107 - DNA, 323 bp, Homo sapiens
gtgcgctccagccctctatgagtacatccaagagcagagatctcaataccgcccttaaacaatccacatccgcggggcaagcctcaaaggacgtcttctttttatcggctggatcaaggtcgatggcgatactgtctaccaagccaaaccgaaagattctgctgagcccgctctcctgcccacggatcgtgctgctgtagatgactcggatgacaacggccaaggacagccagatcctgaacaacgtcaatcagcatgattgaaatcagtggcgccccctgggcgcctttcaatattcatatcgaagggaacgcctcccttcg

SEQ ID NO: 499108 - DNA, 421 bp, Homo sapiens
ggtattctgacccccatgaagaacgagtcaagtgtaaaaaacacagatctcaggtttcctcccaagcgtgtcagcgagcgctgctgccgggtctagatagccatgtaccaacaacagcaaagccaccctccctcctgcttcttccaggattgctctttaaagggaccagagtgacatactgatgcctactgaggcatctgagatgcactgtgttggaggttagcctcaatgccagcctctggttgtctaggtgagtgacatcaccataaaatcacattgtgtaccattctggactcaggatcacaaaggcagaggcaaccaactctttttttttttgtttttttttaaaagcctccttaaagagattcttggaggctgggctctatcaggggtaaaccgggtcttttcccccccagttttc

SEQ ID NO: 499109 - DNA, 169 bp, Homo sapiens
cacatggtgctggcatctgggggagcggaccgactcccgtcacattccgacaggcccgatggactcactttggtaagcaaactcctaccgaacacgggccaataaaaaaaaggtgggtttttttttttttttttttttttttttttttttttttttttttttttttttt

SEQ ID NO: 499110 - DNA, 164 bp, Homo sapiens
ggcgcctagcacttcacaaactgataagggctctatgaaaagctcacgttgacatcacacctggtgggcaaaagactgaaaccttctcttaagatcagagcaagacaaagatgtccactttcaatactttcattccacattgtactggaggttctagccagggg

SEQ ID NO: 499111 - DNA, 415 bp, Homo sapiens
  misc_feature (246)..(246): n is a, c, g, or t
  misc_feature (367)..(367): n is a, c, g, or t
  misc_feature (385)..(385): n is a, c, g, or t
  misc_feature (401)..(401): n is a, c, g, or t
tgagggcggctccccacataagagttcaatagatctttgattgatggctcatgagaattgggctgccgactgtaagtcatcaataaattcctttactatctagagactatccataagttctgtgactctagagaaccctgactaatacaactagttaataatcttagggagaaaatatttttaaaatctatagaatattgttgtgtctggccagcagatcacaacctgggttctagcctggaaagnaattttggaaacctggaagagaagaggggctaggcggtgagagaaagaaatgcagctaagacaggcattctggatccaaagctccaattttacctgttcctgcacgcaattattaaaccgnggggaagggggccccganttcccgccaattaatncttggggtcccatt

SEQ ID NO: 499112 - DNA, 1063 bp, Homo sapiens
gcaagataccccatggactccctgtacgtgggcgactgtgattcggacgtcagcgatgccgagcagtccgaaaagttcaaccccgcggaagtctgctgctgtgccatccgggtctggcagctgatgtgatcaccccgcgcgactccctgggctatgcctacgtcaactgtccaggagacgggcgacggctgagccgcagcttggacagccatgaacttctgactgtgtattaaggggactggccagatgccgtcactgatgtgggtctcagatgggatcccgtcttggagaagaactctggatgtgggaaacgttcttcatcataggaaccctggatacatctataagatacacacggcgccttatatagatactagatgtgcttccggacccatactgtcctggaaggtggtgtgtgatgagaacggtctacgggttgatgcctcgtgtccgcgcagccgagcacccgtgacgggctgtcggatgaggaccatcgacgagcggactcacatgggcgagtgctccgtcaatgacccgggaagccaattcgaggcgcaggagtcaacgtctgtcgtgcacatggcgggaatagctgatgcttggtacccctaagggcattggatattccgcccaactgctcaatactcgagaacgtcttggccgaccgaggtgactgctgaccagtgtggcgcatgtacatccgcgggcaagtcgggaaacacaccggtggctttggcgtcggactgggggaagcctaatcgggaccaactaacaggggaacggatatgctgagatccgcgacagtggcggctggcacagtccggtgtcaaagctgcggccacaacagcaaggtcgaacgtatggtaggagtggccctaacggactgcaatgcacgattaacgctctcgcaaacgacgagacacacaacaaatctatctattgagcggaccaacttcttccaaatttctcccttgtccgagactgccataactctatacatgctacaactatactcgactcctgtctgcaccactcctataactttccccctcgcttcccctcg

SEQ ID NO: 499113 - DNA, 242 bp, Homo sapiens
ggcgaaaactgtgagaatacagtaagcaaaaaatagcaaatcagcctcccgagtagctgggactacaggtgcccgccaccacgcccggctaattttttgtatttttagtagagacggtttcaccgtgttagccaagatagtctcgatctcctgaccttgtgatcctcctgcctccgcctcccaaagtgctgggattacagacgtgagccaccaagcccagccagccagaccctatttctgat

SEQ ID NO: 499114 - DNA, 783 bp, Homo sapiens
gaaaaagcccaaggagccccgagtgaggatggagagtgcagcagatggtgactcctccgccccggtctggtcgtgggcacgtacgacagcagcaacgccagcgacagcgagttcagcgacttcgagacctccagagacaagagccgtcagggcccgcggcggggcaagaaggtgcgcaaagatgcccgtcagctacctgggcatgcaagttcctgggaagcgacctggagagtgaggatgatgaggaactggtcgaggccttcctccggcgacgaggagaatgtagcccatgcagcgcctgtctgcaccgccgacgcgtcgacctgccagtgcccatgtttgaggacaacctggggcctcagtctgtccaaagcggacaggtggcagggagtatgtcagccaggtgtcctgggggaatgcttgaagcgcgagggtgaagggtagggacgccgaaggcgagtgcccggggtgggcgaggcccggctggctccagcgcgagtggagagcgcaggggtatcatcggcgaccagagggcaccagcccgggggatcgcgtagggaaacgcgggagatgtaagtgtgcgccaggcattccactaggcgatggaggcccaagatcaacatgggctcctttcggcagccgcagcgaaggagcagacagaacccacaggtcagggggcagacatcgaggctgatcaggagggagaggtagcaacatatcaaagggagaggccatagctgaccaggggaaagggctgcaggtaaatcaaagggcaggggccaa

SEQ ID NO: 499115 - DNA, 104 bp, Homo sapiens
tcagccaccattaagatagcgttcaagctcaacacccactacctaaaaaatcccaaacatatatactgaactcctcaccaagtaccctgggaccagcacaacct

SEQ ID NO: 499116 - DNA, 290 bp, Homo sapiens
  misc_feature (238)..(238): n is a, c, g, or t
ttttaaatgtttgataggattcaacagtgtagccatcaggtctgggattttctttgatgggagaccttttattagagctttaatcttattacttgttattggtttattaagttttctatttcttcaaggttcaatattggtaggttgtacgtgtccaggaatttatcagtttcttctagattttctaacttgttggcatatagttgctcataataggctttaatgatccctttacttntgggatcccagttgttatggcccctttttttggttccgaatttaattaattg

SEQ ID NO: 499117 - DNA, 1182 bp, Homo sapiens
cggacgcatgaggtctgatgcaacgcgttcgtgcagtcgtccgctaaggtattagctaatataatgtgccggcctagaaataaaaggctgattcacaaaggtggattggtgagtaccacagaggcgaagcgatacataaaaagtgtgtttgccatacctttcaggtaattgtattagccacacaattcgagtactcataatcccatcagagagaaggtctactacgaagaggtaatgatacgctctggttctgggcgctacctagggcagggaaccctacgcgcaaacgcaagggtaaacgaatcggcatccccattttattgtgatctaatgttaaacggtttaacaactgatgatttaacaagatatactactaaaaaccaattaaggaaatcaactttacttactaacgaggcacttaaagtgtgtttcgggacgttagttggtcactggcttttggcctagtaaagtcagacaactgaaaggcgaagtggaactttacgcaaccgtattaatataaggaagtcttacttgtaaccagtacatttgggaaaaactcttacagtggtgggcatgataatttgggtccaagaccagttcgtattggaccttatgatgtagaacgacaactttttaaaaggataactagatacatgttggcatttcaagcaattcgtacttaagatatgcgaaggtagtgcactggttaacgaacaatttttcaggatagcaaaacttatcaacaatcaaacccggtttagcgcaatagggtcgggtacaaatatggttcccacaagaggagttaaaattatcaaaacgttaggcacttaagccaaattaaagaagaaaagtttactgtgtgaggtatagcaaaatcgggggagcaaaattgcggggcaacttacatttaagcccacgtatccacacataccccttaaatttttgggacatcaagttaacttaaaaaccggtttccaacgttcagcagtcgaccacttacagcgttcatatcacatagcgggtatcacaaggggcccaaccgatacaagggttctaagacagcttggcaactacagcatcgcacaacgcgtcgaaaccaaaaacaggcaaacacgcgcacggaagtcaaccgaacacaagtatcattacccgaatgccttccctgtcacaacaacacgaagc

SEQ ID NO: 499118 - DNA, 149 bp, Homo sapiens
agttatacagcagatccccatctctacaaaaaaaataaacaattagccaggcatattggaatatgcccattgtcccatctactctggaggctgaggcgggaggatcgaagttcacagaacccccataacccatccagctcgccaggtag

SEQ ID NO: 499119 - DNA, 126 bp, Homo sapiens
aacactacttgcgttggtctctattacctaacctggtcttcctctgctgctgcttggtttcctcctaatgctcgtgctctcgcgtgtccttcgtgaagttgctccattgatcggtcgcgcattggt

SEQ ID NO: 499120 - DNA, 388 bp, Homo sapiens
aggattaacactggcctgtgtaatgcctgcggtgcccttccgcaccaccatatctcccgtgtatcagcacaagtctctgtcagggccatatccaggccccttacctctccaggtcccctcacccatctctctcctaacactgtaacacttaacagtgtgtccgaggctcacaagtacccactccccacacaaccgcccacatagggtcggtcatccaaagcttgacactcaaggcactgaaagtggaagaaggaatctgattgctaacaagattgtgtggagttttactgtattgggattttggctgctctttccccagagttagggtattctcaggggggacagcatctgaagagctccaaaagcaaacagaagagctcagggcccg

SEQ ID NO: 499121 - DNA, 996 bp, Homo sapiens
taccggaaaaaaaaacaaaaaattttttttttcccttttaatttttttaaaaaacttttctttttttaaagaaaaaatttgttaactttattgaccaggcatcttaacaaatatatttaaaaatgcttccatcaatttcaactatttgtctatttgaacacacatccaccgacatataaaaagacacgcgtgttatttgaataaagtgggagtgtcaacatctcctcttaccacagaaatcttcatcaaccttttatatgtgtgttaaaggggtgcaccacactcacccttctagtggtagctagcgtggaaaacaaatttacagacacactggttgatttgtgctaccccccatacaaacacttccaccttcttaaaaaaatctttttacaacaccagtatattcgctataaagagagaagcccacttcaatcattctaaaatcaccaatctattatacaacaaaacaatctcttataattatacaacagaggaaacaactctgtctacacatctgtaagaaaacctctataaaaaaaaataacctttttcagcgttggtcaacctcttcttataaaaaagaatataccgagagagaaaacacccgctaattaaatacagtgccgatgtctccccccgagtattttattatgtgcttataagacaaaaacacttcttcttttacaatgtgggggcccgagagaagaccacaagagtctatattcacattgacaagaaaggacggctctctccggtcgtgccaacccacctcagagctctaaaaaagaggggcctgcacgcgggcctatttctcacccaattaagaaataacgtgtagtcttttccaagccgccatatttacccgaagaaaaggggggggaaactttcccatcaattggcaccaagggggccccaccacttatgggacagacaacttgtttatacacgcttcccttcaacaactgctgtgcgcttttgcgacaataccagtctccc

SEQ ID NO: 499122 - DNA, 224 bp, Homo sapiens
gtaacagtgaagtgttctcagcatcataaaggcagaagctgtggtttcctgtggggcctgccaaccgtccctgatgctgaactctgcttgggagttttttccatgggactttaaaaaatgttgcccttaggttgggccagacctctgttaacttcagtagggatggcaccaggttcaagaggccaaagaagagacctggagctagtgaaggaaacatagggttt

SEQ ID NO: 499123 - DNA, 445 bp, Homo sapiens
ctgatgggccatgcggttgacagaaagatagactacgaaagtggcttatatctgaacacacaatagctaagacccaaactgggattagataccccactatgcttagcccgtaaacctcaagcagttaaatcaacaaaagctgctcgccaggaacactacgagtccacagacttaaaagctcaaacggacctggtcggtgctctcactatccctctaggaggagcctgcttctgtaatgcgataaaccacctacattttctgaccccacgaaaactacgagtagcccattatgaaactgtaagggtcgacaggtggatttagcacgtaaacatgagagtagagtgcttagttgaacagggccctgaagcgcgtacacaccgcccgtcaccctcctcaagtatacttcaaaggacatttaactaaaacccctacgcatttatataga

SEQ ID NO: 499124 - DNA, 306 bp, Homo sapiens
aacccctagtggagaagttcaatagcacatgcgactggggtttgaatagttagctctcattctggttttttttggtgtgttttttttttagctcaaaaaagaagttccaggatatggctatacggacaaactcatctgggcattaatggttacgggaatactaacgatttggattatacttttctgcctcatgggggtagggacaataattaattcaggttttcagaatgcagtcctgtcttggggtggattcagagctcacaaacggaaaaccaaagccactttcccacctgcggctatggaaag

SEQ ID NO: 499125 - DNA, 261 bp, Homo sapiens
atgtataaatcatgctattggcaaaaaacatccaacctacttttgaagtgcgctcgcagcaccaattcataaaactggttttgccccgggatgcagactttttgatgaatatcttagctgaacttgaattggtgggcctaattttagggggcttttagctactgtgttatcagtttatctcctgtggtgctgatgggcttagctaccacggatcggtgtgtactctctgatgatccattatcctctgcagaggaagccacg

SEQ ID NO: 499126 - DNA, 1090 bp, Homo sapiens
gaataaaaaaaaaaaaaaaagtagattttaaaaagccacatgggagctcccttctacccactaagaaaataaccaatttttacatttttggagggggagtgagtttttaggaaaggggaattaacgattccaggcgagagctctggggcatagaacagggcgcaggattccatctctccccaagccccttttaagtgactatgtcaaggccccaactcccttcaccaccaacctacgcttacccttattcgagttaatccgtactaaataatccctcctgcggcatatcctaattgtcagactagcattaatggccacacccagcataagtccaagtgaataccattccacctcgtgcaattgctccgaacaaaaggtaccaacaacaacgatcaaatcgccccacagatggaccgatccacgcgccactgcgtagaatatttggcgatggagaaaaaaccgctaaatacacacagcgaggcacataccacctgagagcagaataacggcatcaaccaagcggagaacccagaaacaagacgagacaaacgcgggcgtgggcaggcctgcatcacaacgccatctcactctcacccacgtgcgagcatcgctccatccacgtgagacacctcccgagcgaaacgaggaacaaaaacaaaatgagggcacgacctattacaatcacagaagcatctcgagtcgtcccgacttattaccaagcgccattgaaagcactgaggatatagatacctatatctgcaacatacacaacacgcaccaacgtcttgccaatacactcctcatgtgactttctggcattgagtagctacaaaccccctgtctctgccccatccccctttcaacatacattccacctatcccaaaagtgaacctcatatgcagacaccacactctcaccgcaatttcattacgcaatatgcgtgaatcatatcaccacatatacaaatagatgtcgtaatacctactggtgaactttatttgtaacacaccccacattctgatctctaaatgcgtgtagctcccaatacacatgtgtgttttgtttccacacatacccaatttcttactt

SEQ ID NO: 499127 - DNA, 215 bp, Homo sapiens
atgtgcgtctggctatgtagccatggaaagcataggttcttgccaatttataactgcagtaactgtaatgaattcaaataatggtttacgatcggcaacgacttgatcatcaaagcatttcctaatttctataattcagtggtccacctgtcacgtcacatgttgctgcagttccagcaatttacgctgatgctgaaacttcaatcacaacagta

SEQ ID NO: 499128 - DNA, 119 bp, Homo sapiens
  misc_feature (39)..(39): n is a, c, g, or t
gcctcttctcctaggagctggtaataaggacggggcgcntttaccctgaaggctagtgccagagccgggactgggaacctaccacaccccgctgcctcagtgaggccttgaagtgagca

SEQ ID NO: 499129 - DNA, 171 bp, Homo sapiens
tcggtaagtggagtctcagagcaggagcctctctcccttgcccagtgaaactcaaactcacctcatctgtttatctctccagagtccagtggcgaggctaggacagtggcgaggctaggacagtggcgaggctaggactgtggcgaggctaggacagtggcgaggctagga

SEQ ID NO: 499130 - DNA, 159 bp, Homo sapiens
aactttgcctaaatactttcttcaccaagtctcatgaggagagggaacatgctcgagaaactgatcaagctgccgaaacctatgaggtggccgaatcttccttcaggatatcaatgaaaccagactgtgatgactgggagatcggacacgaatgtacag

SEQ ID NO: 499131 - DNA, 613 bp, Homo sapiens
  misc_feature (11)..(11): n is a, c, g, or t
  misc_feature (68)..(68): n is a, c, g, or t
  misc_feature (79)..(79): n is a, c, g, or t
  misc_feature (148)..(148): n is a, c, g, or t
  misc_feature (306)..(306): n is a, c, g, or t
  misc_feature (319)..(319): n is a, c, g, or t
  misc_feature (321)..(321): n is a, c, g, or t
  misc_feature (323)..(323): n is a, c, g, or t
  misc_feature (339)..(339): n is a, c, g, or t
  misc_feature (350)..(350): n is a, c, g, or t
  misc_feature (355)..(355): n is a, c, g, or t
  misc_feature (447)..(447): n is a, c, g, or t
  misc_feature (455)..(455): n is a, c, g, or t
  misc_feature (457)..(457): n is a, c, g, or t
  misc_feature (473)..(473): n is a, c, g, or t
  misc_feature (506)..(506): n is a, c, g, or t
  misc_feature (512)..(512): n is a, c, g, or t
  misc_feature (514)..(514): n is a, c, g, or t
  misc_feature (522)..(522): n is a, c, g, or t
  misc_feature (542)..(542): n is a, c, g, or t
  misc_feature (560)..(560): n is a, c, g, or t
actcaagatanaaggcaagcggtttacctagaaaggtttacatattttatctatattttttcatttanccatttttttnaaatgtcattcttttcattcatgcttcttttatcctctttctttagaagttcacagtgttatataagtnaaaaacaagacagatagaaaccaccctaaacatatggctttatgtacataaaaaattcaataatgttgccataacccctaatacagtgtgatccttatttatttattatccagaataaacttctgttcatattaaattcttcaagtatatctagagcngtgcttgtcaaantnangccccactgctaagtnaatccccatcnctttnacgatcacttctaccttcaacataattatggtacagttctaatagttttttttatttttcatgtttcatacattctcaaattttcctttatnctcatttntnccaaacatatactttnattttcatcttgtttaatattcccttttttctnctcctnangttaaaantggatctgtgttaccaaatnttctctttcctttttttnttagagtttatcatcatttatttctattacatttaacccaaattgaagatgaa

SEQ ID NO: 499132 - DNA, 1215 bp, Homo sapiens
gggtgagagctggggagggagccacgtcttgaggtcgccatgcgcttcctgtatgagtgcccctggcggcggctgcaggagctccgggatctcattcccaagatccctttccggatacagctgcggggggccaatgatgtgggctacaccaactaccccagacaaactgtgcgtcttccaagttctcgtgaattggcaccaaacgagcaatggccatggatgtactaccggagtgtaccgactccactcgaactcacttgcccaactatgctgctgcggcatggcaagcgggatggaagtgcgcggaggccgtcggtcgagaagtgctgccaatctcggatacacctcgggcggaccgttgggcctgagccacacagtcgggacctaatgtagcattcatcatgcaagtgagcgtaacactgcggctttagggcccggaaaggaagcgtgggtgactggacgccattggcaatccgtcggactagtcgcttgtggccactctactggcatcattggcccagggcgccgtgacgtagaaaggtccgccactggggaccccttgcgaacacaatggcgatggggctcatacagcatccccattccggagagaaaccccggccatgttcgcccccggtaatccgtcacacatatctgggatcgattcacaagggaactcacaacatgaaccaccggtctcaaaggggtggccagggtgctgctgggctagatccaatgacttggcgcgctgcttggccacaaaaggggctagggcaccccttggacatgttcgcggctgtcgacatggttgggcgccaatgcttgtgaacattacccgcaaatggtacctgagggcgaagatttaacgtatacacaccatgagccccaaaccatagttggaggggtggtccccatagagacggtgtggcccctaggaatagccgagcacagggggacaacatgcgccccattgggtatagccaaccccacgcagggggtggaacaccgattgggtaatgtccgcggactgggtacaatgacaccatacccgggtggcaagcacacgggacggacacgggggggactcccggcgggaacaccgtgatacgtgccaggtggcgcaatctggaacagaggcgcaacgggtgaccacgccaagcgcgacatggaccgaggggccacaacacagcgcggagggctgcacagttacacaacaac

SEQ ID NO: 499133 - DNA, 377 bp, Homo sapiens
  misc_feature (172)..(172): n is a, c, g, or t
ttgtgtgatttcaggccagcacgcgggccaagttgatgagaagctggtctcactgaagtatttatcaagtctcagactggtatagttggaaagggagaacaagaaccacggttctcacctctgccagctaaaacttgcagcggatgcagatacgagttcgccatcatcgaanctagcaagaccaggacgcagactgggtgttcacagaaagttgaaggtcccacttgagaaaggactaagaatggtgagcccacgctgggggaggggtggggatgatgtgtgttccagaactcaaatccagctgattgagccctctcagtgcagtgggatatacaatacccctttcagcatctccccaccccatgaggaataatgaa

SEQ ID NO: 499134 - DNA, 396 bp, Homo sapiens
tttcatcatcctcctcctcctcaccagtcacgatctcctcattcatcttcctcctcctcatccttcgtcctcctcgtcttccactacctatagcatcttcatcatactcctcctcatcctcctcctcctcctcatcatccatggcctccacgtagccctcagcatccgagtcacggggcctccttttctgtcccgtgtcctatgctcgttgcctgatgtgagttgcgggaggatgcttgaacacattctctgcggtagtcgttcacgtaggtaaactcgcaattgaaaaggtctaaactcttgaggttaactaactatttcagtggctctattgtactgaggtctataattttgtagccacttaaatttagatgcgtgaggttcggacacttttct

SEQ ID NO: 499135 - DNA, 151 bp, Homo sapiens
acagaaatgacccagtcccgaacgtgacgactttaggcgcccatctccaacgtaactcggcgccggtgacgtccactcccggctgggtcaccactccgagcaccagcaaacctggtgaagagtcgaacacagctgcgatttcctggtttta

SEQ ID NO: 499136 - DNA, 436 bp, Homo sapiens
  misc_feature (1)..(1): n is a, c, g, or t
  misc_feature (13)..(13): n is a, c, g, or t
ntcgatcattcgngggtatttttccactgaaagtggagacggacaaggtacatccttttgcttcctgacccaaaacgagagcatggacccaaggatccttcagggcccacaaatctccttcccaacacccccaacacccaagggtgctcctgtctgcagagtgctgtctgctttatccccaagggtgattcctagaaacttcgacatcagatctgcccctttaatttactcttggctttcaaggcaaattgatattcacatccaaagcgggcaagcgatcaactgcttggcggggttggactgagctgggacccaggatgtgaaatagaatttattgtggctctgattatgtacactagatgtgcctgacctgctgaccaggcttcacatggtttgtacaataaatacatccgccgggcctgctcaaaaaaaaaaa

SEQ ID NO: 499137 - DNA, 116 bp, Homo sapiens
cgggatcgggcagagaggctgagtacggatgggaaactatgtgcacaagtctttccagaggagtttcttaatgagatattgtatttatttccagaccaataaatttgtaactttgc

SEQ ID NO: 499138 - DNA, 180 bp, Homo sapiens
atggctcctaaaggcagctccaaacagcagtctgaggaggacctgctcctgcagattttcagccgcaattctctcggccaagttcctccgcgttctcttcgggaacggcgttcatcgtttcttccattcccaatctggtattacttggcgatatatggatatatggacctattcaggtct

SEQ ID NO: 499139 - DNA, 111 bp, Homo sapiens
agatgatgttagaaacagtgtggattgtgtaataacgccaagcccagttgtagttgtttgagtgcagtaatgaaatctgcatctaaagtaaaaacaagattgtttgtgtca

SEQ ID NO: 499140 - DNA, 136 bp, Homo sapiens
ttcacaagatgcacaggtaaccgaggaccgagtctgtaaacatatagatcggtcataactatcgtggtcgcgtattgtctgtgagtgatctagggaaatttcatgtcacttccctctcattcactgcagtcacaag

SEQ ID NO: 499141 - DNA, 223 bp, Homo sapiens
ttttaaaaaaaaaaggaaaaaaggtttttaattttttaatttttttaaaaacagggtctccccctgtcacccaggttggagtgcagtggtggaatcatagctcactttaactgcggccgtgggatttttgggctcaggtgatcctcccaggtaattataggtattagctattatgcccaccctaaatgtatttattttgttgtatttcaactccaagaaccca

SEQ ID NO: 499142 - DNA, 121 bp, Homo sapiens
ccccgggcccccaattaacccccctttttttttttggggtaacccccccccgggggttttttggacccccccccctggaaacctccccctttttggtttttaaaaggggggggccccccca

SEQ ID NO: 499143 - DNA, 635 bp, Homo sapiens
gggagaagcggcgtcggggctggagcagaggcagcagccggacgagcagcggaggcggcgggagtcaggcgatggtggaatttgactcagttcaaagtgcccagcgggccaaggcctctctcaatggggctgatatctattcgtggctgtttgcactctgaagatcgaatacgcaaagccttacacgctttgattgtgttcacagaatgatcaggatactgtgggattacacaaaccccaaatctcagtggaccaagggtgaccctggcagcaaacccccaagaaagtgccagaggaagggcccccttcttccgtgggaagaatcaccccgcgcaggaatatgggaggggccccaaacggtgtgggtaaccaccaagccatttaccaatgatgaggggctacgggggccgccacacaaaattcaatacaggaagggggacgaagcgatgttggtccacccagttggtggggttcaaccggttcggggggcccaatgtcggttaaaggggcacgcaaggttatggggcaacccgcgaacgcatatttccgcacacaaaccaggagatatgagcactccagtcggacaggccttgtggaaatggtctaatgggatacagatcaactctaaaggattg

SEQ ID NO: 499144 - DNA, 137 bp, Homo sapiens
tctccttttcaatgaagaaaagctttgcttaagggttgcaaacttttattggagtaaatttgaatgatcccactcctttggagtaaaactagtgctaaccagtttccaaaagaatttagcttctggttggaatttga

SEQ ID NO: 499145 - DNA, 151 bp, Homo sapiens
gagtagcatgaggcaggccagataaccggttactcacatgcggggataggatgcgcttcatcatggagtaaccagtaatccagctatagagagcaggacactggcccgattattaccaatgcgaggctgctattgaattcatgcagtgcat

SEQ ID NO: 499146 - DNA, 522 bp, Homo sapiens
aacggttacgaaccacttaagaagagacgagaggcatttagaattcattgaaaacacgctggctggacaaaatattggtaggcgctctgcgttcccctgaacgatcgtactggggaatactttttcattcttaagttgcattttgctagataagtgtaagtattacatcgtcatttcataggatccaaaattcttcagaattaccacagcttcctttcacaattatcaaggcctggggcaaccattaggcaactttccgttgggcttatagaccaagttaacaccttatcatagtgaggggaacgaccttaaagagccgttggacacgctaacacttcgccaacgttgggacaagttaaacttggccgatcatctgtgcgccccgtttatttaccttttaaccagaacaaccccaaggatatcatataccccccccattccattattgcacacatgaaaacataacttctcccccatacaccttcaaaacccagacacattacaacatcttgaacactttcc

SEQ ID NO: 499147 - DNA, 117 bp, Homo sapiens
ctggattgagctcatgctcttcgttcatagtaatacccatcataatcggaggcttatggcaactgactagttcccctccctcaatgattgttggtggggggatcctctatgcgtcga

SEQ ID NO: 499148 - DNA, 407 bp, Homo sapiens
ctcctctaaggatcctcctagttgagtatctgctcaccccaacagagaaaaaacaaagttttctacaacatgtactactctttagaaactgcttgcctctcagtgactttacactgtcatttaaggacaacttataatttccaacaggtctatgaaagttaaaacaaagaagattatgtaaaagaggttataaaatgatttagaggtaaaaactgtcaggagtaacctggttctgcgtaaattagatagctatctgcaagggtctataaaggcatataggcttttaaataatgcttctaatttaatcaagcattaatgaacttagaaaacaatataatatgtagaactgcactgagattatatagaaattatttaaacagagtttttacagaaaggaagggaaaagg

SEQ ID NO: 499149 - DNA, 126 bp, Homo sapiens
gagggctttgagcccgctagacaacaagtgtctgttcaagggctaccgatgggaagaagaagatcagcactgtggtgagctcccaggaagtgagtaaggtttcagcatggtcttattcaacacctg

SEQ ID NO: 499150 - DNA, 1069 bp, Homo sapiens
  misc_feature (736)..(736): n is a, c, g, or t
  misc_feature (868)..(868): n is a, c, g, or t
ccacgcgtacgccacgcgtctgatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttctgtggacacttggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaactgccaagaagctcaggcggaaggagcagctatgggagaagctggccaagcagggcgatgctgccctgggaggtgcgcagggcccaggcccggctcctcaacccttctgcaacaagggccaagcccgggccccaggacaccgtagagcggccttctacgacctctgggcctcagacaaccccctggacaggccgttggttggccaggatgagtttttcctggagcagaccaagaagaaaggagtgaagcggccagcacgcctgcacaccaagccgtcccaggcgcccgcngtggaggtggcgcctgccggagcttcctacaatccatcctttgaagaccaccagaacctgctctcagcggccacgaggtggagttgcagcggcagaaggaggcggagaagctggagcggcagctggcccgcncgccacggagcagccgccacccaggaggtccacattccaggagctgtgcgaggggctgctggaggagtcggatggtgagggtgagccaggcagggcgagggccgagctgaggatgccgagtctgtcccagccacgccgcctggacacacagagaaagacggacagcacgggggaaaggcgtgcacaggtgcggtacaaaga

SEQ ID NO: 499151 - DNA, 1125 bp, Homo sapiens
  misc_feature (792)..(792): n is a, c, g, or t
  misc_feature (924)..(924): n is a, c, g, or t
ccacgcgtacgccacgcgtctgatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttctgtggacacttggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaactgccaagaagctcaggcggaaggagcagctatgggagaagctggccagcacgcctgcacaccaagccgtcccaggcgcccgccgtggaggtggccgcctgccgagcagggcgatgctgccctgggaggtgcgcagggcccaggcccggctcctcaacccttctgcaacaagggccaagcccgggccccaggacaccgtagagcggccttctacgacctctgggcctcagacaaccccctggacaggccgttggttggccaggatgagtttttcctggagcagaccaagaagaaaggagtgaagcggccagcacgcctgcacaccaagccgtcccaggcgcccgcngtggaggtggcgcctgccggagcttcctacaatccatcctttgaagaccaccagaacctgctctcagcggccacgaggtggagttgcagcggcagaaggaggcggagaagctggagcggcagctggcccgcncgccacggagcagccgccacccaggaggtccacattccaggagctgtgcgaggggctgctggaggagtcggatggtgagggtgagccaggcagggcgagggccgagctgaggatgccgagtctgtcccagccacgccgcctggacacacagagaaagacggacagcacgggggaaaggcgtgcacaggtgcggtacaaaga

SEQ ID NO: 499152 - DNA, 561 bp, Homo sapiens
gggtctaagtctacactgtcccggtcgctggagctgcaagccagtgactttgataggtgcttctatcctcagtgcaatcccgagtgccgtggcccttgccccagatgcatatagcacgggttccagcagtgcttcatagtacccttaatgcgaactaaaaaaccgaggccgccttccttaggaggaagaaacacgaccaccaagaaacccacagagacaccccgccagtgaagtgagacgcaacaggatgccagactgaatgagagccttgtccccagtggggagaatactagcatctgagacgaaaaccggaatctgccaagacgtgaaggtcctaagacccacgccattcaattggacggcagactgcacaccttgatgcccggcctagtggaggcccaaacgctgcctgacctctgtgactcagagagtgcagaaggggtagtccccccggcttctggaggtggcaggagtgcagaactcagcccctgatcgggcaggacacacgctgtctctctaccacaggacccggaggcaggggaggtaaaccccatcggataa

SEQ ID NO: 499153 - DNA, 746 bp, Homo sapiens
ccacgcgtacgccacgcgtctgatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggctttgtttgtccagagggccccaaattgaaaaacactacttccttcgttgggacaacttgtgcttccatatgtgtaaaaacgggcttgaccaaaaggaaggaggaacccaaaagtccagaaagaagtccacttgcttctcaaaggaaaaccccgttcgggggtttgaacccttctatcccttcgcagaaccacaatcccataatggttcccctttgtccccgcccaatatgacgttcccttcgacccgccaccaaggtttccgcccaaactggccccaaatgaaagggcttcaatgtggctgggaacacgctgaaagccatggctttaattgggggacaggacatggcttgggcgctcaatggccatgggggggccagatgcctttgaccccctgtgggcaaggtgtttagcggccaagggtgcccccattgggccccctgggctttccacttccaaaacccacttttctttgccaaacaatatgggggccaacacg

SEQ ID NO: 499154 - DNA, 1285 bp, Homo sapiens
  misc_feature (16)..(16): n is a, c, g, or t
  misc_feature (175)..(175): n is a, c, g, or t
  misc_feature (216)..(216): n is a, c, g, or t
  misc_feature (236)..(236): n is a, c, g, or t
  misc_feature (245)..(245): n is a, c, g, or t
  misc_feature (368)..(368): n is a, c, g, or t
  misc_feature (419)..(419): n is a, c, g, or t
  misc_feature (464)..(464): n is a, c, g, or t
  misc_feature (467)..(467): n is a, c, g, or t
  misc_feature (489)..(490): n is a, c, g, or t
  misc_feature (493)..(493): n is a, c, g, or t
  misc_feature (552)..(552): n is a, c, g, or t
  misc_feature (571)..(571): n is a, c, g, or t
  misc_feature (676)..(676): n is a, c, g, or t
  misc_feature (933)..(933): n is a, c, g, or t
tcttttttttttttantattttattatttaatattagtggtgtgttttctatactgtgtatattacttctattgttgcgatggttgggtggtgtggttttttttcttttttgttgtttgttatctatctcctctcccgtacctacccacgtgtttctttgtcgtctcaccttatnttattatcttcgcgcccgctcggcgccggggcttctccgtntctcttgcctacgttcgatncgtcggtanctaacactccgtagctttccaaacacaatctgctgtgattcagacactacatcgcaacggacgtgaacaggcgagaaaattcatatatgctatgatttgagtatgtatagttattaaatttanagttaaaatgataacgcaccgctcgtggagaaggagaggaagatcagtggngaagggcgggtgatggtaggagtgtggaggcgctgagagggtggnganttgggagtgtggtgtggtgtgnnaantgaagtgtgtgatgatgcgacaatgtgtatggagagatggtgagacgagaggtctactnaatccgtcgggtggactgntcagtagttaagcgttgcgcgtatatagttggtatagtgcactccgccgctcttttatattttattcactcgtcacgcagacaggtagctatcctcacacgcccnacgtcgcgcagacggaagtagagtagatacataagctatgacgttctcgtgttatcctcattctcctcatcttccttcgttcgtatttcgtactatcgtggtggttgcgatgtgttacggtctgcggatatgcatggcaaagtacggtagcgtggcgatagtagtgagaagagagtacgacgctaaccgctctgtccaactacttcatataatgagatctgcgatgtgcacaatctgacgtggctacggcacgatanagaggcgtccgtcgtagcgtagaggaatataagcgattaacacaaggtcgttccgctccgagtaccccgcgaggagaatagaccgagagacggacagtgtagtactgcagttatggtgtaatgagagcgtcaggtcgtgatgacacgtccgatagagagtctcacgggtgcgttacgctaccgaatctgacatacacagagtcatatgactcagtgcgtgttcgttgaagctggttagggcgcggggggaatatacaacatcgccagagacgtagttaagttcccgcataggatatataatgtctttggaatggagacagatgatggcgtcgagagtatgctacccgactcg

SEQ ID NO: 499155 - DNA, 745 bp, Homo sapiens
  misc_feature (733)..(733): n is a, c, g, or t
  misc_feature (741)..(741): n is a, c, g, or t
gggactgcccaagaactatcaagggccggagcggacaacttaatatgactagcttacacaatagctgttatgacaaaaatacctcatagaataaagaaacacctagaaaaaacttatgcaaggagagccaaagctaaaacccccggaaccagacaagctacctaagaacaccttaaagagcacaccgggggggggaaccaaatcgaagggaagatttataggaaaaggcaataaccttggcgggcctgttgacccatgggtgttcaaaattgaaaactttttgagctggagagccgatttcagaaccctttggatcctttggcctataagggggtgagttcaaagaggggcggccctttttacactacggagagacgtggaaaccccgagggaatacccaattaacccttgttgggacaaaaccccttttcccagggggggggattaaggaaaaagcccccccccggtcccttttccaaaagttggccaaacctttggggagggggaaattggaacgcgtataatttcttaaaaaacccgggttaaatctgtggaaaaaaacccttttttttaccaaaaggggcgaaagggggggaaattccctttttaattaaaaaaaaattccccacaaaggggtcgctgttttcccccgtgggaaacacaaatcctcttttaaaaagagggccccccaacccaaaggggggaccctttttacgggggggggccccccttnggagcctnccct

SEQ ID NO: 499156 - DNA, 456 bp, Homo sapiens
cttttagaagtttgagaccagcctgggcaacgtggcaaaagcttgtttctataaaaaaatataaaaacttagccagccttggtggcaccacctgcagtcccaactattcaggaggctgaggcgagaggatggcttgagctcaggaagtcaaggctgcagtgagctgtggtagtgccactgcactccctcatggttgacagagcaagaccctgtctcaaaagattctaatatagatactctttttatgcatatgtaatttatatatattatacaaaatattatttgcatttaacatattctgaaccaatagtcttttctacaagcagaacattagtattcttgtcactctgaatgtaggcacagatttttgtcattctttatcttttttgtgtgtgtgtgacagggtctcactgtcaccaggcgagattgcgcccctgcactccagcctgggccaca

SEQ ID NO: 499157 - DNA, 150 bp, Homo sapiens
acggggcgttgccctgatatcgcataccgtgacttggttttatgttgatcacagcctcaatggagacttgtataagaattttattacttttttattaaaggcttctaagctaactttacctcacggtatatcagatcacagcttaccttt

SEQ ID NO: 499158 - DNA, 1140 bp, Homo sapiens
actagttctagatcgcgagcggcgcccttttgtttttttttttaaaaatttttacatgtgttttattatccgtggtccccagaggggggtttatccagaaaccaagaaaaaaaaatcaactcagaattaaacttcaaaaaaaaaaagggagggggggagccaaacgcgcattcacccacgcagggcggaccagggcgatgtaggccgcacctctcacacccttctgggaggggtcccctagaagaccacagccgccgagacccaagaccccgggagggagacgcatctcaggacacggggggcgccaacggggagagagagaaaatctcggggaaatatgtgctcttcacattatattagagagaccgccggagaagacagcacgcgcgcgaaagagagatatattcggtcgcgcataggggcgagacatatatctatctatctcgatctattatcgatcataaaaaacctccgcggaaaagaagctatcaaacatcaacgacgcgtcttacacacagctgaggcacacatgtctcctctcggtgaaaacagacgctgtttctacaaaaaatttcgctatatagcactctctcctacgaaaagatgcggcttctactctcatagagggggcttcagtggggggggagcgaaactttataagcatataatatgtacctctagcgggagcaatcctgaagcgcagtcagcaaacgagagggctcgcataacaatcaacacccacactatgtgatgtaaatatacacacagggcagggcaacctagacaacgagaaacaactcacgcaagaaacaaaacagatatagaaaagacagagacagcaaacaaaaagaaccaaagaggcaggccgcagggaaatacaaagggacggcagaaacgagagagtaggtgacaaaggacaaaacaacaaaccggaggcgcgcagcagcaacagcatgcgacgacgagaaagcaccccaacaagatacgaccgaaggaggaaaccaaacaaagtgcaggaaccccaacatatgaaagaggagcgcgacgcaaaaattaatacaaacaacagcacgacgcgcgcgggggcgagcgcgccgataaaaacaacaaaaccaacgcgcaaccacgcagaggaaacaa

SEQ ID NO: 499159 - DNA, 272 bp, Homo sapiens
gttattgagagtgccacgggtcagaagcaggggcatcatgagaccagaatgcctgaatcatccacttgcatagctggactctctgagcctcgggttcatcaaatcataaatggcgatatatcatagggcttgttgtgaccgatgaagtgagataatccacaatcagggttaagaaagtgcacttgtacatgcagtaaatattcacgacattagctcctattacaggtaaatcaatcttttatcccaacaaccacaagggataatacagcttt

SEQ ID NO: 499160 - DNA, 245 bp, Homo sapiens
gggggtctgtaaagccagcccgcagttataggtcggcttagcagagtaacgaattaaatcaggtggttcgcttccagccaatcacccagcatacgatgccggcggcatcatccaggcgggaaacacctcgatttgccccagcagcaacagcgtaccgcttactaacagtgtagcgccaacgccgaacaaataacgtgactgcccctgacgaacccgctgagcctgcatttggttggtcagcttat

SEQ ID NO: 499161 - DNA, 330 bp, Homo sapiens
agaccacttgacattgacttagccagaaataaaccacctgattcgagatcaacacaacacccaggagctaattattagcatcatccctctactatagctaaccaaatcaacaaccacctatttagctgttccccaaccttttcctccgaccccctcacaacccccctcctgatactaactacctgactcctacccctcacaatcatggtaagccaacgcccacttatcccgtgaaccactatcacgaaaaaaaactctacctctctatactaatctccctccaaatctccttcattctgacattcaacaccattgcaacacggtctctca

SEQ ID NO: 499162 - DNA, 967 bp, Homo sapiens
  misc_feature (294)..(294): n is a, c, g, or t
cttggccccttctggggacccctcatataaggtgctgcctttatatttggcgtgtccccaggggtccggtccccgaaagtactttggctgcgtggaagatgagcccgttaattagggagtattttaaaatgagctgatgtagatgctttgctttgtaggtatccttaagaaatgccccctctgcgagaatttttcttcgtgggtcttctctcctcgtgagctgtgcccagctgcccctatcgagctggggagtgccgtgctaccgccttctgctctccccctggtctcgatggnccggcatgctctcctcctgcagcctcgggattaggttggttgaagccccccaggagcctcactttgtttcttgaagaaaaaaaccttcttaccgccgtatggctgccgccccggtgtttgggcacacaagaggggggtctcctgctccccagagggggaatccccaatcttcgcttaaccattaatcttgaagagtttctcctccgagtgtgtcgcgctacccacagagaggcgttttttcatgatatcatcctcggccccttggggaggggaagtcttttttaaaagaaaaattgggttaccccacattgtgtgtgaaaaaagcttgtccgcgtcatatctagcttgttctgggtccaccgctgaaaacattcctggcgccctccttcttatctaatccgagtagagtgagttgtctgcttcccgttcttgcaaaaaaagtgtcgcccaggtgattaatctccaaaaatcgtgttagcccaacaagcccgcttatagtatgtttttaaagaacgggagccccccccttgtgtccatgttgtttatacgaaattactttgcggacgggtttgagtacagcacatcttatggtaggcgacggagacaacaacggagataggggggcgaccccaaaaaaaaacgggacaaacccctttttttaaaacaccccaca

SEQ ID NO: 499163 - DNA, 213 bp, Homo sapiens
ggtgcggacacgcatgtgcggctctagtgggttttctgggccccgatctttgcatgtggctgagcaatgcggaatcgaccaaagctcactgggtggtgtgaccaggtgtctgcggtgggaactgagtgggccaggacatgctgcatgtatgtggacaaatgtctgtaatagagactgtgagtgtccgaacatgaatatgcggccagatgttta

SEQ ID NO: 499164 - DNA, 975 bp, Homo sapiens
gaaggagctgtctgacgtcgctcaccgcatcgtggcgcctggcaaggggatcctggctgcagatgagtccagtgggagcattgccaagccgggtgcagtccattggcagcgagaacaccgaggagaaccggtgcttctaccgccagctgctgctgacagctgacgaccgcgtgaacccctgctattgggggtgtcatcctcttcacacttgagacgactctaccagaaggcggatgatgggcgtccctttcccccaagttatcaaatccaagggcggtgttgtggtggcatcataggtacgacaagggcgtggttccccctggcagggacaaatgggagactacatccaatggttggatgggcttgtctgagcgctgtgcccagtacaagaaggacggagctgacattcgcaagtggccgttgtgtgcgtgaagatatggggaacacactcccctcagccctcgctcatcatgggggacatctgcccaatgttctggcccgtttatgccagtatctgaacagcatcaatgtgcattgtgccatcgtggagtctgagatcctccctgatggggaccatgaattgaagcgctgcagtatgtgacgagaaggtggtgggtgtgtctacaaggtctgagtgaccaccacatataccgggatgcaccttggtgaagtcacatggtcacccaggcatgtttgactacagaagttctctcatgaggagattgcctgggacgtcatagggctgtgccgccagtgccccccgatgtacttggtccctctgtctgagcaacgtgaggggggttcatcagctcagcgatacagaggcctgtgacccgggctgactcccaagcagagcgaggttgcggagtgggaaggatcagggcgggataaaacggcaaggcgaaaacggcgggggtgaccacataacgaagtggccacagcccaaaggagggcaggggtgccacaaagtagaac

SEQ ID NO: 499165 - DNA, 451 bp, Homo sapiens
gggaggaatactatttgcgctaaaatatgaaaatactgatggtaattgttttttttgtttggtgtttttttttttgggagatggagtctcgctctgtcaccgggcaatgggcgccatctccactcactgcaacctccgcctcctgagttcaagcaattcttgtgcctcagcctgccaagtcagacctctaaaatatctaagtcctttactgtgtatgacccatttaaattatttaaagtcccttaagtaaagatccacaaaattgtatagaaatatattgtataaatttatcactgaaataaaacaggaagtaggttggtgacactgttatctattcattcatcttacctagcacaattgagtttatatataaggatgaaagctctttaataataaataggtgagctggtgccagtcttcaggccaatagttagataacactgacaaagca

SEQ ID NO: 499166 - DNA, 223 bp, Homo sapiens
ttagcttaaactccaatacagatacctaacttacaatggggttacatcctgatgaatccttcataaatttaaaatatcctgagtcaaaaatgcatttaatacacataaacctactgaatatcacagcttagcctagcctaccttaaatatgctcagaacacttacattagcctacagttgggcaacatctaacacaaagcctatcttatagcacagtgttaaa

SEQ ID NO: 499167 - DNA, 176 bp, Homo sapiens
tgaacagataggagacaatgctgggtaaccagctcttatgaactcgttgacgctgaggctatccttccggccctcctgcctatgacaaaggtgaagaaggtggtgaccacggtctcaatggactcctactagctctgtcagatggttctgctgcatttttcaggggggaacagggc

SEQ ID NO: 499168 - DNA, 105 bp, Homo sapiens
gaccaggctaattatacaagctcatctgcctacgacaaacagacctaaaatcgctcattgccatactcttcaatcagccacatagccctcgcggttataatgctt

SEQ ID NO: 499169 - DNA, 318 bp, Homo sapiens
aatgcaattcagctctgggggcttagtggctagctctagagtgctggaggggacttcacccctgtctaaatccttctagcacagcactttggcgtgtgccaagattccagcctgactgcaaggtgactgtggttgctaacacggcgaactcccggaagagtaccttggtccagccagtgagggctgctcccagagctgacttccctttcctccctatcgtgggtttaccccactcgggctttgtgtccctgaggagcgcatcttccccaatgtgcatgcgcatcaaagcgtacctactctagactcaatccagctata

SEQ ID NO: 499170 - DNA, 700 bp, Homo sapiens
tgtggtggctcaccaccacgccccggtaatataattgtattctaagtagagacggggttatcaccatgttagccaggatggtctcgatatcctgaccttgtgatccacccgcctcgtgctcccaaagtgctgggattacaggcgtgagccaccacacccggtcggatcttaatagaatctttaaaaaaaatgtattcatttatttttagagacaaggtctcactgcatcacccaggctggagtgcagtggtgtgatcatagctcactgcaacctcaaaattcctgggctcaagcaattctcctacttcagcctcttgggtaggtaggactacgggtacacaaccaccatgcccggctaattgtttaattttagagatgggggtctcactgtgttggccaggcatggtctcaaactcttggtctcagatgatcctcctgtactcagcctcccaaagtactgtgattacaggcgtaagccaatgtacgcaagccttaatagtattattaatatcctttaatgtagtcctcaagaattaaagtgcattagttagtcaatattgccttaaaaatacattaaggtgattatgcagttcttgcatctgatagccctagagctgaacgtagccagatggtggcaatccttggcatacacatagcaacactcattgaatacattgggattcaaggcaattcttcacca

SEQ ID NO: 499171 - DNA, 1050 bp, Homo sapiens
gcacatatttccaaattatatggtggtcctcagaagtaggtgataggaagaaatacttctcaagggtgcaaacaatgcagagtaatacaacttttaacttggaggaagcacaaccatactccaagaaagcatcatcaacatcaccaccagcagcagacaccaccagcagcaacagcagcagccgacgaccaccgccaatacctgcaaatgggcaacgaggcctagcagccaatgatgaaggcttgcactgattggacctgacagcaatcttgcagcaaacacccaggagagcacgaccttccaccccaacgaagccgtctctctcctgtcgggaaatcttcctcccgacattcactgagcgcaaagaacatggaggaacctcatcctcgagccatatggcaacaggccagggcgaccccgttccacttcataagtgataaaaggatttggcttcatccagctcgggacaagccgaacctctagcggcgcatcgccacaagcgggagctggacaaatatgccactccgtggcaacagcatactggcgtgtgcgctttgcctgccatagtgcacacccttacagttcgaacaccttcctcacgtcatgcgtccccacagaactgactggaagaacgcacctctgtgtcaaggccacagtagagaccggccggacccacgtgcgggactgaagccgcgcgaacgcccaccaggccacggccactcgagaccgtgctaagcgtaagcccagctgccaaggaacgcctctgcacggcatggaggagaaaagcgccttaccggcgcacagcaatccatgccctgaggaaatggacgacaacggacagagctcatgagaagaaggactcgtccgaagcggatcctgcaaacccgcactccaagcgacgcgacaccacgcaaacgccgaccgtccgatcgagctctcatctcccggcacgcactgagctaaccaaccacacgctcacccatgcgtccacacacaataacaccgcccgccacacacacagagcaacgtaactagacacaacaataagac

SEQ ID NO: 499172 - DNA, 861 bp, Homo sapiens
  misc_feature (311)..(311): n is a, c, g, or t
  misc_feature (655)..(655): n is a, c, g, or t
gacttttgaaacgcttggggggaagtgctgtggagccgctgtggttgctgtccgcggagtggaagcgcgtgcttttgtttgtgtccctggccatggcgctgcagctctcccgggagcagggaatcaccctgcgcgggagcgccggaaatcgtggccgagttcttctcattcggcatcaacagcattttatatcagcgtggcatatatccatctgaaacctttactcgagtgcagaaatacggactcacctttgctttgtaactactgatcttgagctcataaaatacctaaataatgtggtggaaccaacntgaaaggatgggttatacaagtgttcagttcagaaagtggttgtagttatctcaaatattgaacagtggtgaggtcctggaaagatggcagtttgatatggagtgtgacaagactgcaaaagatgaccagtgcacccagagaaaagtctcagaaagctatccaggatgaaatcggttcagtgatcagaacagatcacagctacggtgacatttctgccactgtgtggaagtttctgtgtcatttgatctgttgatttatacagacaaagattttggttgtacctgaaaaatgggaacgagtcgggcaccacagtttattaccaatttctgaggcaagtccggcnttcgttcatttactactacaatccacaaagtaaataggcgtggtgcctaaaaaatttctgtcaatgactggggcgcactgtggaaccacttcgtctggcatagcaaagtgtgtccgacaaccgcatcaatacgcggaggcgtaccctgcgcttcttgggcaccccagtgttttggcgggtgatgcccatatgccaatactacggcc

SEQ ID NO: 499173 - DNA, 334 bp, Homo sapiens
  misc_feature (44)..(44): n is a, c, g, or t
  misc_feature (96)..(96): n is a, c, g, or t
cgcgtgctttgttgtgtcccctttgggccccaaattggcctgcnttgccagtcatccttccccggggtatgcagggggcaaaatcaaaccccctgnccgccggtggagcgccggaaatcgtggccgagttcttctcattcggcatcaacagcattttatatcagcgtggcatatatccatctgaaacctttactcgaaggttgccaaggaacacattaacctggggaaccttcaaacccctttggccttttggtaaaaccttaacctgggaatctttggaagacctcccaattaaaaaattaacccttaaaataaatgttagggtgggaaaaca

SEQ ID NO: 499174 - DNA, 180 bp, Homo sapiens
  misc_feature (26)..(26): n is a, c, g, or t
agttattttattgttcaagagctcgnatggcaagcattaaaccaagcatgggcttggattctgtgagcccaaattcacatatggaagaagatcaaagcaaacgggtgatccagtgtacatggatgacaaactaaaggcttcgagttaactcacgatgtgtgagtttcttaaagttctctc

SEQ ID NO: 499175 - DNA, 274 bp, Homo sapiens
cgttgagatacaggccatggccggtgctcatctgtacatgtccgtcagctaggtcaatagcattcacaacattgtgccagccatcatgactgtcaagtattcctacctcagttagagtatatcctggatcattcaagattgcatccttataagcagccttagtccccaaggcgatcatcgctgaagatgtagcagtgcacgcagtcgacactgagatacaggatcagaatgtatagtgtaccagccgcttgtatggtattacggccaatttatc

SEQ ID NO: 499176 - DNA, 617 bp, Homo sapiens
  misc_feature (3)..(3): n is a, c, g, or t
  misc_feature (99)..(99): n is a, c, g, or t
  misc_feature (303)..(303): n is a, c, g, or t
  misc_feature (409)..(409): n is a, c, g, or t
  misc_feature (413)..(413): n is a, c, g, or t
  misc_feature (417)..(417): n is a, c, g, or t
  misc_feature (592)..(592): n is a, c, g, or t
  misc_feature (613)..(613): n is a, c, g, or t
  misc_feature (616)..(616): n is a, c, g, or t
aanaggaaacccagatccctgcccctcctctggaagagggggcctgggccaggaagccccttccataggtcccagcagggaggagagtggacccctctntgcccagagagcaaggttccaggctccaacaacagaaagaacatgcagggaggagcgggagcagaggcctgtggctatgggggaggaaaagtgggaggaaagggcactgcctgaggagtccgggagtttgggcatcccggggatgcacgcaggagcttccgggcataaggggcctgcccctggctggttagcgcttggacagcncgtgggaaagcaagttcagaccatcgtacagacctgttctttgggtggaaaaggtggcctggacaaaccaagtgcggttgcgtaagtcctgttgccccagcttgtnagtnagcncgctcacgggcatggggtggggcatgtcctgcttgttggcaaaaaccagcggccctccatcccgcagctcgtcctcctgcagcatcttctggagttcatcagcagattcttggacccgctcccggtcataactgttcaccacaaagatgaggccctgagtgttctggaagttgtnccgccacaaaggccgaatctngtnc

SEQ ID NO: 499177 - DNA, 958 bp, Homo sapiens
agtaccggctgtagtggcctggggccgtggcgggagagtcatgtcatgagccgcagccgtggggcgcagagcgcggatctctaccgggacacgtgggtgcgatacctgggctatgccaatgagggtgcgcgaggtttccgctctcttgtgccagcggcggtggtgtggtgagctatgggcgtggcgagctcctacgtgctggcgggatgcattgacaatgggcaagacgggctggagaagggtcggtggatttcctccgtgactccagcctgcgcaatctctacccaacaggtggggggaagcccagctcctcttgatcatagctcttggtacctggcctgtgcaattcggcctccttgttacatgtcaagctcatacttcttgcaaagtgattgtggaacacctggctccgtgtgttgtccaaaggacccttgtgcaccgtgcgtgggtgtgagctggacagaagctaagagaccaacgtgctcaaggacgcaggtggctgcagggagtcacagagggcaggacctgagcgctgtgtgctccctggaattccaagatgctgacgtgaaaggtgaccccttgtgtgggcccggaccgtgtctttcagggaaaatgtaacattccctccccattggaggcttgagaggacttgctgggctcagggggagggcaacggtaattagggcccaaatggattcagtttggcaacgttggtcacccagtggacccccaggtgtgtttgaaggatttctcccccctttgttgttttggcgtactcgtgggccgggggacactcacgtgcaacccccgcaggtgggtcacagggaccccttggaaaaatttttggcggggccttccggagcaaaaatcgtccggtcaaagaaaaaagggggcgcaaaatctcagggcagatatgcacgcttttagaggccggagcataacagggggcaaggtgacg

SEQ ID NO: 499178 - DNA, 434 bp, Homo sapiens
  misc_feature (1)..(1): n is a, c, g, or t
  misc_feature (30)..(30): n is a, c, g, or t
  misc_feature (32)..(32): n is a, c, g, or t
  misc_feature (56)..(56): n is a, c, g, or t
  misc_feature (58)..(58): n is a, c, g, or t
  misc_feature (60)..(60): n is a, c, g, or t
  misc_feature (62)..(62): n is a, c, g, or t
  misc_feature (152)..(152): n is a, c, g, or t
  misc_feature (175)..(175): n is a, c, g, or t
  misc_feature (181)..(183): n is a, c, g, or t
  misc_feature (214)..(215): n is a, c, g, or t
  misc_feature (218)..(218): n is a, c, g, or t
  misc_feature (220)..(220): n is a, c, g, or t
  misc_feature (238)..(238): n is a, c, g, or t
  misc_feature (272)..(272): n is a, c, g, or t
  misc_feature (290)..(290): n is a, c, g, or t
  misc_feature (295)..(295): n is a, c, g, or t
  misc_feature (309)..(309): n is a, c, g, or t
  misc_feature (312)..(312): n is a, c, g, or t
  misc_feature (316)..(316): n is a, c, g, or t
  misc_feature (320)..(320): n is a, c, g, or t
  misc_feature (323)..(323): n is a, c, g, or t
  misc_feature (353)..(353): n is a, c, g, or t
  misc_feature (355)..(355): n is a, c, g, or t
  misc_feature (370)..(370): n is a, c, g, or t
  misc_feature (376)..(376): n is a, c, g, or t
nggagcggccaagtgtacttgcggaactgntntggatgatgagcagcccctgcgcngncntncctggcagggccagtgacaaggccctgagctttgtcctgaaggaaaatgactctggggaggtgaactgggacgccttcagcatgcctganctacataacttcctacgtatccngcagcnnnaggaggaggagcacctccgccagatcctgcnnaantnctcctattgccgccagangatccaagaggccctgcacgcctgcccccttggngacctcttgtacccccangtggnaggcagacagcagncancgcnaagngcntgccgtgtgagtgtgacagggccagtgggncntgtggaatgagtgtncatggnggccctcctgtgctggggggaatgaacccagagaacagcgaagtaagcttgctccctg

SEQ ID NO: 499179 - DNA, 815 bp, Homo sapiens
  misc_feature (553)..(553): n is a, c, g, or t
tttgcccaccggaccataccctgccgccaacccggtcccgggtccgggacagggcagtccccaccgggaggggagcccctaaaggagccaggagccccggacgcagaatgcgtgaatggaagagaactttccgttgaactgcgtaactaccaagaacactattgcgcgcccgcaggatgagattccagaatatgaaggaggaaatggctcgtccacctcgggataacccacgacccgctcacaagttaagatggccctgacctgagattgccacctacagggagctgctggaaggcgaggagagcacggatttctctgcctcttcccaacgtttcctcctggacctgaggggaactaatctggattcactccctctgggtgatacccactccaaaaggacacttctgattatagagcggttgaaaactagagaatggacacggttatccacgagaacttctcagcatcacgatgaccctggataaaaattgcacaccactccagtgcagccatatattacccgccaggattaaaaaggaatcccatatcttanagaaaccagctttcaagtgcccttctgccagtttttcaggagcgccagatagatttgggatagggataagctctagtttttaccaaccggcactcctaccagatttaggaaaaagtttaccacataatttaggttaccaggaaaatcttgttgctaggatacttttttaaaggtattttggatacccttaaactgcttttttttttcccgccagtatcccacccacttgtttctgcttccataaatctttgggaaaactcca

SEQ ID NO: 499180 - DNA, 891 bp, Homo sapiens
  misc_feature (534)..(534): n is a, c, g, or t
tttgcccaccggaccataccctgccgccaacccggtcccgggtccgggacagggcagtccccaccgggaggggagcccctaaaggagccaggagccccggacgcagaatgcgtgaatggaagagaactttccgttgaactgcgtaactaccaagaacactattgcgcgcccgcaggatgagattccagaatatgaaggaggaaatggctcgtccacctcgggataacccacgacccgctcacaagttaagatggccctgacctgagattgccacctacagggagctgctggaaggcgaggagagcacggatttctctgcctcttcccaacgtttcctcctggacctgaggggaactaatctggattcactccctctgggtgatacccactccaaaaggacacttctgattatagagcggttgaaaactagagaatggacacggttatccacgagaacttctcagcatcacgatgaccctggataaaaattgcacaccagacgccgtggcacggcgcacatagagttctgcgccnggcacacagagagatatatagaaaaagaggaaagtccgcctattttcttaagaacaccagctgttccaagggccctttctgcacaggttttcacaggaggcggccacggaatatagatttcgggaataaggaaataaaagctctaagtttctttaccaccccggagcacctccttagccacagaagttttatggggaaaaaagggttatccaccacaaaaatctatggttaccaggaaaatcttgttgctaggatacttttttaaaggtattttggatacccttaaactgcttttttttttcccgccagtatcccacccacttgtttctgcttccataaatctttgggaaaactcca

SEQ ID NO: 499181 - DNA, 443 bp, Homo sapiens
caggagcttgtaattctgcaccacttggaccagcccattgggagttacttcagccgaagccgggctgtggataatcaggtgatattgtggccacatgctctctccttgtcccggggatgactaaaggcctcactatgttgcactggtgggacagcagcaccggtggtgaaccctttggggggacggttctagccaaaggctggcgcagaatgaagcaagcgtgtattcagacatagacctgaagaagctggctgaaatgcgccgagcaaatccccgtatattaagacagaatgctgatcagacctctagtgctgtggagatgaagaaagccctaaagtttatgtatctaatgtgtcactagaagtaggaccgactatgattctacaagcataatcaactccctattaagttctttagatgaatgaaaagacaataaaaattcg

SEQ ID NO: 499182 - DNA, 528 bp, Homo sapiens
ttacgattactgccagcctttcctttttcttttttggtctttgtccgtatagggctgaacccacggcatatggaagttcccaggcgaggggtcgaatcagagctatagccaccagcctacgccacagccacagcaacccgggatccgagcctcatctacaacctacaccacagctcacggcaaagctggatccttaccctactgagcgaggccagggatcaaacctgcaacctcatggtttctagtcggattcatttccgctgcgccacgacgggaactcccttttcttttttctttacctactttactttatacagtacatgacttacacataatgtaatatacctttctctctctctctttttttatatattaggggcctttcaggggctgcacccacagcatatgggggttccccaggcagggggtcaaatcagagctgtagccacgggcctacacaacagccacagcattcgagattcggagccatatcctcgacctacaccacagctcagggcaatccgggat

SEQ ID NO: 499183 - DNA, 363 bp, Homo sapiens
  misc_feature (26)..(26): n is a, c, g, or t
gggagaccgagccttgctctgttgcncaggctggagtgcagtggtgtgatcttcgctcactgcaacctccgcctcgtcggttcaagggagtctcctatctcagcctcctgagtagctgggattacagtcgcctgccaagagatggggtttcgccatgttgaccaggctggtcttgaacacctggcctcaaatgatccactcgccttggtctcccaaagtggtaggatgacaggcgtgagccaccgcgcccagcctcttctattcttttagagacagggtctcactccgttgcccaggctggagtgcattgatgtgatgtgtgatcatagctcattgcagccctgaccatccgagctcaagcaa

SEQ ID NO: 499184 - DNA, 1095 bp, Homo sapiens
  misc_feature (279)..(279): n is a, c, g, or t
  misc_feature (403)..(403): n is a, c, g, or t
atcgacgaaaagaaccattgtacaagaatttggagaagtgaggctgctgacgatgggaaagggctccttcaagtatgcctgggtcttggataaactgaaagctgagcgtgaacgtggtatcaccactgtgatatctccgtgatggaaaatttgattaaccatgcaagatacttatggtgtacgtatcatttgagtgccccaggagcacagagactgttatcaaaaacactgtattacagggacatcctcacggctgtactgtgcgtgtcctggagttgntcgcgtggcgtggctgcttgggtgacatgttgcatagactggttatcgtccacagaaactggtgcatgcacccgacgtagcatgtccctttctgcgtcttacacactggcgttgtgcaaacaanctaattgtcggtgttcaacaataactggcattgccacgtgtagctcatcgccttactaggccatgaagaagcatatcgagggataacttcgcttaagggatatgtcaatgtcacgtatacgaattataggacataattggtggcgtagctaacccccagaacacgaaagtactcactccatgattgccacacatatcttctagcgtttgtggcaacttgtggtggaacaataacaatgtcataggaaaagacccaaaagattggcctaattagccaattgctcattatgtcgtggacaaaggggcgaattgcggcaaaatgttgccaacccccggttaaaacggggattggggcaaaattggcgccaatgttcgggaaaacccagctggtcataggctttagaaagcagttccctaggtaatcctttaggcaattacccttatcacaactccataaacttgccgattccctagagggttagtaacaaaaggtccgcacttttggcacggcctctgtagccactttctttaccccaaagggaattagggtcttaaaccaaaaatatcttcgggttggacggtcacatttggggcttaaacctgggttgtgccccctagatatcggcgccccagaaggttggggcaaccaactttggcgtagagtttcatttcaaaaaaagcccccggggcaag

SEQ ID NO: 499185 - DNA, 311 bp, Homo sapiens
accaggcggaagaggagcgtccagtaagggggcaccttggcggactcctggagccccgttgaccaccgagattgtgattagcttcttgaattcacaacagcacggagcccaaagctccaacagcgccagggccgccaagcgggccggcacaagcataaaagaaggaaaaggagaaggcccagttgcagcagagcttaaagcaggcaaactggttttttgaagccggagccaagccttcaggagagcctttgagttgccgaccggaacttgactggatacagcatcctagcagcgcttcagagactaaacac

SEQ ID NO: 499186 - DNA, 224 bp, Homo sapiens
gatcccaatgccatcttcctgagcttccaacacctgctccgaggaaaggggcttctggattgttggagacaaacttcactgcctcagccagaacaactgtctaaacttctgaagtggcagcagggattcagagccaagattcctgggctgctgaaccaaacctccaaaaccctgaccaaaaatacccggatacctgaacagatacacgaactcttgaatagaac

SEQ ID NO: 499187 - DNA, 307 bp, Homo sapiens
aagactcctagtgcgcacactgtcggcggctgaacagggagcccaaggccagcaggatgccgggtgtagaccgaggccttggcgaaggtggtgtacggaatgacatactctgggtagacctggtgtttctcaaagatcacaaagatggagggatcggacacattgttcacgcagcttatcatagaaggcgttgtccagccctccttgggcggcggacggacaataggaggcattggccccgtaaggaattcgcccaccagcacccgggccaggaacattcgtgtggagtctgcgtgtcggattggca

SEQ ID NO: 499188 - DNA, 698 bp, Homo sapiens
  misc_feature (1)..(1): n is a, c, g, or t
  misc_feature (47)..(47): n is a, c, g, or t
ncaaccccatggaccaagtagaaagctagatcagttcaggcgacttntactagcaataaggtctcaaacagtccatgccaaagttcatgaattaataccccaagagtctaaatttactgaaaaatgacgtgtcataccagaaccagtagcacctctacctgaattagcaatgcagtcaagcatggcttcgtggctcattcctgtaatctcagcactttggtaggctcaggtgtccggtaggtcaggagttcaatcccagcctgggcaacatgatcaaactggctctctaatcaaacttgacagcattccgtatgagctgtctgtagtgcctggcacctgtagtcacagctactcaagaggctgaggcaggagaatcgcttgaatccagcagtcagaggttgcagtgagcccagatagcaccattgcactgcagcctgggtgacagagtaagcctctgtctaaaaacatagattgcaggttcatgagtcagactctctgggttcgaatctcagctctgtctttaacttgcccgataaccatgggcaacttccttaaggaattttctcagatgtaaaatgcggatgagtacagtaactacttcctcaggctgtcaggagtacatgagataatgtttgttaaatgcctctcgcaatgtctggtcaatagttaatttataaaagcagttacctccaccacca

SEQ ID NO: 499189 - DNA, 155 bp, Homo sapiens
gccagtacggatgtgcgggccagtacggatggctatggggaagggaatgtattagtaatgcatgggggagaggatgccagcaggcacctcagaggtgacatggacaggctgtaactccccatgcttactaatacattcacatccgtagcggctcg

SEQ ID NO: 499190 - DNA, 188 bp, Homo sapiens
gagctggcccgcggttatgtttacgggggacaggcatgccgtcagcatgggggtctgccgggtgcatccgctgaccagcctgcgtggacgtgcgcctgcatgcgtgtcatgcggcatgtgtttgtgtgtcagtgtgtgtgccggcaggcgcacacgtgtgtgtgcttgtgcgtaagacataaccgcgg

SEQ ID NO: 499191 - DNA, 471 bp, Homo sapiens
  misc_feature (8)..(8): n is a, c, g, or t
  misc_feature (425)..(425): n is a, c, g, or t
aacggggngacaattcgcgcagccgatcgcacaacgcttggaatcggcgctcgtcttgttcgacgagttgtcccagcgcgctgtagtgcgccatgcgcggcagccgcccggcgagcgcggcgccccacctgatgctcaggtcgtaaacccgttcgtcatcgacgtcctcgcgccccccgagtcgttcgagcgcctcgatctgctcaccgacgaacgcaaggtcgtcagtgatgtcgatccgttcccggccgggggatgccacgctgcggcggataccctgccgcggcctcggttacacgccgcgccgcggcaggggcgcgagatcaggccgagacgggcttcttggcggccggcgcggacaccttcatcagcttcatcaggttgccgcccatgatcttcgccttgtcctcgtcgctgaaatcggncagctcgtcgacgaagctgatcgggtccttcaaaccctcggggtgc

SEQ ID NO: 499192 - DNA, 842 bp, Homo sapiens
  misc_feature (686)..(686): n is a, c, g, or t
  misc_feature (750)..(750): n is a, c, g, or t
  misc_feature (754)..(754): n is a, c, g, or t
  misc_feature (770)..(770): n is a, c, g, or t
  misc_feature (777)..(777): n is a, c, g, or t
  misc_feature (780)..(780): n is a, c, g, or t
  misc_feature (789)..(790): n is a, c, g, or t
  misc_feature (794)..(794): n is a, c, g, or t
  misc_feature (798)..(798): n is a, c, g, or t
gcacggtggcttggcctgctgtttgggcctcttgctccccgggatgccagccgccatgttgtgaggacactcaagcagctgcagggtgagaaaccgacacctaacaaccacggcctggtccacaggatcccggggaagccgtttctgaattcctgaactacagacaccgtgaagtcatgaatttgtttagtttttggtttttgaggcagggtctcgctctgttgcccaggctggagtacaacggtgcgatcacggctcactgcagcctcaacccctgggcccaagccatcttcccgcctcagcctcccaagtagctgagactataggcacgcaccaccacgcctggctaactttgtaattttttgtagaaatgaggtctgtgttgcccaggctggactcaacctcctgagctcaaatgatctcctgcctcggcctcccaaagtgctgggatcacaggcgtgggccatggtgcctgtcatgaggtcttcactgttgggttgagactctgcatttggaggtggtttattaggcagcaatagagaaccatggcagcaaatgttatcatttctgggatactgagggtaagcgtggctgtcatccaggaacaggctagaaggagactctggaccccgggccgtcagggctgagtgaccctcatccgtggtacctcaaggctctctggaatnctggggtctctgttggacactctgcgtgacaccctgtggttcctggagaaccctcctgctgggntcancacacggctcgccggnggcagangancacaatggnntganaagnagagcgagggggaagacatacaagagacacaccaggaacaggga

SEQ ID NO: 499193 - DNA, 256 bp, Homo sapiens
ggagtcagcggaggctccgtggccacccacctccgttcccaagcagaccatggcctgaaatctctcgttcacaggcactctaacagcccacactggtagtccagaagctgaaactcactagaagcagctaagttgatatctacatgagtacagaaaagtcacttggcctctctgaatctcagtttgctcatctatcaaatggaaccagcaggaagtagggcagtaaatcattattcacacaagctccatttctctg

SEQ ID NO: 499194 - DNA, 1248 bp, Homo sapiens
gacgtcgtttgagtcgtactgctgcctgctgacgctgccactgccactgccacctcgtggatcatggagccagcgttgttcgcccgacgcctcgctgccgtgtggtgatgggaacgctgagcatggtgaatgccgcttgcggggttttgtcgcctgcttgctcgctccagcctgactggtatgtgccgagccccgtgtccagtctggtacgctttgccacctgatctgtagcctgttacccgactgtggtctgtcgacttgtctgccggccgcgggacgaggcttctgctgccattggctctctggcagcccgaattcgaaaacggtgactgcacctatccaacgaggccagttctcaatgacagacaggaacgcgtcccaattcgcgttaactctggttgatgaaggcccatcaagtgagtgacaatcagtcgtggttgtcctttgtacccaggtccgcaaagatggcatgcaactttgcacgattcgttgccgacgggtgaccacacggttgtttggctgaatacggaaaacgcacagacgaccccactgaagccttgtattgcagtccggcctatctcgtggatgaatacctcgcttcctgactgcagacacgaatatcgggaatggcaataggacgtgtgtatccgcggaattataccgtttctgatggtatacaggccatatgggggacttgctcaaatcaaggccattcccatgtctccatttgcccctgaattgctgataagcttaccgtgggcaaaagatccgttagttccccagtcgcttgcgcataggcgctcaaatattcgatttgacccaacgaccgctgggaaacaggcggcctactttaccgctcgcggttacaactccattcattatccaggaagtggaaatattaaccccgttataaacggccccggttcaaccagtttccccttgggtcaaaacgcacggataagtttcggagagccaccctatgttccccgcaggcatcaacagtgcgcatcggcacgattatttgtagtatccattgtgggctccccctggctgtggtgcatatgcagggagacagttcgcacaggctttgaacattcggtcggcgcgaaactgttcctcgcatcagaagcgcttggagctgctcgcggccaacaaacgcgcccgtacagtccccattaacgggccccgcgtgctaagcttagtgcacgattttgtggatatagtgtcccccaactgagactcaatcag

SEQ ID NO: 499195 - DNA, 177 bp, Homo sapiens
acacagtatggtagcttacgcacaccattggatacctcagccaagcacatacaccagaatgacatagaaccatagcggtatcctctacgtactagagcaggattaccatggcaacaacacatcatcagatagggtaaaacataacctgtctcacgacggactaacccagctcacgtt

SEQ ID NO: 499196 - DNA, 343 bp, Homo sapiens
aaggtcggggtatttttccgtctcaccaattatctttttacacacacatccagcgtacgccctcatttcttgtccatcgcccagaagctgattctcttgctttttctttcttgaatggcagcagccacgtccaagggctcccactgcatttcacgccccagctgacaaccaactggcgcgagtgaggcaaagagagaaaaggagagaacacaaacttgtggctggagagtagaggctgccacctgctccctatggacatttgcacatgctggtgaatgactggaccctccaggaatagtgccctgatccatagccccaaaaatgtatccaagtggagaacatg

SEQ ID NO: 499197 - DNA, 149 bp, Homo sapiens
ggtttgcttaggcgcagacggggaagcggaccaaacatgccagtggcccggaggctgggtttgtcgcaaaacttatgttgaaccccggggagacccttcgaagaaatctcgtttcggaccaagagctgaagctgtatcggcgagtatgg

SEQ ID NO: 499198 - DNA, 214 bp, Homo sapiens
cggcgggctgagtgttgtcatgtattccatattcccgttcctcctacacaccccagttcaaaggtggaacccaagggtgatgggattggtcccacccgaccagccccctagtcagtgcttgggctaccccaaatatcagaagtcgttgcctcctacgtttccagcgagcagcagcgaggagcagctcctgatagcagcagcatgcagcacctag

SEQ ID NO: 499199 - DNA, 260 bp, Homo sapiens
tttcgtatccagcgctggacgtaatacgggcctgttgtccctgaggccacacgatcactgtgtctctatgatgccaagaaggggtcctctgggaagacgtagaatggccggagacagagaagcccacggagttcccaggtgtggctgtgtagggaatgtcctctgagtgggggatgtgcaggaagcccaccgtaacccaggccaccaggtcctcattttcaatgttctcgttgtagtgaaagaaacttgctcaaagaaca

SEQ ID NO: 499200 - DNA, 415 bp, Homo sapiens
ctctagagtatccccgtgtgctctggacacctttgctcaaatattacctttccgttagctacctccctgtcctccctggctagagtcttcttatccttttctagctcattgcactgtctctttccttgttattttcttgttcattcataggtgggtgtgtctgtggtctgcctccccagtgtcaaagacaagctccacgaaaacagggagctttttcgacttcaccatttcatccttagtaactggataatgcatggcatatagtgggctcttattaaatattttaggaaataagcacataaggaatgagtgaattggtgagttatgttgtcccagagaggttgcctgcaccatatataactagtcatgcatgtgacctttgaaaccatagctagtaatggctattttttgcact

SEQ ID NO: 499201 - DNA, 134 bp, Homo sapiens
catgaagagtttgtgttgttatgttgttagtatcacaatcctcaaacctcctgccgcccaatatcgagtcaaaaagaaatacactaaggccaaggccaccttacatacaacgatcaatcctggttgatgcgctc

SEQ ID NO: 499202 - DNA, 362 bp, Homo sapiens
cgtgaaagatgcgacaccggcagtcccacactctgtggacgatggtcgaactcccgcccagcatgattccgactcgcgcctcggaccggttggcgagcgccaaccgcggtcaaccgtcgttcgaaggtcgtcgacgcgccgattgaggaaggtctctctcatgccgccccagcccacggtgaggccccggaaggtgttggccaacacttacactcccgtcgtccaccacgtccggaccaagcagacattgcatatccaccggctcgacaactagcggtaggtgacgctcctcccgatcctcccgtggatgcagaatcatttggccaattggacgtcacgcggcgtgcgtaggattagacttc

SEQ ID NO: 499203 - DNA, 356 bp, Homo sapiens
aggactttgggttcctgctttgttttggggtccaaaccttggtttccctttggtcctggtgggagctccccctgcctttttcccctatttagctccttagcaaaaagaccctggcctcccctttgccctttgggtccaaaaaaggaataaaaaattccgtggccttgggggcaggaaaaagcccctctccatgaacacttttccagccccctcatacccccttcccagggtaagggcccccgaaagcccagtccccttttcgcctcggtaaaacctgtttgatgccccagattttatttattttcccctaacccagggcaatgtcagcttttggcagtaaaggggcgctccaacca

SEQ ID NO: 499204 - DNA, 465 bp, Homo sapiens
agcgggcggcgatcgaggagctctgcggacgccaagctgcgcgggcagaagcggtccggggcctccggggcctccgcggccccgcaatctccgcgaggacgcatgcgttgaggtacccagcagcagccgggacacggagcacctggtagccagagcacgggagcgagagagaaaggcggtggtagaagcacagtcgatcggaggaagtcgcaggactgaggcgcatcgagaggcagcgtgtcccgaggaggatggtgcccggggggaaaaccgtcagtccggcccgtagaggcctggagggtcgtatctcccgaattaccgtgcgggcagagcgtagcggagaagagtatccgaatgacgtcgcgagacgagtcgcttcggaggatatgaattcatggagagcgatggttctaagcaagagtggatagagacttgttgacaagtgacaatagactataattagat

SEQ ID NO: 499205 - DNA, 249 bp, Homo sapiens
gcaatcctcaaattctgtccacatgtaagaaagggagcatctcaaaaccatgaggaagggcagtgtgtgcatgtgcaaggatatgtcttctggatcagcaaacactccagtatgcatatctatcagagtgagtgtgtgtgctgaatggactgtcagccccaagctgtctgtcctgaatatccgtatgtcctcatgaatgtctctgtcccttaaatgccctaactcacctatggctgcgtctgagtgatc

SEQ ID NO: 499206 - DNA, 369 bp, Homo sapiens
tggcatgtgatgaggcatggatgtttgcacagacgtcactattcctgatgggagacaggagctggatctgggatcagcagtctggacgttacagctcatggcacaactggcagaaggcgctggaatccaactgccaagcactgctgctgctgctgccgacgacgacgcccaggctgctgccttgcaactgaatggagcagttcccttgggtggcctgactccagcagctctgactgctctgagtccagccctgaaactttcctcccaagtgtagcagctctccagactctataccccccagaccatgtaaatcagtggcacagtatactgactccttgtgcctctggatcctgacaataaaaatctact

SEQ ID NO: 499207 - DNA, 210 bp, Homo sapiens
  misc_feature (31)..(31): n is a, c, g, or t
  misc_feature (66)..(66): n is a, c, g, or t
  misc_feature (70)..(70): n is a, c, g, or t
  misc_feature (183)..(183): n is a, c, g, or t
caggagggctggttccaccacctggcccggnatgccgtggcctgcttcctgacccgcggggacctntggntcagctgggagagcggggtccgggtatttaatgagctgctcctggatgcagatttaagcgtgaacgcaggcagctggatgtggctgtcctgcagtgcttttttccagcagttnttccactgctactgccctgtgggtttt

SEQ ID NO: 499208 - DNA, 104 bp, Homo sapiens
cgctccatcttacgattatacggtgctcacgtgtcgagcggaacttgtacagggaggcatgcaccgcagtggtgaatacacgtcgacctggatccatgtttgcg

SEQ ID NO: 499209 - DNA, 127 bp, Homo sapiens
gatagaggatacctaatacagtgtcgtgaagacacagcaggacggctgggagggagcacctggcacacgtaagtgctccatcagcatcagctgctggaaggattcattcaatttctgcagggtgcag

SEQ ID NO: 499210 - DNA, 390 bp, Homo sapiens
gttttgtatgatgcaacctagagccgactgcctcaagggaggctgtctagggtctgaccccgacattctctcccccatgcagcctctccctggggcgccctaagcagttcaggcacctgcaccctgacccttcccacacagtcctgtggagacatgcacttaaccacagtttccaggaaagaaggcatcacccaagagggcaccccgggctgcagaattagggcaggaaagagtgcccttcactcaatacccggaacagagcacggggtccaaggatcaagggaaatgggcacgagacatcagttctgaagagaccagagctggaaatagtcctagatgaggcccctcgggtggcccggagaccaccgggtttcccttttgactctaatt

SEQ ID NO: 499211 - DNA, 139 bp, Homo sapiens
cagtcgcaagtgtggaaccataagtacagaacgaagggaaaacaaaatctgacgcattttctcagagttaggattgttcttttgaaaatcttgggccaatctgggatgaccgagatttgtatcctcttaccagtttttt

SEQ ID NO: 499212 - DNA, 103 bp, Homo sapiens
cagatcatagctaatcgacactcttctatatcatatgcctttacaatatatctatcttagtaagcagtataacaaggctgttcttggtatgaacaacagtgca

SEQ ID NO: 499213 - DNA, 1258 bp, Homo sapiens
gagagaactagtctcggttatattgatttttatttaaaaacctgaagcgcgaccatttctttattaacattatacacaaaagggaggggagggggcgcagctgtggaggctcggccaaaacccggctcccaacccggcactggcgctgctcttgaaaagaggggatctgacgggaaatccagggatcaaggcaggataggagatgcggcagcgacatgaggctggggagatcgcagaggttcaggtggcgaaagcgctcaccgcgagacaaaaatgagcctgctcaccgcggccggaacaaaacaagagcaaaaagcagcagacgacgccaagccactaatgaaggcgcacaaactacggcaaccacatccaaacatggggaccaaagacacaacgaaagggcggaaaaaaacgacaaaccaaacgacgaccatgaacaccggcccaccagaatccgaccaaaagccataaaaccacacaccacagagttgacaagaaaaaaggaaaccagaaaaagaaacgaaatataaaccgaccgagaacacaaaagaaaatagaacaaacgaggatgacaaacgacggcacgaacaaaaagaaaataaaaacagataaaaacgaaagaataaaaaaaccacaagcacaagcaaccaaaacacaggacactaaaacagaaaaacacaacataaaataaacacaccaaaaaaagaaaaaaataaccgaaaacaaccacacagttaaacaaatataaaaaacaattacaaaaaaccatcacaatactcaaaccaaacaaaataaacaataacactaataactcaaacacacaatacacaaccaacccaaccaactacaaacagaactccataccaatgaataacaccacacactcaacccacaaaaagcacagaagaccagagaaccgacatacaaggcacgtacaaaaactgaacagaaagacgagacgagagaaggacagaagccgaatcacaagacaaacacataccaaagtgacaacgctaaatatacaatacagacaagaaaaaaagggagcgaccccgacacgcgcaacaaacaacccgaatcgtggcacacaagcagcgcaccaggagagcgcaagacgcgaagaacgcgccaggcgcagcacatccgcgtggtcacgtacaaccgacgacggtagaacaagaccatgcaggaccatggcgaccgcgagcgagcgaggggaaggaacaccggagagcagagaacagcccgccaaatacga

SEQ ID NO: 499214 - DNA, 122 bp, Homo sapiens
agtaggcgacgtacaggcgtgcgcgcgacctagctaatcgatgtgtgtggtcggtagagataggatttcactatgttgcccagggctggatcttgaactcctaacctcaagtgatccaccca

SEQ ID NO: 499215 - DNA, 302 bp, Homo sapiens
aaaatacaatgatgagacagttataggatagacgttcccatcacaaaagggaaaaatcggaaggaatgaaggggtgatggatccgaacaagtcaaacttagcaaggcaaatttccattcaatcttaaggttggagaataattgtctttcgcttgaataatcctctttgccttgaataatcctcgttgactttccaggcctggggttggcagcatcactgccacagctcttcagggtggccccccttgtggtctctgaggcagctccactttttgaaccaagcaggaagagcctcaccacctt

SEQ ID NO: 499216 - DNA, 445 bp, Homo sapiens
ctggctaaaagggatcagcacagggagagaaacaggataggaaagcataatggcgagcagcctatggcccacggcctgtaatcccttcccaagactagctgctcagggtggtgcagggacaggaccataccctgcgcctatttcctgccttctttcccctatagggaactctgtaggctgagccactgtcctgctcttatgacattatatcttgggcctttttcttaaccagtgagcagggggcctcctcctggcccaggccttaggggaaatggatcagcctttgaggttcttatttggggaggggagtccttaaaaaaaatctaaaaaacccttccttatggcccattccccattttaagggatctcctaaattattaaaccttctcaaaggctggcggcctttttagttccccccccctaggaaaatgcccggccggggagg

SEQ ID NO: 499217 - DNA, 748 bp, Homo sapiens
  misc_feature (48)..(48): n is a, c, g, or t
  misc_feature (50)..(50): n is a, c, g, or t
  misc_feature (74)..(74): n is a, c, g, or t
tgacgccggtgcagcgggggggcccgtgtgtgtggcccccctttgtgnantgtgccctggtgctggggaaccgncgggtgtgggcatttattcccccccagggaccccggggagggcaaaagggggggcgaactttaatacatccccctgtgggatttgcgccaaaaccgcgggggtttgtgtgggatgcgggggccccaaaagatgttttctccacccgcccgaaatgtgggtggggagagcgggcgcactgcgtgcggatgggaggggaacccacaccgcaccacatgtgggccggacgcgcagggaagagcgggggctgtgggggaaaatatttccccacgtagtgggcgccccatatggggggggctctgtggggtgccccagcccccacataggaggaggatgttaggggctggggaaaaaaccccgtgtgtgtgcgtgtggcgccccctttgtgggcgggtggtgtggccaccttgtggaactggggtgtggggccccgaccccctagagagctggtgagaaactcgggcgccccccattttctcacccacggggggcgccggcggtgtcgcgcaaaacagcgctgcgggcccccaaaaaaacagaggtggggggaccccgcgcggggagaacgggggcggcgcaacctttataacaaacgggcgcgggcaaccgaggactttgggcggcggaaaccttgtggcgcccccccctaggagtttccaaaaccgccaaaaaaagg

SEQ ID NO: 499218 - DNA, 254 bp, Homo sapiens
ggatggtgtgtgaggctcatggaggaaatacagctgctggcaaagaggagaaaagcagctcccagtcagacaagccagccgagaagaaggaagatgaaagccaaatggaagatcctagtacctcctaaaaatacaaaattagctgggtgagttgcacatgcctgtaatcccagctacttgggagcctgaggcaggataattgcttgaacctgggaggtggaggttgcagtgagcctagatcacaccacccatca

SEQ ID NO: 499219 - DNA, 112 bp, Homo sapiens
tagtaaccctatccccctttttaaatagacacttcctctttttctgactgtttcctggtacttgaattgaagttctggctgggtgcggtggctcacatctgtgatctcagca

SEQ ID NO: 499220 - DNA, 128 bp, Homo sapiens
aggaatggaacagaatgttgccttatttgtctagttctgtattacatacccatagtacagttttatagtatgcatcagataaaagtgctatatgaacagttaactacagtagtctgcaagtacagttt

SEQ ID NO: 499221 - DNA, 109 bp, Homo sapiens
agaatctgactctgtagaccaacatccagtgtgattttgtgtctgagaccacaccccagtagcaggttacgccatgtacaccagagccccatgtgactcccacgagggt

SEQ ID NO: 499222 - DNA, 237 bp, Homo sapiens
gtgccagcctcttcaccactccgcctcgatctcacatgactttcagacacaagtaccatgtcattggtttggagggaaagagtagataagataggttggtaagataacaggtttcaacattacttgctgtttctttaaacaaacagtgatgtcactgcctaaaagaacaaaggtgccttctaatagcatcatttaacttttaggcagtgacatcactgtttgtttaaagaaacagca

SEQ ID NO: 499223 - DNA, 129 bp, Homo sapiens
cctacagcccacactccacaccggtggcaacgcctgatgaaggcaacgttcccgccacagcatccacacttaaccatctccaaactgccactgcatgtgaagaaggagccatctgcagatctgccatgg

SEQ ID NO: 499224 - DNA, 266 bp, Homo sapiens
ttggcaacttcactgcacctggcaaaggagaagggtcagtttgaggtgtgacccagtttgctccagaacgtataaggggtctgaatctcatctccatggacatcttcaacagcttcacctgacaacgactgttcctatgaagaagccacttgtgtataacgcagaggcaacctctctcttctcctctgtttcgtgaaggcaggggacacagatgggagagcattgacccacgccagccaatctgtatgctaaatcatggtcatcaa

SEQ ID NO: 499225 - DNA, 336 bp, Homo sapiens
  misc_feature (130)..(130): n is a, c, g, or t
  misc_feature (179)..(179): n is a, c, g, or t
  misc_feature (243)..(243): n is a, c, g, or t
aaaatttatgcaaaattactttgacagacactgctcagtgggtgctgtgggttaacccgaatgcctcctgtccttccaggttcctgctaggccttctgaaagcaaagtgttcctcatttctaagtctttnaggaacatgactttcttgatctgctgtctttatgtagctatgaggcttncgattggttatagaaactaggtgaataattcttggaaacattcaaggttaatctttaaaaaacnaaaaccaaactaatatttaacagcccattaaaaacatccacatgaaccaaaggaaaatactcaatttcaatacaagcagaaggaaaagcgatc

SEQ ID NO: 499226 - DNA, 350 bp, Homo sapiens
  misc_feature (97)..(97): n is a, c, g, or t
  misc_feature (100)..(100): n is a, c, g, or t
aaactttttttaatcgttgtaataattgtataaaaaaaatcgctctgtatagttccaacttgtaagcatgtccgggtataaatcccttaaagccaanctnaccaaaggaagtaagaaaaagaaataaaaccagtcctcctcagccctccccaagtcggttttgtggccccccgcattcgctgtgaggtttgtttgtccggttgattttggggggtggagtttcagtgaaaataaacgggtctgcctttgggtgtgggtatatatacaaagaaatgtacatatgtgtgaacccaattgtccgagaaagtatctatttttgggtaaataaatgagctgctgcccctttgcca

SEQ ID NO: 499227 - DNA, 635 bp, Homo sapiens
atgtgcgcatgtgtaccagaatgagaatgaggtgggggtgtgccattcatgagaagctcagtggtagcaggtgggtgaagcggtgaggagctctttatcgtctgcaatctgtggtgctcgtaccatgagaagggcctggtgaacggagcctgccgagtaaggacagctcagcgaccattgaagctggactatctggagcctctatcttattccactggggcgactggttttacagcctgggaaggaattttcccattgatgagtcgggcaatgtggttcccagtgacaccaaattctggaacgtgggcggcatggaagagctggtggatgaagggctggtgaaagctatttggcatctccaacttcaaccatctccaggtggagatgatcttaaacaaacctggcttgaaagtataagcctgcagttaaccagatatgagtgccacccatatctcactcaggagaagttaatccagtactggcagtccaaaggcatcgtggtgaccgctacagcgccctcggtctcctgacaggcctgggccaagccccgaggaccctttctctcctggaggatccaggatcagggatcgcagcaagcaccaataaactacagccaggtctgattcggtcccatg

SEQ ID NO: 499228 - DNA, 101 bp, Homo sapiens
cttttggggtctttgctgaaactggattttacgatgtctctctaagatggacctaggggaaggctcagaagcctgactaaagtttgactaagcaaagaagc

SEQ ID NO: 499229 - DNA, 640 bp, Homo sapiens
gtggcgctgcggagacccggctccagacgcctggcggccgccggcacacaacggcgctttctagctccctcccccgcagcgcacagcccgcctccttccgcggcgcctgcagctggcagcgcttgctctgccctaccgtgacgcgctccgcgagacgctctgcgggctcctggcacaccgggtccgcggcgtggcggacgcaccgcacggagcgcgcacacgccactcggctagcccggctcccgcgagcccatcgcttcggcggcgcacgtccctctccccgcgctggccctcctttctccgcgcggcattcgccaccgcttccctgcggctgcacgcacgaccgcgcttcgtcgcctccttgccccgctgaccgctcgcctagcaactcaccttgctgcgcttcgcggcccagtccccacctgcctgaactgccaaccacacaatgctcaccctcacctgctcactcaccaacccgcacacctccaccgcccccagcacccgcgcctccacttcaacactctactcctgctctccacaacctccctccctaccgctgcacaccgccctcactcaccctcaatcctcttcacccccaccagcgctctctccactgacctccttctccatcccccaaccc

SEQ ID NO: 499230 - DNA, 225 bp, Homo sapiens
cgtatccagcagtcgtatgtcatccagaaaatcggcgaccttttggttcagcagttttcaggtgaaaatggggagagattgaaagaaaagtacggtgtgttttgtagtggccacaatgaaactggtagtcattacaaggtggtggttcagcaaaacaagaaatttcaaaacttgatcaagaaaattggcaacttctccatcgtgcgactgcttggattacaagga

SEQ ID NO: 499231 - DNA, 311 bp, Homo sapiens
cacgaggcatcctatacaggtaaagagctagttaacatttagaaaaggttcatatttaaataaatttcaagaaaccaagttaaatatttttccaggtaacaccaactaacatccggtgaaatctcggggaaacagtatctcatggctaattagatagccatccggtcttactaaggtccaacttttttttttttttaaaggaccggggtctggttctatcacccagggcggggagtgcagggatggcaatctcaactcagggcaacctctacctccggggttcaaggtgattctcgggtctcgggggtacc

SEQ ID NO: 499232 - DNA, 204 bp, Homo sapiens
  misc_feature (7)..(7): n is a, c, g, or t
tgagganacccaaccctgccacccacagccagagtagcaacaaagatgatgtggatgtgtttgtgagacagctaagacagacagaagaggggggaattacttaaaggagagactcaacccaagttcgagcaatgtggaacaatatcaagcaatggtttctagtttagaagaatccctgaacaaggaaaaacaggtggcagaatt

SEQ ID NO: 499233 - DNA, 251 bp, Homo sapiens
atgaactcagccctgtactggacaaccagacgctgagcatcatggacttacactggcgtagttgctgctaacaccggattgaccattcatccagacgagctacccatcggagcgcctataactcgtgcactttttgacggacgctcacagtgttgattctataccccttgacactgactataagagtaagaacatctttgtatgccctgttgacccataccatgtctgttggcacagtcactgaggctttg

SEQ ID NO: 499234 - DNA, 288 bp, Homo sapiens
taaggctacattccagtagagaaatatattatatacactccacatagaatctcatttgaacacctagagcaatgtccagagtcctcactatcttacttaaaataaaactacagatacagtaaagatcaaggatcataccgtaagaacacaggccaaagttcggtagtacaggggaagagatcggaaccagcaaggatggcaggggcaaagggctcaagggtgaagaggacagtgggaccacacagagttggggagataaaaggaacattggatgctttggtggcaccg

SEQ ID NO: 499235 - DNA, 92 bp, Homo sapiens
gtcgccgcgccgggggatgtagccggcgccctgctctagccgcgccgctttgagtaccagccgcgctgcagccgcgcgccgctagccgtgcg

SEQ ID NO: 499236 - DNA, 153 bp, Homo sapiens
ctgtcgagcatcgaacgacatgtgtggactaggaggaggatataccatctggcaaaccacgcataggttaatacactgtgtgtctggggaatgacgcacagatctgattgacttgtataaaatagggctaaccacctaccattaacagtgtac

SEQ ID NO: 499237 - DNA, 141 bp, Homo sapiens
gtgcgtgaggatccccagtgcagtagcctcatcgggcaggctgactcaggggctcacgggcagtcaccaataacagcagaacagcctcgggcagaaggctggctgggagaccgggagatgccccagtccagagactgggat

SEQ ID NO: 499238 - DNA, 139 bp, Homo sapiens
tgtggttgtggtgcttgagtacgtctcttcgtgtgggtgccaagtgcttgtgtcgccactgtgttctgagcccccttttctggaccccactgtgtcctgtgactatatcgctactgtgagctgttcccgccctacccgg

SEQ ID NO: 499239 - DNA, 196 bp, Homo sapiens
cgatgcttggccttgcctcgggcctagtctcggagccttacctcggagccttatcctcggagccttatcctcggagcaggaggtcgcttcatatgtgctaggcacgaggatgtgcagggcgatggtagacaccaggcctgttgatagtgcccgagagaagtctggacgaggctgaccgcgcaggttaaggtctccg

SEQ ID NO: 499240 - DNA, 596 bp, Homo sapiens
cccataaaatgatactctagagtggaactatgacaactaccgatatctgttaacatcttagaactcacagtgtcatattggaacctttgcgaaagtctgagtagtggtacaacattaactcgaatagtaaacgtcaagaccgcaaaattgatctgttaatcagaattttgtctttcgtgttgatgctcacacttactccctgtgtgtcttggttatccgtgatcaattgacactcagagactagttagataagaaattaaatttccagaaaaagtcacttaagtatgtaaagtagaatttcctaattatgtggtctggaaattgctgatgtctacagaatctttctcaagtttgaagtacaaatacttgtaactgatgttgggtggtaaggtgaaagatggttctagctcagtgagtttttcttattttttttgcacaaaggagttgaacattgaaataaagaggtgtgagactggaaaataatgcggagagatcatggattatttagattagtgcctttctagagaagaggaaagtgaagtaagtgacagcataaaggatcctttatggtctaaccccagatcctttctctagct

SEQ ID NO: 499241 - DNA, 375 bp, Homo sapiens
taagaccgcacagctgcatcatatacaggatatccaatgaaggctatgggatgtaccttcctccccgagtagaatcaagtataaacggcaaagtagcctataccaaagtgcagattttaatatttcaaattcacttccttcccacataagaagaatgtgaagaggagaaaattattcacatgctcaaagttttagcaggtttgagaaatggttttggggtgattattttaaattataggctatatttgttctgcttaaaatgtttcaatcaaagtgacttgaaaggcagagacaactgcattaagatacaattaaaaacttatttgtgactcagcctatgttaaatactacaacttggaaaataaagcagttttc

SEQ ID NO: 499242 - DNA, 264 bp, Homo sapiens
aggcaatatataagatctgagtagctgggcatggtgtcgcatgcctgtaatcccagctacttgggaggctgaggcatgagaaccgctagaacctgggaggcagagggttgcagcgagccggagatcacgtcacttgcacttccaagcctggattgaacaggagcccagaaccccgtcttcaaaaaaaattctaaagaacaacttgactcagtttttgcagtaagagctcaatctccttcaaggaagaatgtcaaggttctcttt

SEQ ID NO: 499243 - DNA, 410 bp, Homo sapiens
  misc_feature (278)..(278): n is a, c, g, or t
  misc_feature (286)..(286): n is a, c, g, or t
  misc_feature (293)..(293): n is a, c, g, or t
  misc_feature (329)..(330): n is a, c, g, or t
gtaaaacagagggtggaggaaagcttttcctctctcaaatgagctttgcgaggtatacttcttgaaggataggaagttgaagtgttaggacttttatgtctattctactttggcttagtttacatgattcttagtttattagcctataaatggccaagaaaacttaaggttcaataattagttataaatatgaaatatccccaatttttaagataaaaacaacttataaatgtatttgtctgtaaaaattgtgtatatttttacagaacatctatttntttttttnttttttnatttttttattatactttaaattctagggtacacannacaatgtgcacatgtaccctaaaacttaaagtataataataataaaaataataatcatagaaaaataaaataaaattaca

SEQ ID NO: 499244 - DNA, 681 bp, Homo sapiens
tcctcctgaggagcacaatacttgggaccctgataaaaaacttggattgccctgagctaattcctgaatttatgaaaaacttttaagaagatgaaggagggtgaaaattattaaacccagggagaagctcagaaagtaacaagaggaaatccaattttctcaaacagtgccgatgacttcaaattctaaaaaaaacgagagagcagacgcaagtgatatcgctcggggctttgacgagacggactggacccagaaaagactcatgggggcaacagatccctgtggtgattaaatgtccctaagtgaacatggaaacgacacagattgaacgctgacctggtctcttgcaaaagaagctaattgtgaaattgtccacaaatttgtgaatagcatttttattgaacgagacgactgaccttggcatgcttatcctgaggatgcggaaaacacaagagaaagaaacagcaaagagctaaaggaggggatggctctcgtgtaatttctcttgtgtacataatacattcacctccctgcctcctctcctttctacccaaccccttttctatcctaaacactatccataaaaaatgtgctttatcactgtgctccacaggagaaacaaatcgaaatagtaatatactaaaaaccccgaataacagaatttgtcacaaaacaaagggg

SEQ ID NO: 499245 - DNA, 144 bp, Homo sapiens
tccacgttacaacctttacaggtgggccttcagctggttcgctacaacaatgtcttccacaactcaaacttccaccgcgctcacacaaccggttcacttcttgcttttcacttacacagcttccgacttcttcttgcagaggct

SEQ ID NO: 499246 - DNA, 404 bp, Homo sapiens
taatgcctcattaaccttactaagggcataagcccaaaaaaggcctttgagtagccatggtgaatgttacagactctgtgcataagagcataagctctttactcacagtagagttctccagatccttgctcagagcttatgaatccctattttaaacagagttgtatcaccttgttatctgattttttaggtctgcaaaaacacagggtagaagtgagtgggtgaaattctcccgagggtgcccacgtgcctggctttgttaagtttgggaattattctggatatatctgggtacgaatgtgtgtatgcaagcatatgtgtcgggcttctgggtatactcatgtgttggttataatgactttgtgtgcgagagtgtgtgcattagcatttccggcatctggcgg

SEQ ID NO: 499247 - DNA, 543 bp, Homo sapiens
  misc_feature (25)..(25): n is a, c, g, or t
  misc_feature (65)..(66): n is a, c, g, or t
  misc_feature (109)..(109): n is a, c, g, or t
  misc_feature (116)..(116): n is a, c, g, or t
  misc_feature (124)..(124): n is a, c, g, or t
  misc_feature (126)..(127): n is a, c, g, or t
  misc_feature (138)..(138): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (159)..(159): n is a, c, g, or t
  misc_feature (165)..(165): n is a, c, g, or t
  misc_feature (182)..(182): n is a, c, g, or t
  misc_feature (192)..(192): n is a, c, g, or t
  misc_feature (218)..(218): n is a, c, g, or t
  misc_feature (233)..(233): n is a, c, g, or t
  misc_feature (247)..(247): n is a, c, g, or t
  misc_feature (250)..(250): n is a, c, g, or t
  misc_feature (283)..(283): n is a, c, g, or t
  misc_feature (298)..(298): n is a, c, g, or t
  misc_feature (302)..(302): n is a, c, g, or t
  misc_feature (315)..(316): n is a, c, g, or t
  misc_feature (333)..(333): n is a, c, g, or t
  misc_feature (345)..(345): n is a, c, g, or t
  misc_feature (348)..(348): n is a, c, g, or t
  misc_feature (350)..(350): n is a, c, g, or t
  misc_feature (354)..(354): n is a, c, g, or t
  misc_feature (397)..(397): n is a, c, g, or t
  misc_feature (399)..(399): n is a, c, g, or t
  misc_feature (404)..(404): n is a, c, g, or t
  misc_feature (409)..(409): n is a, c, g, or t
  misc_feature (416)..(417): n is a, c, g, or t
  misc_feature (423)..(424): n is a, c, g, or t
  misc_feature (426)..(427): n is a, c, g, or t
  misc_feature (440)..(440): n is a, c, g, or t
  misc_feature (463)..(464): n is a, c, g, or t
  misc_feature (471)..(471): n is a, c, g, or t
  misc_feature (478)..(478): n is a, c, g, or t
  misc_feature (517)..(517): n is a, c, g, or t
ttttagaccaaaatcaatcgccggnaacaaacatacaatttttttcaacatctgtaaaccagtannattagtattatggtttttttcagataaaatatattttgtgaanaacttgnaatggcananntcattctggcntttcaaacngcnatntacggnatcacnaacatccctttatatantcaaatattnaagagaaaaaccgggcaaaacatttnaaaacagactaatantacaatcaagtatnggncttagggggagacatttaaaaagagtccgggangggcattaccagagngggntacaaaaccagtnnttattgggctgcatttntacagcattccnaangngggnaagggtgcatttttccaatgcactagcttcaaagttggggggnanggggnaaggntaatagnngctttnngnngaaagcagcgggncatttcacaggattgtttcgggnnggggggntattagnaacaatgctttgtttaatgcttctagtttagcggcaaanacaaaactaaaatagcagcaaattca

SEQ ID NO: 499248 - DNA, 184 bp, Homo sapiens
  misc_feature (112)..(113): n is a, c, g, or t
agaaggtaagggagtgggaggcaggtgggtgttctggagggggtatccttgtgctctaagggtgctatgttcgatgctggtgtttcggggatggtgaatgcccttctttaannttagagggaaatccaaaccaataggccccaaggttgccagtgggataggggtgtaaaaaagtaaattgggc

SEQ ID NO: 499249 - DNA, 657 bp, Homo sapiens
gggagatcctggctaaggtggttaattgtcctagacgctgtagagcaggcgtccccagcctggctgcccatgagaatgccctgggcagctttaaaaatcctgatgcccaggctgcacccagaccaattaaactaggatcgctggggtggcgcccaggcatgggaatgttttgaacttcctgggggtttctgaagtgcacgtagcgttgagaacccctgctgtgaaggggctgagagagagagagagagagagaaagaaagagagaaagagagcgagagagcgagagagagcgagagcgctcctggtgctctggggtggggaggggtgtcagggccgaggaccccagatgactggcatcccgccaggcaggggtgttggtgaggactcgggtgcacccatcgccactctgagcggtggggcgtctattaataattaacccggagttgagtccccccggagggcagagcaggtaggctggctcgagggtcccctctagtggtggatctgaagaactgcatgtgcaggctgcgtgtctggctgagattggcaggagggacaactcccccaccacacccgggggcctagggtcccccaggtatatggttattggcaagtagttcacagaagagctaggggttagaaagtggcagtatcccg

SEQ ID NO: 499250 - DNA, 350 bp, Homo sapiens
  misc_feature (236)..(236): n is a, c, g, or t
tcacacgcacttggaaaagcaggagctagagagagagttgagagagaggtaccatacttttaaacaaccagatctcatgagaacttactcactatcatgaggacactaccaagccattgaggggtctgcccacatgacctaaacacctcccgccaggccccaccttcaatacgggggattactgttcaacatgagatttgatggggacattcaaactatatttttctgcccctggncctgctaacctcatgtccttctcacattgcaaaatatagtcatgcctttccaacagtccctcaaagtcttaacttattctagaatcaactcaatcaaaaatcccaagttgcgtg

SEQ ID NO: 499251 - DNA, 624 bp, Homo sapiens
  misc_feature (21)..(21): n is a, c, g, or t
ttggcggctccattcaggggnggctcgctactctacgcttcctagcaaggtttgatggtccccacaaccctacatcagggcaggtggggctggtgtgggaggggctctggaggcctctgaggccagatgtgtaaacagggctgaggttcagtaataggatgagtcttcaggtgtggagcagcccacctgggctcttcccatgtctcggtgttacttctcatattcgtgtgtcctttcaaacttcagggacagtattaatttatactagtatttcttcctcagtttggtgactggaatgcagggagtgccttagaggatccagggatgacggaaggcgggtggggggtcctctctttcagaaggggaacttcccaagaggggggtggcgtctcgcctctcagtaggttccctacctcggggtcttccacccttcaaagtcgggtacagaattaagcaggggctggagggaatgaccctcagggaccagtttcacccagagggggtagatgatgaggtatacctagaagtagctcagggctccagagtcgggcctttcaggtggtgtcttactcccctttgagaccttcagcgtgttgtcttccagtggctgcatacttctctgat

SEQ ID NO: 499252 - DNA, 1229 bp, Homo sapiens
  misc_feature (343)..(343): n is a, c, g, or t
gctcttcagcctggcgtcatgtctaagtcagagtctcctagagagcccgaacagactgaggaagctcttcattggagggttgagctttgagacaacctggatgagcgagcgctgcaggaagccatctattgaggcacaagtggcgtgatagccgctccacggaacttggtgtggtgacatagcagagatccgaaactacctaagcgctccaggggctttgggtttgtcacatatgccactgtggtaggacggtggtactgcatgctatggatatgcgaagggcacaacaacggttggatcgagaaagagtttgtggagaaccagacgagatgctgtactccangaagaaagattctcgaagaggacgcgaggtgcgcgcacattaactcgttgaaaagaagaagattatttagtacgtgtggcattatacaggataggacactcgaacgaacatcaccataagagacttaatctgttgaagctagttcagtggtaaaagacattggaaggtgatccgaatagtccattgacatggagcactgacgggcatgtggtcggactgagagacacggggcctattgccgtttcgtaaacctgttgatgcgatgcatggacgtccggtgtgatgatgcacttggtcaattcaggaagatagacgatgagctgggaatttggtccataacctcgtgaagtgtagaaaatagtactgtcggaatgcgggaagagagtggcttagtgcattcattccatgtgcgaaaatgaaggtcgaaagttgggtatctagtggaaggactctttggtaggttggttggtggaatggctgggtttacagtgtgtggaaactcgcacaaatctttctggaacgaagcgaccggagaaacggttgcacttgggttccggctgggtgggactttatgggctcgggtagtacgatgggttgggctgggttgggatgaatggtgtgcgctaggtgcgacgattgggctagtatatagcgcatgggtgtgttacatcggatggggaagcgcatttgtgtagggaagagttggttagcggaaggcatagcgacgtggagtccaggagagaatcgatgtgaatacgtgcagtctttggcacaattttttgtgcgggcttggaaggaaggacaatgtttggcaagcggcgtaaacagtggggcccctatggggggtgttggccacaagttgcgcagaacaggaataacaggttgg

SEQ ID NO: 499253 - DNA, 352 bp, Homo sapiens
ctagctctgtcacctgttgggtatgcatcaatacaggaacggtccccagcgttggggacgagccccacagttgataactagtatagtgaaccacattgttgtactgaaccacttattcgatgactcgctgatcataaacaacctgtgtgtaatatgttttcctctaaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 499254 - DNA, 680 bp, Homo sapiens
tcacaggttctttcacaggtgaaggatcagctggatctgctctctgtgagtggtcagaagcagttgcaggctttgggtctggagaggctgaagaagcagctgatgtagagaggtatgaagtgtgcaggaacactgcaggaacgagctgcgcgtctgttttctgttaaaggactgacccctgatcagattgatccttcactcttggccaaacccagcaagggcaagaagaaatagcagtccaaattcactgctgtgacgaaaaattgtttgaggaatttattagtcatcaattctgagattttaaaaatgtatcgctgtttgatttgaggttagtttttaacacagatggcgctgtgtgctttacaaacactactcgaagctaagtttgggaagttttttcctagtttgggaagggttaatgtgaatttcaagagtgtcaatagttggctgtatttacgttaatcttgtgacaagagccgacttgcattacatgctgaacactcaagggctcaaaagtttttgagtgtatagataaactagcctagagcactgtctgctgtttttaaaactagcctagagtgctgtctgctaataaaaactagcctagagcaccgtctgctaatataactagcctagaatgccgtctgttaataaaaactagcccatacaacaacttgtta

SEQ ID NO: 499255 - DNA, 1050 bp, Homo sapiens
  misc_feature (911)..(911): n is a, c, g, or t
gggtaaagtagccgccctccaagtacgcgggagaaggggaggaagtagtgggggccgctgcctccggcgtggaggaagaggcgcgggggtgctggtgaggaggacacacacgccggcggcggcgccactacgaaagaagacccccctcctccgcgacgaggtgtgcgacggaggccgacaccgcgtggtgaggagaaaagaaataaaacttgcggccggggagacgccgctcggcggctactaggtgtgaccccgcgcacgcgggaggccgccacactgctctgctgagttgtcgaagtgtactcttcttcacactgctggggagacgccccccacacacaggcggggggggccaccacagcaaagggcagtgtgcgtgtgttttctctcctggagaagagacacgactctctgcgggctttaagtatgggcgtcttatatgtagacatctgtcgagactcgggagaacactctcttgggtgtctctccctcagatgtcgagcgtgtgtctctgctctataagcgagagagagtagacacacactcgcacggcgaaaatttggggtgtcacttgtggcccacactgcttcacacgaccccacaaaattcgcagagaattcacaggcacacaggtgtaaagaagtatccgcgccagaacactgtctgtatactcgagaagcgctctagactcttcacacagagaagagaagagagagactcttcggtgagatagactccacgagacaccgcacgcgagaaggctggagagagttctctttcgagacaccaccggaaaatagagagagagaatatatgagagagatgtatctcggagagcacaggcgcacacagagatgtgagtcaccggagaacctggtggagagtctcccaaattggttgtccgcacaaantctcagaaggtatattctcctcagcgtccacagggcgtaaccctcggaaatttgggtttggctttgacggaagggaattatcctccccaaattgggggtttataaagtttttaggaccctatttaaaaaccggattcca

SEQ ID NO: 499256 - DNA, 414 bp, Homo sapiens
cccgtcacggatactcaaatctatctaaacatggacatctttttgaaggaatatttattacacctcctaatattaagatttctcagcaaagttggaaaatactgccatactgccataagcgttaactgagattactatgtgagccagaatatagtaaaatcacgcttattttaaaacttgcactacatttcacaacaaatgatctactttcataatctttacgtggaaaagtaatcttgctgagatcgtaaagtttttttctttcccatttacttcttctcctcccatgtatgctaggaatgttgctcagtagataggaaggggtggttaaggggaagtaaccaagaggtagatgaggttgaacacaaccaccactctccataatcctaaaaataatcctgcatcccacaaatt

SEQ ID NO: 499257 - DNA, 136 bp, Homo sapiens
ctctagacgatcccgtatagcttatagttcatccctacccctcatgcctgcgtgagtctgtacagggatatgtgtgtgtgtgtgtgtgtgtgtgtgtgtgtgttagagaggaagaggaagagcaaatgtctgtata

SEQ ID NO: 499258 - DNA, 1029 bp, Homo sapiens
ctggctctgcgcccagcccggctctgctgcagcgtgcagtgaggatagatgcctgcgcagcgcggactcgggagccccggtgccagcagcctggcctccggagccagccacaggcctccccgggcggcgcccacgctcctaccgcccggatcgcgcggatctccgccggctaccgatgccgcctgctcccggcccagaggcgacgacacgatgcgctgcgcgctggcgctctcggcgctgctgctactgttgtcaacgccgccgctgctgccgtcgtcgccgtcgccggtcgccgtcgccgtcgcccttcccagaatgcaacccagactagctacggactcgatctaacaaaaagcagcaccgagctccaggcattccagtgtcaaccgatcatggcttaccagattcagcccaagcagagcacaaggtccccaacttccacaggtcccaacggaagatccttgggccttcgggttcacacgggcgaagcgaaccattgggtggtatttcccggtggacttcgacggcgggacacctcacaagcctgggctttacacacaaggtctcttcaagggcccacaagtctcagcagactctacgcgtgtgcttagcaggcaggacagcctcagggcaaaccccgttatgttacccgacccgacttcggaagaagccccccaagaagaggcatacatagcatccggttgcagcgcaccaccccgagttaccggtttgggccaaacccttcacaacgatggcgcgaccgagggagttaaagaagccggtttaaacgaagcccaccatagagccagcggccccaggaagtttgggacgcacacagacgtcatttacccacgcgagaaacgttccttgggcggcggggacacaaaacgccacggccccacacagtgctgggttgtaccccaccaaggagacctttacgcatttccaactcttaaaggtggaaggaaaaacgtttcttgaacggaccccctttaaggccgttacaagttcccacattttagacgcccg

SEQ ID NO: 499259 - DNA, 122 bp, Homo sapiens
gttttgattctcttagttacataccatggggtggaattgctgggtcatatgtactctatgtttaacttcttgaggaactaccaaattgttttctgcagtaggagcatcatcttccatcccca

SEQ ID NO: 499260 - DNA, 287 bp, Homo sapiens
tactaggtataatatgcacaaccaactactccagctgacacaggatgccatcaaccattataatctatcgagcatactagatattctaaggctgatcaacagatagcaaagatggaacccttatagggaaaaaataaaatcccttctaccccagttttgacacatgttcagaagttataaaggaatgttaaattatttaagatatttcaaaaaagaattaagaatggaagagtaagttctgctggaaaagatagggcagctttacagtctgcaaagtagatcatcta

SEQ ID NO: 499261 - DNA, 179 bp, Homo sapiens
gctgctgacagtgccagatacttagggataaacatcaaaatgcaattatagttgctataacgttagatactcggaattcaaaactttactttggcaagctgaccttgataaacctaaattgaacccaattaacaattgtgtagaaatgtgctattccgtgaacatacattattatacca

SEQ ID NO: 499262 - DNA, 231 bp, Homo sapiens
aagtactgacagataacgatgagtaagatcccgtccactcatggaaggcttacgactaggggtagaaatgaagttattaatagctagacacatatcaattcatttaggtaggtctcagatataaactaacgtaccatcagataacccacattcaagagtccaaggatcacatcacttcctacagaggctgtactcctgaagctctacacctagcctgcctttcagcaggtg

SEQ ID NO: 499263 - DNA, 183 bp, Homo sapiens
cttgtcgggatgcatgtggtcacgttttttctgtgaacatgaactcatggcttcctgtgaaaataccaataccggccgtggtgcaattctcaataaaaaacagattccaccaggggcagctttatttggctttagccatctatatggtggtataccgggtggtcaagctgaatatgtgcggat

SEQ ID NO: 499264 - DNA, 160 bp, Homo sapiens
tcaatctcatgctcctgcactccgctcccggttcgacgcgattcttccgtctcagcctcccttcgtagctgggacccgaggcacgcaccatctcacctggccaatttgttgtattttcagtagagacagggtttcaccattgccggccaaagcaggtctc

SEQ ID NO: 499265 - DNA, 235 bp, Homo sapiens
gcttttgggtctgttacccaaagaatgataaagttggttttatttcaagaagtcggatcaaaaagaaagccccaacaatctagaagctcagctgcacgggaaagggggtccgaacctcgaagttttagagacctcacccgggagctcccaagacagggggtgggtttcccagctcgcccgcacgccccgacctttccatcgtaggagttgggggactcttccccagccagacacc

SEQ ID NO: 499266 - DNA, 244 bp, Homo sapiens
aggaggcggagtgagtgagctgagattgagccactgcactccagcccaggcaacagtgtaagactctgtctccaaaaaaaaaaatcagtcgggcacaggggtacctatagtcccagctactagggaagctaaggcaggaagattacttgagcccagaaggttgaagctgcagcgagccgcgatggtatcactgcactccagccggggtgacacagaccttgtctctttaaaaaaagaaagaaag

SEQ ID NO: 499267 - DNA, 1366 bp, Homo sapiens
aacacctctgttgttctctcaattaacagctcgggtcgcactcctcacgcttagtttatacttgccccggtcggatcaactcttttcaccacgcaagcgaccagatagtcatcatcagtagccacgcttgtttttggtggcacaccacattaaacaacatttttcgctcaacaataacaacgctcgttcgtccttcttccgtccataatattcccgcgcgtaagtttgttttttctcacaccacactttgttcgcctcacactcgggtggtcgtgcccagcggcccttgttgtgttgtggtgggggaatccacccttgtgtgttgtgtgtgtagtaggttgttcctcgctgtggtgtggcgggtggttccgtgccctatcgtgttcgttgtccccgccccacccttggtgggggcggtgggtcgcccgtcctcttttttcttgttgattgttgtcgtttctgttctgctgttctttcctcctcatcgtggtgtggccgcgtttgcatccgtcattctctcccacccggctcctgccgtgttgatgtggggtggggtgtctggtttttcctctccgccccctcgcgaggtttttcccggcacgtttattttgttttttggtttgccacgcgtgtgaggcgaggtgtttgggggggcgcgcgctctccctcccctctcttctctcttgttttgaattcctctctcttctccgctcccctcctctccaccttcccatccgtctttcttttcactcccctcccgcgcttttctcttcccgcccccctgttttttttgttctctcctcgccgttgtctccttcttcttctctctctcctgtggctcgcgcacacacacaaaggcacgcccccgccgcagagagggagcggccgcgcccctcgctcagagggaggtgcgcctttgtctttgtgtttctctctctcccccccactcccccctcactctccaaaataatatatattttttttatataaaaaaagaaaaaaaatcaaatctcaaccatcctcacctcaccctccccactgggcgccccccttcttttattgtctgcgcgcactctctcttttcttccccctatctctctcacacaacattctctctcttatataaattaaaagagagaagagagcccaccacaaaaataataaaaacacacaccaccacccctaatttcaccactctctctctttttatatatataaggagccgccgcgagcgagagagagagaagtatcattctttttttttttgcccccccctccccctctccccccttttttactcacccccccccccctcgcctctttctttttctatataatataaaaaccccccccccccccccccaca

SEQ ID NO: 499268 - DNA, 283 bp, Homo sapiens
tgtgggcactagaggatccccccgagcacagcggccacgcagtttatcgtaagcgatatagaggtctggggcgaacgatctaactatttaaatttaatgggttaggagccggtcgtgcgttgagccggcgtggattgcgagtgctaggtggggcactttttggtaagcagaactggcgctgcgggatgaaccgaacgccggggtttatggcgcccgatgccgacgctcatcagaccccagaaaaggtgttggttgatataggcgggcggcgctggctgggcgg

SEQ ID NO: 499269 - DNA, 116 bp, Homo sapiens
caccaccactacggtgaccaaccccaacacccaccggacacagaccccaacccgacacccatcaccagcaccaccacggtgaccccaaccccaacacccaccggctccgcgctgcg

SEQ ID NO: 499270 - DNA, 1090 bp, Homo sapiens
  misc_feature (285)..(285): n is a, c, g, or t
  misc_feature (387)..(387): n is a, c, g, or t
  misc_feature (421)..(421): n is a, c, g, or t
  misc_feature (440)..(440): n is a, c, g, or t
  misc_feature (485)..(485): n is a, c, g, or t
  misc_feature (506)..(506): n is a, c, g, or t
  misc_feature (525)..(525): n is a, c, g, or t
  misc_feature (566)..(566): n is a, c, g, or t
  misc_feature (703)..(704): n is a, c, g, or t
  misc_feature (711)..(713): n is a, c, g, or t
  misc_feature (802)..(803): n is a, c, g, or t
aattaggctaggtacgaggctgggtggttaatggccgagggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgggcgcgcggcagcggcggggattactttgctgctagttatcggttcgcggnagcgggcgggtgtagtctcggcggcagcggcggagacactagcactatgtcggaggagcagttctggctgggggactggggcggcggcagcggcaaacggcnggctggtaaggcggctcggcggggcgagcaggangggagccatggtggcggcngacacagggtgggcagctggcgtgcgggcgtggaaggcggagccngggacctggcgggcggaaccngtcgtctgggaggcaccgnaagggggcagctgccgagtcgcgaggggggccgaagattgnacgccagtaagaaccgagggagggatgaaggcctattcaaaactcctccccaacgaacactctggaaagcagcgaacggcacacgcgggaaagaatggaaacatgtgtttcataggaggccttagctgggacactannaaagaannnatctgaatggactaacttttccaaatttggtgaagttgtagactgcactctgaatgttagatcctattcacagggcgatcaagggcgtnnggctttgcgctatttcaagaatcgcacagtgtacataaggtcaggtgtccaaggacctaattgatggcaacgggatgagcctaacgggcaagcctacacaaaggccggttaaaaacctttggtgggggcctctcctataacctgaagaaacagcagaacgggggactgaagagggcgcccaagcccaggtaacagcaccaacgagggcgcaaaccccgaagaaaacaaacaatgagaaacaacggtgtgaagtagaaacagaggcagcaaaacaggagagctagacg

SEQ ID NO: 499271 - DNA, 1224 bp, Homo sapiens
  misc_feature (837)..(838): n is a, c, g, or t
  misc_feature (845)..(847): n is a, c, g, or t
  misc_feature (936)..(937): n is a, c, g, or t
aattaggctaggtacgaggctgggtggttaatggccgagggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgtgtgctgctgctgtgcagctgtgctgtgtgtgatctacttttgcattgcttagttttctgtgttctgctgtcgcagctgtgctgtggttgttagtactcctgtgctgtggcatgctgtgctgtgagcacaacctacgcaccatattagtccggatgtgaccgcatcgttcctggctgtgggtgacctgtggggcttggctgtgcaagctgtgcaaactgtgctgtgcctgtgtagggccgtgcttcctggctggtgctgaagcatgtgatgtggatggccatgggttgggctgtgcgacaccatgggttgtggcagctgtgcgtgtgcaggctgtggatcagctgtgatgcctgggtgaccctgtgtggtgctggaaaccagcagtactggaatgtgcaccctgaatgtgggtgggcatgcagcccagagtccagagaagtggtgtgcagacaggatttggatcagccatgtaaacgaaccgagggagggatgaaggcctattcaaaactcctccccaacgaacactctggaaagcagcgaacggcacacgcgggaaagaatggaaacatgtgtttcataggaggccttagctgggacactannaaagaannnatctgaatggactaacttttccaaatttggtgaagttgtagactgcactctgaatgttagatcctattcacagggcgatcaagggcgtnnggctttgcgctatttcaagaatcgcacagtgtacataaggtcaggtgtccaaggacctaattgatggcaacgggatgagcctaacgggcaagcctacacaaaggccggttaaaaacctttggtgggggcctctcctataacctgaagaaacagcagaacgggggactgaagagggcgcccaagcccaggtaacagcaccaacgagggcgcaaaccccgaagaaaacaaacaatgagaaacaacggtgtgaagtagaaacagaggcagcaaaacaggagagctagacg

SEQ ID NO: 499272 - DNA, 240 bp, Homo sapiens
  misc_feature (14)..(14): n is a, c, g, or t
  misc_feature (100)..(100): n is a, c, g, or t
  misc_feature (119)..(119): n is a, c, g, or t
  misc_feature (149)..(149): n is a, c, g, or t
  misc_feature (167)..(167): n is a, c, g, or t
  misc_feature (202)..(202): n is a, c, g, or t
  misc_feature (230)..(230): n is a, c, g, or t
  misc_feature (240)..(240): n is a, c, g, or t
atcctccacatctncatgtcgaatagctgaggaggagggggattggtcttgctgcctcaggtggcagaggtggaagaaaatccgtgtataagcagatctntgcagttcaaacccatgtncaaaggtcagctgtattcaaagtgggagtnttaggtcttctgcaagangtggctaagaatagtggggggaagagatactattnctaagtatgtttatgcttactgctacancactactttn

SEQ ID NO: 499273 - DNA, 298 bp, Homo sapiens
aattaggctaggtacgaggctgggtggttaatggccgagggcggcgccattaaagcgaggaggaggcgagagcggccgccgctggtgcttattcttttttagtgcagcgggagagagcgggagtgtgcgccgcgcgagagtgggaggcgaagggggcaggccagggagaggcgcaggagcctttgcagccacgcgcgcgccttccctgtcttgtgtgcttcgcgaggtagagcgcaccctctgtaactgccgcgattacttggctggttgactcggacacaggcattggctgctgaag

SEQ ID NO: 499274 - DNA, 897 bp, Homo sapiens
  misc_feature (44)..(44): n is a, c, g, or t
  misc_feature (112)..(112): n is a, c, g, or t
acgaaggtttcctgagctattacagaaaaactggcagtcctctncttggtaatctagctactgatgctgtgaaggaagctcagggcagccacacgaaataagcccatatggnaaaagaattgagaccaccaactaacagctccagctgagccaacaacagcttaccagccctgtgagtgaggccattttgaaagtggaccttccagacctaagctatgcctgatgaatcctgctcaaatagcaaaatcttgagcaaagaaatgattgctgttgttttaaaccactaagttttgggcaacagattatcaaaacagtaccccaatacagagtgatttaaaaatgagtgatgattcgcacaaataaaactggacagattctcctgatgccaaattacggacctcatatttccagagataagagtttgactgctttttgtcttttcacccagagggaaaggttataggtagactttttcagcaataatcctttctggaactctaaacgtgcgttttctattgtcaaggttcccattttgtagaagtgcctacattgccattactatcgagagcagaagtaggttacgccctgcctaggttaagccaatacaatctcgcgattttaccttgaaagggctttttagcggaaacttttgaaaccaaatcactaatctgacgatcaatctatccgtacccctaataaccaaaaaaaatactaccggacccttttgccccttagtcgccggaccctctccggcccgcttcctttcagtgaagggtgtactttcccacccctcccttccttcactaacatgagctcccgcaacaccggttgccgcatagctggtcattttttttcccacacgccgagtaactgcgtttcccccggcccccagcggtc

SEQ ID NO: 499275 - DNA, 177 bp, Homo sapiens
  misc_feature (177)..(177): n is a, c, g, or t
cgtgactggccgtcgttttacacaagccacgcgcccacacaacacactccccccccaacaactccatctttcacacgcaacaagcgctcacgttcacaacaccccaaccacctagcggcgccacactcaaccttttaccatcaaatcaccagccgataaataacaatacaaaaccan

SEQ ID NO: 499276 - DNA, 359 bp, Homo sapiens
gccctttaatggttccaaaccctaagtccccacatagcccctgggtttggcatcttcggagcccccctggccccgagctgcttgactcaccggcttcctatttgatgcacccaggcccccttgtggccaactccctccccttttcactgaggcagaagccctgaggtggggtggacatgggtgccctcccgtcccttcatatccccaggcccactttggcctcaggttttgccctggccatgtcatctacctggagggggccctcccctttttcgggccttgaatcaaaagcccctttgttagggggggatttcccagccccctcctcccattaaaaaatattttggaaacatgcagta

SEQ ID NO: 499277 - DNA, 438 bp, Homo sapiens
ggacaatctgccctctctcacgaccgggggtctcgaagaggacgggggtaggaaatcctccaggatctcaggaaatttcactcggcttcgtcctgcggcaagggtctcttgggtcggcagggtgttctgctccggcgtcgccgtggtcttcagcttggcctttgctcttgctgtggctcttgccagtgctatggctgcggcgtgcggctcttgtccttgcttggggctcgtgcttttgctctttcttgcgccggctccgactctgggttccgggtccgggtcttgcgccgggagcgggagcccgatcgggaccggagatctactcttagaaggactgctttcgctggctgccacttcgggcttctgctctgtgacgggaatgtctgcttcgagagcgagagcttgaatgactccggtttctggagtaggaccggcgtc

SEQ ID NO: 499278 - DNA, 401 bp, Homo sapiens
  misc_feature (138)..(138): n is a, c, g, or t
  misc_feature (141)..(141): n is a, c, g, or t
  misc_feature (154)..(155): n is a, c, g, or t
  misc_feature (182)..(182): n is a, c, g, or t
gcaaacagttaaaactttgtgcacgaagcccttggtaacatgttccggaatgtctggttttcagggaaaaggtcaactgcaagaacgggcagggccactgctaccaagaggcactcccagcatgcacatcacagacgncgnctgacaaacggcnncaggtaacccaactgtgcataccggancagcccgaaggagagacacatcattgtggccatgtgaagggagcccatatgtgccagaccactttgatgcaactgtggaggactctcaactaggtcagagcacgacgagataccccacctccctcaacctcatcctctccacagctgcctcttccctcttacttccctgctgtgaaagaagtaactacagttagggctcctattcaacacacacatgct

SEQ ID NO: 499279 - DNA, 1019 bp, Homo sapiens
gcgggatgctggttttaaggaataaaatgcaaatggtgcttcttggaatcaatccatgtaacagcctagagaacaatggggcatccagggataatgagatcttctagagtgcaataggtgagggttcatggaagacacatgatgagataacatacgagagaaaaaggttgttgtgagataaatgaatttcggaatcctagtatttctggtgtagtatagattcgtgggtaataataacactatgcaaaatggtggagttcacgagtctgaagttgtcagaattggacatctttggtcatcacgatctatcatcaatcttcaaggcttaaggcttcttactcgtcccgctcaacgaaggggcgtaaggcaacttgcacggggggactggcaggaaccacaatgcatcttgcagtcgagtaagggtccctaatacacctggtggcatttgagggccgtttcgtgcacgaactggcaggatatgagctaggggaggaaaggtccataaatgttggagtaagaccccctaaagcattattctcgcttaatccagcaagtccctaaccaggacgttctacaatctaatctccgcctacagactgcatctgtcccggagcttttactcaaccgtaccgggtagaaatatgttagtcgctgaacgggagaaggctggctccctttttagtattttccacccctaagtggcactttgaatgatggaggcgacatcaaaaatgtattctatggttaccgcaatgacacattagttaagtccccaactttccaactacttggttaactatgatggggccggtggaaccatgttgcgtcaacgtataagtatacggaaacagtatgaagttgagcgtatgttgccttagtctaaaataccttacccatttagttgcccgtgccccacaattttggatgaagtcccttctcgggaataacgacattatttgtcttaacctcttaatatggtctatcccagagatttagtgtcccatcagttgggcaaccta

SEQ ID NO: 499280 - DNA, 246 bp, Homo sapiens
ggctcggtactttcagccatgactcgaggtctggcaaagggtccataatccccatccagattcccatcagcaggcatggacaaaggccgtggctatgccataagatggtgtattctctctcatttttgtgggcagaatgttggtttccaccgatctacccagcgcaactgtatccgagtctgcaactggtgaatcttacgtctccggactttcctggctccaacgaaggaattcgggcgactctga

SEQ ID NO: 499281 - DNA, 353 bp, Homo sapiens
agtccacccaagtaaaatgctatcacaaacaccaatattctaatacgtttataacaagaacataaataagatctgtgcatatgatctttaatttatatcccagatttaaaagtacttgatcaggtatgtagatatcactattagctatacaaagcaacagcacagcattcactcttaaacagcaatgcaacacttcaaaatgaggctccaccaattgcacatcacaaccactcaaccagacagcaccaaacatgcattaagactgtaaacacggcattatcatgtactttaactccatgtcaaaacacacccatatcaagttacagtttcagcacacttcaatcctcccaaaa

SEQ ID NO: 499282 - DNA, 373 bp, Homo sapiens
caccaaatgcgaacggactgatctacccagccggtgctgacggctcgtacttcccccctgggctcgaacgccctgacagaagcctcgcctgattcggcgagcgctgttgcaccacctttcttcccgcatttccactgcacgacgcctcgccggatcgcttccccgttgcttgatcagtccgttcgcatgttaacatgcgaacggactgatcacatgacctaagtaacctctcctttgttacagttgtcattgatcatttcttaaattaatatattggcgtttcggtttcaaaaaatgtaaacggggaaatacatgggcaggaccatatgagcaagctgagggaaaaggtgttggatcagtccgttcgcatgtt

SEQ ID NO: 499283 - DNA, 572 bp, Homo sapiens
gaacgtgacataactctgatcctcctgctattctcttctggattctcactagtctcacaaatctatacaactgggtaagttcttagtcctaaaataaagacctatctactacaatacttaaaatagttcttattctgctgccttcattgtacattgataaaaataacatagaaagaactattcataaaaaaataaagtgtctaaacaacatagtcaaatatctaataaaaaataaataaatcaagagtggtaaaatgtttaactctggaagtcatagaaaatataagtaaaaatcacaaggtcatctttaaaagctttactcatatagcaacaaatgaaaaggagccatgatacctcatttatataggcatatgttcacaaaggcattttatcctacatagattaggcactataaagtgttagagacaatgttaaccaataatccatctcctggatgtctatgccatacgaacaaagcagccataagtgatgacccgtatgtcaaggtgtttactgagtcatttaactaggcagcaaaacaatggagacaaaattactacccacgatgatct

SEQ ID NO: 499284 - DNA, 285 bp, Homo sapiens
tgatggtgtggtgttatgatgggtgataaatttgcaccacgttatatttcacagcagagatgagaaacaaatgctattcaatgtttcagattgaccttgaatcctatctccaattgaacgatgagcatgtactcacattaggaggatattgtagagattgaagaatattttctatgatgttggctttccccatattgaagtatatccctgccacattattgaattggtctgttgttagcttatatccttggagagatggaagaacatccataacaccacacaatt

SEQ ID NO: 499285 - DNA, 333 bp, Homo sapiens
aggcatattcttggccgaatattggattttaaaaagcttataggtttagcaagggggcggctggctggtttgtttaccccggtttgagaccccattaggaacttcttccaaaagaagggttcccccctctgggcttaactaatgctgttcaagtgaaaaaatggaatggtggttggtaaccgctggggctgggttgatttttcctgaagtccccaactcatcggggtcccaacaaagtttaagggttttttttttttttttgttctattcgtatccccactgccccgttgtgaatattttgttccccaaaaaaagttcgacttttttgcccca

SEQ ID NO: 499286 - DNA, 415 bp, Homo sapiens
aaaaacctttttttttcccccggcccccccgtttgtttaaaattttttcaaaactttaaaaacttcccccctttttttttaaattttaaaaaatttttttgttttcccccccccggagggttttaatttttttttttcaaattaaacccgggtttcccttcccccaaaatttcaatcggaaaaaaaattaacaagtttttattttccggggccaggcccatttttttttattttttttcagccaaaattttgaaaataccccccatggaaccttttttttaaattttttggggtccctccgggggtaaaatttggaaaaaaaggctttttttaaaactttatttttttttttaccctctcccctattggggacctttttaaaattttatttttttccccctttttttttggaagg

SEQ ID NO: 499287 - DNA, 99 bp, Homo sapiens
tgtacataactccatatcactttcagattgcataagggtgagagctgaatgtaggctccaacaggaagacggcattgaagcctggttgcttgttactac

SEQ ID NO: 499288 - DNA, 1000 bp, Homo sapiens
  misc_feature (858)..(858): n is a, c, g, or t
gagagactgtgggccgggccgaggaagaaggctgctggcaaaggggacgtcccaacggagagaccacctgtgcttcgagctggagttgaacgatgcgtgcagcaccttggtggcagaacaaggacagctcagctggtggtgattgtaccacgacgtggatcccatcgagctggttgtctttttgtctggccctgtggtgtcggtaaaatgggggtgccctctacctgtatgatcacacggaaaggcaagactgggacgtcatagatccacagtggcgaccgtgccgccaggtgtcgccttcacatcaggtgatattcggcagtacataaggctgcatttggctaacgcctgataggcagctatcaggaccaaattaacgattgagagactacgactgagtatccgacgctccctggttggtggcactgatcctgggtccgaaggtctgtggctcgtatcgcgcagggtcgacaacggccacacggcttaggtgaacttgccacttaagggctgtgggttaaatcgtatcacggaatgagttttctgtaacactaagtactacatgagacactaagtacgacattttccttcaggcatcccacatccccggttgcctaatgggggtccggtgtacataaaagggggaaaggacccccatgtggcgtaggccagaaatatacgtgttctttgaacggaaaagcagggagtcaggactcttagagccagtgttgcttcggacgcaaagctgagcctatgcctgtatccgtatattgcagaggggctctccttcaagcccactatgggtgttagcgtcccttggcaaattttggcgctaggccgccggttctgctaatagcnaagacgggttagggaggatggagaccttacgccctctgtatcggttccacgtggaagattcccttctacgctgtcagtggggggcaacaacgggtggggagccgtattgaccgttgcccaaatggtggtcccaatcgcgatg

SEQ ID NO: 499289 - DNA, 929 bp, Homo sapiens
  misc_feature (133)..(134): n is a, c, g, or t
cggacggcagtagcgtgccccgagactctccgcactcactcccgactcgccgagccagaggcagctcgagcccagtccgcgtgcccagcagacagcgccgagagcagccccagtagcagctcatggccgggtnnaacgcctacatcgacaacctcatggcggacgggacctgtcaggaccggccatcgtgggctacaaggactcgccctccgtctgggccgccgtccccgaggaaaacgttcgtcaacatcacgccagcatgaggatggagtgtcctggttggcaaagaccggatcaagattattaacgatgaatgggctgacacattggaggccagaaatgtaacggtgatccggagactcactgctgcaggatggaggaatataagcatggatcttcgtaccaagagcaccggtggggacccacaacttcaatgtcactagtcaacaagactgacaagacgctagatccatgcgtgatgggcaacagaaggtgtccacggaggtatgatcaacaagaaatgtatgaaatggactcccaacttcggagttccgagtacaagtggacacatcggtacatgatacccaaaacaccgacatcagcgggaatacccacaaaagaaataagaaaccacataatctacaccataagaaaagacaaaacatataaataaagaggcataaacccaatacccttaaagaagcaaaaacacacatggcaaggagccaggatgaatgcacagaaacaacgacaaccaaaaacaccgagacaggagaaacacaggaacggggaaaaaaaagaaaaaaaaaaaacaaacaaaaagcaagacaaagacacagacacaggagaaaaaaaaaaacaaggcggagacaggcaaaacaccgccgaaaggccgggaaaacaaggaagaacagaaaaaagacaaggac

SEQ ID NO: 499290 - DNA, 626 bp, Homo sapiens
gcaggcaatctccggcacgtaggagaaggctctgccacagtgacgaaggagtgagaccctagtggcgagtatccacacactcgggtgcgtcgtaactgctagagcgctgatacagatgcctgttacgagtgagatgtcggtgctgagactctaccaggcaccagtggacattatctccaagaaggtagcgacgagtcacgttcacacgctgctcattctggaccaagcccttgccgaccaagtttctcctgatgacttcctcgacagacttttttttctagacgacctgtaagacttaactaacccagtgaaagcagacttggaaatgcttaagactaatgacgacagtactgttgcatacatggtcaaacaagagaccaagcaggacaatcctggtatagccgaagtgctactagatgagctaacgaatgaactgcgtatgttgattgtgacagtggctaacaatgaccagatggcctcaacatattgtgagtgcagggcactgcttttcaagccaaatttttatagaccattacagagggagttttatcaaacgaacaccaaggcatagtgggtataccccgaggttgctcattttcaacttttctcggaggtatcccttggct

SEQ ID NO: 499291 - DNA, 198 bp, Homo sapiens
ggacttaccagtcttgccctgtacgggacttccttctgtgcatcatagctaacatgcgggtgaagcacagctctttttcacctgtcggtgacgcgctgctccctagagatcgtcacgttgatttggcagcaggatcattctctctttgatgaaaatttttgataaatacattctcggtgttcacacagaaaaaaaaaa

SEQ ID NO: 499292 - DNA, 233 bp, Homo sapiens
  misc_feature (8)..(8): n is a, c, g, or t
  misc_feature (27)..(30): n is a, c, g, or t
  misc_feature (84)..(84): n is a, c, g, or t
  misc_feature (88)..(89): n is a, c, g, or t
  misc_feature (163)..(163): n is a, c, g, or t
  misc_feature (194)..(195): n is a, c, g, or t
ctcgtgcnaaaatatttaatttaaaannnnttgtaaacttgcaataatgaaaaagtgtacttctgaagaaactacatgaacgtntttnntggtattcaagtcagctagtgtttataattactggatattgaacttaggggaagctcggctgccctagtaacanaaccagcaaacgtcctgatgacaacgaagtnntgacattagccattccttagggtaggaggaacagatgg

SEQ ID NO: 499293 - DNA, 112 bp, Homo sapiens
ggctatacaaccatatagagatcccaagtaaaatcaataaatttcttacagtgtttcaggaaccgataacgcattgagtggaggctagcatggtggtatcaaggggtgaccg

SEQ ID NO: 499294 - DNA, 105 bp, Homo sapiens
ttcaaaacccttgtataccccttcttcaagcttcggggtgtcttcctgctgggtggtcctttggagaaaggcatttatttctctgaagaaggaggtcagtcgtct

SEQ ID NO: 499295 - DNA, 771 bp, Homo sapiens
agggtgcaccccaccttgtgggtggcagccccgcgtagtccttggtctgtccgtccactattattgttcgtcgctccgcgttgtcctcgcccccgcctgtgtggttatcgctcacccgatcgctgttgacgtggcctccattaactgggggcgcgggccccccgccggagttgtggtcgctcctcttccgtgtgggggccccgtcctgccactgcctccctccacggcggcgaatactctggggggcgcgagactcactttagtgatgacgtgccgcgctaattctcgcacgtgtcgggttgggttatcactagcgtgactccctacatcgaccacgctgtgttttgtggtagtgaacgcctccgcgaccgagtggtgccacgcggtttctctgtacgcgtcggtgcgggcacgcatagagacactcctttgtctcttgtctcttggtgcgcgaggggtgagtgtctttctctctcccctgggtccgcgggcggttgtgtgttctggcccccgtgccgttattggtgcgcccttcggtcgcggtgttgaagacccctatttgtgacccacacatggttcggtatatttctctggcaatcaggcaccttgcggccccttcgtgggtggggtgttagcaccaccgccgctattgttgtatctcacactttggggggttttccccacgaagagagtgtgcctgcatttctttcctcactaccaactgctcgtcgtgtgaacaccacccccacacaaacaataaacaaaacaaca

SEQ ID NO: 499296 - DNA, 585 bp, Homo sapiens
aaaaacagaaagaaaaaaaaaccatttggaagcaagaaagcagagagacaacccacagaatggcagaaaatatttgtaaatcatgtatccgataagggacttgtatcccaaacataaagaactcttacaactcagcaataaaaagacaaataatccaattcaaaaatgggcaaaggatgttaatagacatttctccaaaggaaatatacaaatgatcaactggcacatgaaatgatgctcactaccattgttcattagggaaatgtagatcaaaaccacaatgcaatacttcttcacatccactaggatggctaaaatcaaaaaacagaaaataagttttggatgtagacagaacagaaaccctcatacatagcaggtaagaatataaaatggggcagctactgtggaaaacagtttggaagttgctcaaaacctttaaacaaggagtcaccacaatgaccaagcgattccactcctaggtatatgcccaagacaaaaatggaaacatgatcacccagaaatttgtccacaatgttcaagaccatattattcataatccgcataagtaaaacaatgccacaattc

SEQ ID NO: 499297 - DNA, 415 bp, Homo sapiens
tcgactatacacgatccccatgccaataacctccttttaaaataaatttcccagtcttgagtagttctttatagcaatgtgagaacagactaatacaatggtctatgtatttaactgtgtttttgtggtggccaataattatctttggtttctatgtttagcactcccttaaggacctcctttaaggcaggtctggtgataacaaattcccttagcatttgcttttctgaaaagaaatttatttcttcttatcttacgaagtttagtttggctggatacaaaaattcttggttggaatttcttttctttatgaatgctgaatataggctcccaatctcttctggcttgtagggtttctgttgaaaggtctgtggttagcctggtggagttcctgtaaaggtgacatgccctttct

SEQ ID NO: 499298 - DNA, 243 bp, Homo sapiens
gacggatcccctcacactttttgcagacgcagcacacaggatccaggagcccagtgtttagatgaagctacggactgagcgagctaagctagcaagcagcatttcgtggctgaatatcggaaaagagtccaggagccagtgcgatttggtgaaagaagctaggaagaacgaaggagcgctaacgatttggtggtgaagctaggaaaccggattctcggaaggagcgagtgcaacaagtgtgct

SEQ ID NO: 499299 - DNA, 1109 bp, Homo sapiens
aggcgtcatcaacctcaagtgccatttaacaagattgccccctgtctgaagccctgtggaccctgaccttctcctagcgtgccgagaccctgcaggcctctgccctgaaggcctggggcggtgcaccgaaggagtaacctgaacggcttgcgcaaggagtgcagtatgtcgagcgatgccctggccaacagccttgcctgtccactgaaagtacactccgagcggtcaggctggggctgcttgccagacgagtccctcttcgtctctaaccacgccgtattaagcggaggtgttcccagggcgtgcgccccatacatcgtccaggcccatgtcccgcctcccactcgttgaagacggaggcctgctcctcggggtctccgggctggcttgcccgacgctctttcttccctcgtgacatggtaggtgtgtggtgtcgtcatgttggaatgctaggttccatcaccctttaccggtcactactgaccataataaacagcgtatttacagggggccaccttaacacagactcaaaagagaattgctagtgtaccgtacaaggagggccggcatcaaaagcagggatcccgccgcgagaggggcgggcccgcgaaaaatatgtcgctggccaaccgcacccggtttcttgtagtgcttccaaaagggtggcctcctaccacaaggcgagcaaccgcctactctaaggcctaacgaatgaggtgcccagcgagttgcaaacagaccctgactgcttccgtatgtggaacacgactgcctcacatttgacgagacgcactcggcggagagcccgagcgaccacctgttacccaccggtttgcgggaacggcccatcccaaattgaacttgtcgggcccaaccacgtgacaacgcctcgggagggtatgccaattacccacgctcagaacgcatatcacactcattaaacagcttgagaatcggcggttaatcgacggtcggtcgacacacacgtatcggcgtaaactcctcattcgaccgggaaccacaaatagaacttggagaacgcgcagcggacactcgtatcatacctgacaacatttattacaaccgccgcgaacactcttaggacaact

SEQ ID NO: 499300 - DNA, 874 bp, Homo sapiens
gactagttctagatcgcgagcggcgccctttttttttgaatacagggtctcactctgtcaccctggctggagtgcggtggcgatcagagctcactgcagcttcaatctcctggctcaagtgatcctcccacctcagccttccaagtagttgggactacccacatgcaccaccatgcacggctaattttttgggtttattttggggttttttgtttgtgttttttattggtttggtatttttgagacagagtctcgctctttcgcccaggccggactgcagtggcgcaatcttggctcactgcaagctccgcctcccgggttcacaccattctcctgcctcagcctcccgagtagctgggactacaggcacccgacaccacgcctggctaatttaggtattttaagtagagacggggtttcaccgtgttagccagggtggtctcgatctcctgacctcgtgatctgcccgcctcaagctcccaaagtgctgggattacaggcgtgagaccacgaacccggaccttgtcaggtaaaagtaagtagagacaaggtctacactaacattgcccaggtgggtctcaaaactcctgagctcaaagcagtcttcccacacttggcctcctaaagtgtggaaattaatagcatgaaccactgtcaggcccttaagaacagccctatcagactctaacatcctcgaaaccagaacaggaaaaggtgatcgtgaattgacaagtttatgacaagacttataaagcagaagtctgtacgaaaataatagaccattggggttggtataaactccaagtagtttgagacactcttaataaaggcaagtggagtaaaacaacaaagaaaaaggaggggggaacaaggc

SEQ ID NO: 499301 - DNA, 203 bp, Homo sapiens
tgtgtgtagcccactgcagtcgtcagtgggggccagaaggaactggtggcagcgagcaagatccccggggacaagaggcatgtctggttcggcgagaagcatgaccgatggattccagttcgagtctggcggccagggctccgagcctgccgatgtggccatccagctgaccttcctgcgcctgatgtccagcgagggctccc

SEQ ID NO: 499302 - DNA, 210 bp, Homo sapiens
tacccaccacgccaccggagaagcggggggggaatctcttttgcattttctagggccactcctgtgtcatactatgaggtccccaaagactagaggtctaatcggagccgaagccgccagcctatgccatagcaatgcaggatctgaaccacatctgtaacctacaccacagctcatggcaatgctggatcccttctccggtggcgtggt

SEQ ID NO: 499303 - DNA, 174 bp, Homo sapiens
ctgacggttcccgatgctcacttcatcgcgttcttctttcttcggtggagtttcgctcttgttaccaggctggagtgcagtggtgcaatctcggctcaccgcaacctctgcctcccgggttcaagcgattctcctgcctcagcctcccaagcagctgggattacaggcaggaga

SEQ ID NO: 499304 - DNA, 608 bp, Homo sapiens
gagaagactgtacacaattccagaagagctgccctgaaggagagaacaatgtcatcactacccgtaccatacacactgcctgtttcacttgcctgttggttcgatgactgtgtataatcactagggaacaccgatacctcagctttgtgtcatggacccacagactggaggtgcaatttctagcactgggagtgtgatgatggactcaggatattgctttccaattccgagctggccctttggtcatcctgcaatcatgaacaggtcgtgtgttgggcatatggcagcatatgaggagaagatgctactatttaccctttgaagatggcaaaccatttgagctgtgcatctatgtgcgtcgcaaggaataccaggtaatggtaaatggccaacgcatttacaactttgcccatcgattcccgccagcatctgtgaagatgctgcaagtcttgagagcatatctccctgacccagagtgctcatcacgcgcatcgcaggcgcagcactgatcagactccctcattgctcgcagcgaatcccctcctttctaccttgacccactgggattcccagcagccctactaaccagaactacatcccctccctca

SEQ ID NO: 499305 - DNA, 656 bp, Homo sapiens
actgggtgcagtggctcgcgcctgcgatcctagcactttgggagcctaggcaggaggattgcttgagctcagttcgagaccggcctgggcaacatggggagaccctgtctctacgggaaattaaaaaattggcttggcatggtggtgcacgactgtggtcccagctactcgggaggctggggtgggagagttgcttgagcccgggaggtcgaggctgcggtgagccatgaccacgccgctgcactctggcctgagcaagagtgagaccctgcgtttaaacaagacaaaacaaaaacaaaaacacaccaaagctaaaagcttctctgtgatttaaaagatgtagaactagaccagcctgtccaacatggtgaaatgcaacctccaccttctgggttcaagcctcagcctcccgagtagccaccacgcccagctaatttttgtatttttaatagagacagggtttcaccatgttggccagtctggtctggaactcctaacctcaggtgatccggccgccccagcttcccagattgccgggattacaggtgtgaaccaccatggcagccttctggcacttgccagcagcagcaagagcctcacggtgtcccccggctcccctcagaccaagctccccagcgtgccgcacagagggtaca

SEQ ID NO: 499306 - DNA, 103 bp, Homo sapiens
  misc_feature (58)..(58): n is a, c, g, or t
tctagacggatccccgcttacaaccccaaaacggtcacgaacggtcgtgacggccccngctttccaccggtccctgtacttcgtacctgacacacactcaacg

SEQ ID NO: 499307 - DNA, 97 bp, Homo sapiens
ggatttgctggtgcagtacaactaggcttaatagggactcgaattcgagctccctgttgaacttgaacctaaaaggaccattcaaagcctgaaaaaa

SEQ ID NO: 499308 - DNA, 108 bp, Homo sapiens
  misc_feature (97)..(97): n is a, c, g, or t
aaaatttcattgcactgaaatgcaattttaaatgccatgtgtatgaacttgttttccttaatctttaagatgtcagtattcatgtaaataaacaatngatccagcttt

SEQ ID NO: 499309 - DNA, 194 bp, Homo sapiens
acattatttataatacacactatatattaatattatatatgtcagctctctgttcccttgtcaaattcaaatatggttcttaaggtaggtcatctgtaattatttggtgaatgaaacctgtccatgccaggtcctctatcaaataggggcacacaacttattacaatagccatatacctggatattgcaaagtc

SEQ ID NO: 499310 - DNA, 404 bp, Homo sapiens
  misc_feature (45)..(45): n is a, c, g, or t
  misc_feature (56)..(56): n is a, c, g, or t
  misc_feature (345)..(345): n is a, c, g, or t
  misc_feature (397)..(397): n is a, c, g, or t
gcctgggagaccgccgggagcccgacttcctggcgctttgcctcntgggaagtcgncaaaggaacagcgccaacctctctccacaagccagggaccctacaacccaccgcctcaggccagaaccagcagctgatttagataccatcaagacacctaaaaccttatcatgagccagatgctgtggaagagattctgggagaatcctgaggaccccccagttgcagccatgtcaagactgatgctgaggaggaccccaactgttcacgagcaacacccgttcgaacacagccaccttacttggggaaagattcaagaagctgttcacagatggtgggaaggaaaacntgagggaaagcggggacaaccagttcacaatggagttattttaattgttagntattgag

SEQ ID NO: 499311 - DNA, 532 bp, Homo sapiens
ttgaatataattagctctacttcaaattgtcggcctataatccctcagcagaaacaaatcatttacatagtaatcccatggggaagaaaatgactgtgattcataacatttaaaattttaaacaaaacaacagcaatgatgtggtcatctattcattcaacaaatgtactaagtaccttctatggaccagatgcgaaagccctggagatggaatcatagaattagaaattaagaaaactgtatggattatgcctataatcccagcactttgggagcccgaggcgggcggatcgcctgaggtcgggagtttgagaccagcctgaccaaagtggaaaaaccccatctctactaaaaatacaaaactagccggggggaggggggtggcgcggtggtgcatgactataatcctagctactcgggaggctggggcgcaagaattgcttgaacccaggaggcagaggttgcagtgagccgagatcacgccattgcactccagcctgggcaacaagagcaaaactctgtctcaaaaaga

SEQ ID NO: 499312 - DNA, 319 bp, Homo sapiens
tcctgtccccaacgaagaatccgggggcccctgggccagtcccaggacctttgcacaggaatgatgggtataacttaccccccccgggaggcaggaaaacagccaaaaaccccctttacccttttggacatttccagttttggagagtttattggcaattgcttttcaagtttaaccagccccaccagggggcataggccctttccaggggggtttgtcccccaatggtttgcctcccgttccaaaaccccctcatcctcaggttgccccaactggttggacggcaggaaagaaaaataaaaaaaaatgggttttgtga

SEQ ID NO: 499313 - DNA, 81 bp, Homo sapiens
atgcagaagtagggttttggcctaggtaacggggcagagatgtggttcgagattctccccggactctccgtcatgggcgtg

SEQ ID NO: 499314 - DNA, 118 bp, Homo sapiens
atagaacgagagatatatcaaaaggggatctaaaaaaattccatacaggaaggcagaagaaaaggcaaatgaaaaggggaaaccaactaaaaacagaaggggatctgggcctcgggcg

SEQ ID NO: 499315 - DNA, 360 bp, Homo sapiens
acatataaagccccatgcgggagtctcatacatgagccagagacatacctatggacgaggcacgatgagacctgaaacactgacacatttaagccatggttctacacaagtacacaaaaacacgtctgaaaaccctgcacacaaacttagaccagtgatggtcaccacctgaataataccaggacaccatcaatgaggaaaccatggaaaactccttgagacagacatatagctcttgcctacatgtaaactttatcacaacactggtgcaagtattatagctaacttacaatacacatatattacaagctctaccactgttgaaaaatatgtcattctcatttgatcactatgttcaga

SEQ ID NO: 499316 - DNA, 532 bp, Homo sapiens
ggtcgtcgctgccgctgccgtgtgccagtgtcacatgtcacctcgcggatcaggagccagcgttgttcgcgccgacgcctcgactgtcggtgggaggaagcgagagggaagccgcttgtgggtttgtcgccgctgctcgcccaccgtctggaagaggccggagctgcctcgtggccatgctcgtggtcgctattggctgaacggatcgtagactcgtttacccgcgggtcggtccatgagccgtcgtacgggtagaggcgctgcgcccaatgggcgttcgtggagccgagttcagaaggatgtatgatctaatcaacggtccattctcaaacagatagaaccgtcccagtcggttaatggttgatgaagccgatcaatgaggacaacagttgtggtgtccttgtgccagatccaagatggatgacttgcagtgtgttccgaggtgactacagtgttgctgaaaggaatgtaagagactgagaagctgttatgcatcggccttttgtgatgatacttgttctgatgagtaaga

SEQ ID NO: 499317 - DNA, 335 bp, Homo sapiens
caggtccacacttgctgccgccccggaggcagattgccgcggacatcccagtaagtggttgttcccttgcattgtgacgaaagcttggctcctatatgcatccaggctctaggaaaaacatggcctgctattgcagaataccagcgtgcattgcaggagaacgtcgctatggaacctgcatctaccagggaagactctgggcattctgctgctgagcttgcagaacaagaaaaatgagctcaaaatttgctttgagagctacagggaattgctattactcctgtaccttctgctccatttcctttcctcatcccaaataaatgccttgttacaag

SEQ ID NO: 499318 - DNA, 385 bp, Homo sapiens
  misc_feature (51)..(51): n is a, c, g, or t
  misc_feature (167)..(167): n is a, c, g, or t
  misc_feature (208)..(208): n is a, c, g, or t
ggcctcagaggggaggaaatgagcaccagttggtccatgggcagccacggnaggcatacaaaagacaccacaagttcccactatggtccatgggactggcatgcttggcccccagtcttcagggtctccctggcctcaaggtggggcctcaccagggacccaccccnttcctcccaggaacctgtgtgcctcctgctgccattcatgnacccaggctgtaggtgccaaggtgcactgcaggccagtgctgagctgccctcagccccttgtcaacttccctcctaaggcacatcagtgccaaatgtctggaagggggctgagctggcagggggctggcatgtcagcactggcactgagcatgtgtacatctgactgggctgcgaca

SEQ ID NO: 499319 - DNA, 295 bp, Homo sapiens
  misc_feature (213)..(213): n is a, c, g, or t
cacggctgcaagcagctgtgaccaggagtacaaccctgctgagcattatgggacctaccaaaagcatatttatgaattccttcagctaaataagccagaatcagtgtctcttgctttaactaaggacattatgtgatagaatgattaactaaacttttaaaaagcgaactgttaggcttaaaaaattcccatggattggatttgatgcatggngcaccaaatttgaaacctccctgataaattataaggtccttctggggggctcgtggtctcactggcctcaagagtgaaaccg

SEQ ID NO: 499320 - DNA, 516 bp, Homo sapiens
  misc_feature (17)..(17): n is a, c, g, or t
  misc_feature (28)..(28): n is a, c, g, or t
  misc_feature (51)..(51): n is a, c, g, or t
  misc_feature (73)..(73): n is a, c, g, or t
catacacatttgaaacntctgcgtctangcgttgattacgagacaatgatnttaaaggggggatctgtagcangtgacaacttaaatacaagttcagagaacaatgatgagaagattgtgcagaatgctataataaaaaaaataggattttttggaagtaaactacaagattatcagaggtcagaaatcatgatgttaattatggggaaagtacatgtctttggaaaatataaaaataatttggatataagtaaactaggggatttgggaaaaaggagaattaagataatgttgatgagatctttgattatggtgacctctggatataaagagaagaagattgttaatgaaatgaaagggtatttaatggataatttgttataacaatctataatggaggactacgaactgagaaagttggtattggaagtaatgacataatatcatggatcgtcatgacaatagggaaaagcttcgagggataagaataataacggatgtagctgacctaaagat

SEQ ID NO: 499321 - DNA, 141 bp, Homo sapiens
  misc_feature (8)..(8): n is a, c, g, or t
  misc_feature (11)..(11): n is a, c, g, or t
  misc_feature (32)..(32): n is a, c, g, or t
caatttgnttnatcaacgaatgaaaataggtnagagaggcattccagatactggatggggttctacctgatctcatttcataccttattcctggtttatatgtaggctgcttcctaaaaatggttaactcagggctagagg

SEQ ID NO: 499322 - DNA, 400 bp, Homo sapiens
aagaggatccccttcgacggacgcattcaggtggtttggatgagaatggctgttactacgagggctatgtggctgattgaagagtatgcaatgcgggttttatgttgttaatgtggtgggtgagtgagccccattgtgttgtggtaactctgtagagggagtatagggctgtgactagtatgttgagtcctgtaagtaggagagtgatatttgcatccaggcagcaacgtggttactcagcgccagcagagtctccccagtaggttcacatcagtggggggtaaggcgcaggttagcgaggcttgctagacagtccatccaaaacacagctcattcagtgggcagtagcagtttgccagtccttgcagcagcaggcattcatgcatgcgcactgtgaatg

SEQ ID NO: 499323 - DNA, 394 bp, Homo sapiens
  misc_feature (37)..(37): n is a, c, g, or t
  misc_feature (40)..(40): n is a, c, g, or t
  misc_feature (47)..(48): n is a, c, g, or t
  misc_feature (52)..(52): n is a, c, g, or t
  misc_feature (85)..(85): n is a, c, g, or t
  misc_feature (107)..(107): n is a, c, g, or t
  misc_feature (114)..(114): n is a, c, g, or t
  misc_feature (140)..(141): n is a, c, g, or t
  misc_feature (149)..(149): n is a, c, g, or t
  misc_feature (154)..(154): n is a, c, g, or t
  misc_feature (178)..(178): n is a, c, g, or t
  misc_feature (195)..(195): n is a, c, g, or t
  misc_feature (240)..(240): n is a, c, g, or t
  misc_feature (242)..(242): n is a, c, g, or t
  misc_feature (278)..(278): n is a, c, g, or t
  misc_feature (284)..(284): n is a, c, g, or t
  misc_feature (354)..(354): n is a, c, g, or t
gagagtgatcatagaggacccctcacgccatgtcacnaantatcccnnaggnagctgcagtgaggttcttccttaaagagcaggngcagcctgtgaggtcaacaggnatagttnggtgacatgggaatgggttgggcctnnattagcanagttngtgtcgtaaggtgagactcatgtnacatttctggaatagangttattgactgtggacatgcttatcaactccactggccgtcattntncatacatccagcttacatcacttactcactgacttnggggtnagggtgggtggatggggtggcaattaagcctcctgggaaaaattgggaagctcagtatctcagtaatggntgaggcagcagtgaggctgagcaaaagttaatcagtgatt

SEQ ID NO: 499324 - DNA, 442 bp, Homo sapiens
  misc_feature (50)..(50): n is a, c, g, or t
  misc_feature (91)..(92): n is a, c, g, or t
  misc_feature (136)..(137): n is a, c, g, or t
  misc_feature (169)..(169): n is a, c, g, or t
  misc_feature (194)..(194): n is a, c, g, or t
  misc_feature (256)..(256): n is a, c, g, or t
  misc_feature (364)..(365): n is a, c, g, or t
agaaacttgtattaactgacaggtacaggtgcttgttgtacgagttcttnttttacttgtattcttagcattgctccgactcatttccaanngggttactttaggggtcaggcaccttttattttcctccattccnnttgtcagatgagggtttgcttgttcaatcacnatttgggtaagtattacgttatttngtggttggtattcgtgggtattcgcgatctgtgggggcgttccgttgacactctcctttaanaatagacgttttgtgtttgcaagttgtagcgatagccttgaaggatttcgccttcgttttggtggttgggtatgagttgtatataggagtgttgtgacaaagtgaganntataggtagtaagtgtgcccccacccattacgaggtagggtatacgataggtaagtttcatctccgcttaaaaagaa

SEQ ID NO: 499325 - DNA, 640 bp, Homo sapiens
  misc_feature (332)..(332): n is a, c, g, or t
tggagtcaaggtctcactctgtcacccgggctgggagtgcaggggcactatctgggctcacggcagccttgacctccgggactcaagcagtccctccttacctcagccctccctaatagccaggggctacaggcatataccaccagtgcccaactaatttttaaatttttggtagagatgagtgtcactagtgttgcccaggctggccgggaactcctagcctcaagcagtcttctggcctcagcctcccaaagtggcgtgggattacaggcgtgagccattccacccagcccagattaaagtgttttaatttctaccgtgccatcatgggntcttaactaagtgaaggtgacttctttctttaccaattaaattagaactgggtatactaggcaaaaaacaaaaaaaaaaaaacccgagagggaacttctatggccgggagcgcggagaaaaaaagaaggtgtaattctggaaacgggggcccatgggggccaatagggtggtatctccttggacccaagttttcctttggtcaccagtgggggtgaaaacctggcgggggcccccaaaaatgggaggcgcgaaataaaatcccggaaaaccccaggtgtacctctggcttagtgtctctcacacaagt

SEQ ID NO: 499326 - DNA, 642 bp, Homo sapiens
  misc_feature (258)..(258): n is a, c, g, or t
  misc_feature (370)..(371): n is a, c, g, or t
  misc_feature (418)..(418): n is a, c, g, or t
  misc_feature (436)..(436): n is a, c, g, or t
  misc_feature (451)..(451): n is a, c, g, or t
  misc_feature (505)..(505): n is a, c, g, or t
  misc_feature (510)..(510): n is a, c, g, or t
  misc_feature (534)..(534): n is a, c, g, or t
  misc_feature (537)..(537): n is a, c, g, or t
  misc_feature (544)..(544): n is a, c, g, or t
  misc_feature (547)..(547): n is a, c, g, or t
  misc_feature (562)..(562): n is a, c, g, or t
  misc_feature (575)..(575): n is a, c, g, or t
  misc_feature (581)..(581): n is a, c, g, or t
  misc_feature (619)..(619): n is a, c, g, or t
gccatgcgcgctgcccgcgccgcgccgctgctccagctgctgctctctgctggggccgtggctggaggctgcgggcgttgcggagtcgccgctgcccgccgtggtccttgccatcctggcccgcaatgccgaactactcgctgccccactacctgggcgctctgtgagcggctggactacgccgccgcggccaggatggccctctggtgtgccacggatccacaatgtggacaacaccacagagatgctgcaggagtngctggcggctgtgggcgatgactatgctgctgtggtctggagtgcctgagggcgagcacacagtgttctacccagatgaagaggtgtcccaatgacactgtgaccaaagaannggcaccagttttctgataggagctggaagcaggaacgcccctcaccntttgaccaggtaactggngggcgccgaactatnatcgctagttttgacagacgacagcacaaacatttctgtacacaatcaatacangactnctgacgggcttactgcatgggggncangggggcnttnccagctggctgggcncccaagtgcctgngagctncccagtagcctaactatctcccaaactctctagggtgntggggaatcacccccccaagggg

SEQ ID NO: 499327 - DNA, 147 bp, Homo sapiens
gcagaggatcccctccataaggtgtgcccaaatagaagcagtctgattaaattgtgtgacacacaggcctcagattcttgaaaaggctttagagaccaggcatgtggcttatgcctataatcccagcactttgagaggctgaggctg

SEQ ID NO: 499328 - DNA, 226 bp, Homo sapiens
tccccccaattttttataagaaaccttttccaagggggcatctttgggctctctggttttaaaaccttttgaacccaggcttggagccggcagaggaggctggggctgtgggcttccgcccccccctcccccttggtgttcaaaaaaattcccggttccggcccttcccaggtggaaaaggtggtcttttttttttttttttcccataaaaagccccttagcttta

SEQ ID NO: 499329 - DNA, 760 bp, Homo sapiens
  misc_feature (25)..(25): n is a, c, g, or t
  misc_feature (248)..(248): n is a, c, g, or t
  misc_feature (290)..(290): n is a, c, g, or t
  misc_feature (295)..(296): n is a, c, g, or t
  misc_feature (298)..(299): n is a, c, g, or t
  misc_feature (594)..(594): n is a, c, g, or t
gagagaactggctcgagtagcacangagatctgtgcttcacttttgcattgtttccgttggcttctctgtcttttttaaacacaacaattgtttgttgcacctccggtttcctcacatacttttgaacaaaaaatgtccaccaacccccccctgcctccgttttgggccacaggagttaatcacttttttggcaaaccccataaacaaagaatcctttcacctgcctaacctcgtgccaaattctgcncgaggtgaatgtccaggaagacttttggtaaaaaaggcgccnaaagnntnncttttgggaagaagaaaacctcttggaggggcttgtaggaatctacatgaagcgattatgtggaaactggtttccccactcccccggattcccttttgctatacttaaaggcccgtaccttgcctctgccctggattggttggcaaactaaaggacttgacgtcataactccggtgccttttcccttacaaggtggggagtgcccctggctttcgcctttgtttggtgctttggcctcgggtgcattttccaccgcccttccatgggccttttgtggtccctggggagctctttnctcataattttgcgaattttttttgtggggttttcatacctactttcggcgcctaaattgccaaaaggaaagggaccgaaagaacctccttatttgtaatgaggattggtttagcgctgattttaaaccttatgagctttttgtccacatatatgggggggtttgg

SEQ ID NO: 499330 - DNA, 528 bp, Homo sapiens
aatttttaattaaaattatatttaaaaataatataatcactcaaaacccaaaacccaccaacaacaacccactctcctcccccaaaccaaaccaaaaaccaccaacaccaacacactatatcccccaacaatacactcacttcctaaactttacatcaacacccacacacaaccaacaaactaaaccaccacacctcccccaaccacaacaccccccatcacaaacacacactaacacataccccaacccccccaacaaaccaaacattacacacctcataaaacctcctcaacaccccaataaacctccccacaaatttcataatcacttccacccaaaacaaaactcccaactaaaccctttttgaaacacaaaattcctatcaccaacacactaacccacacacctaaccaaaaatccaccattctcacacctaataccaaacccccaacacacaccccccccacctccctcaccacacccactcccattcaaacacaacaccacacctccccaaaccgatccct

SEQ ID NO: 499331 - DNA, 126 bp, Homo sapiens
caaccagtgtgtccacggtcacttagagattgctcaagtaagatgcagtgtaagaacagatcactgagtttttccaacatagacttactgggtgtacttgacttcagtaattgatctcatgcaaca

SEQ ID NO: 499332 - DNA, 301 bp, Homo sapiens
ctccaatcctacacaagccctatgatggcagagcatccaactgcgctacctgctcagagtggtgctcaagacactatggaaacaccagtatgcatggcctttccagcagcctgtggatgccgcccagctgaacctccctgattactatcagatcattacaccgcctatggatctcggaccaatacagacgcgcttggaccacaactattactggcatgctcacgactgtatccaggacttcaacactatgtttaccccttgttacatctacaacaagcctggagatgacataatccaaagg

SEQ ID NO: 499333 - DNA, 317 bp, Homo sapiens
atagtcgggcttgggggtgccaccggtatccaggtagctgccactacaggtgccgcaccaccacgccgggctaattttggtatttttagtagagacaggtttcaccatattagccaggggggtctggaactccggacctggtgatccacccgcctcggcctcccaaagtgcggggattacaggcgtgagccacctggccgggccaaaaatctcagaatttctttaagacgtgtttaattggctccagtcagtaatttggaacgcactttccttttttttttttcccccttttgggtccctttcccccaggcccacca

SEQ ID NO: 499334 - DNA, 299 bp, Homo sapiens
  misc_feature (132)..(132): n is a, c, g, or t
gcggccgcgtcgaccagcacggcctggcggccaaggaaggccgcggcgttggggatcgagatgtcgacctcacgatctccggaccgctgtttctcgcagaccagaaacggcgcatcggcgccggccgccacntgcgccacccactgctcgctctccaggtcgggcccgacgatcaccggccgggcgatgttctgcttgatccatgacgccatgagcggcgcggcatgaacaagctgggtggggatgcggtagatctccgccaaggcgtgatagcggtgcaggtggggatcgacggtcac

SEQ ID NO: 499335 - DNA, 83 bp, Homo sapiens
gtttgctttttaaaaaaagcaaaagcccaaactttggtttttcctaaaaaaccccaggggccccccccgttttttccaaatta

SEQ ID NO: 499336 - DNA, 732 bp, Homo sapiens
ggcctatgctgatgaagccaagaagcgctctaagcccatatgtgaagacttaccttctgcctgacaagctcccgccaaggtaaaatagaaaataccagcatcaagcgggacacgtagttaatccactatatgatgagacgctgaggtatgagatcccagaattctctcctggccccatgcagcgaccgctgtcacgtttctcatatttggcagtcagtggtcgttttggcagaatacactttccttggagaggcagagatccatgatggattcctggaatgcttgataagaaactggatcattgcctccctttacatggaaagactcagtgctgagatccccgacgtggcttgccatcacacaaaggcgagttggctggtttcattgaaagtacatcccagcctccaaaacctcctgttggaggctgaccggaaaaagagtaacggtggggaagggggagagctccatggtgtggatcatagagaagccaagaacttgacggctgccaaagcaggagggacttcagacagctttgtcacgggagtacctcgcttcccatgagggaagcaaggccagtaaagcgtaaatagtcctgtgatgaagaagaacctgaatcctcactacagcatacattggtctacaatggtgtgagggtgggagatctacagatttgtgctggaactgctgtgttggaccgggagccccgggcgatggtttctgggcgggggcgcg

SEQ ID NO: 499337 - DNA, 207 bp, Homo sapiens
  misc_feature (19)..(20): n is a, c, g, or t
  misc_feature (54)..(54): n is a, c, g, or t
gcagaccagaagaatagannatggaaacgaatgaagcgtcagaaaaaatggcgngtacaacgcgcgacctgcgtctgaaaagcctgcaaaaaaagaactctcaaaccactgtaatttaacttttctacgctttcagccgagacagatgtccagattcggaaaggcaagctgagtggcaacgccacccgaacttagcactatcgtggt

SEQ ID NO: 499338 - DNA, 578 bp, Homo sapiens
tgtcgtcttgagatcaacgggtcaagtacccctcaggatcctatttatacagtggcctcagcaacatgttccaatttctcctcagcacttgtatctcagattgcacatttatgggcatgattatttgatgtacgtctctctcccacactctgggtccgtcgcctgtgttagatatgtgtgcgagtatccataaacagctgttaggaagacatccgtgaagttctgaggactctgatggcaccaagtggagcttgcaggtgtggcttgagaaggtgcagtgtgaatgataggcctagggtgataggccgagaagatcggtcaagcccagatatgacccactgggcctgtcagtgtccaggaggtggggtgaggcaacaggtctaaggttctggatctgtcagtaccacctgaggagttgggaatgggcacaggtacaaaagtgatgagtcttcattgttcaacaaagaatggcaacaggtgtgaggatctgggtatgtcagtatctgaggatgtggggcctggcacaagtatgaggcactgggccactgtacaagcaggtgggctgaggacagcaatgt

SEQ ID NO: 499339 - DNA, 1182 bp, Homo sapiens
gggccatatcatcatagctaaagagcccagtgccatgacccctaacaggggccctctcagccctcctaatgacctccggtcgcgtagccgatcgtgatttcgacttggccactaccagttagagcgtcgtccctcatgactaggacctactgaaaccagaactagcgactaatgcatattaccaagtgagtggcgcgcatgtaatcacgaggaaagcatcataccgagaggtcgcgaccgagataccagctggtccaaacaaggcctgtcgatatcggggataagtcctactttagttagctctcagaaggtgttggtttccttcggcaggatgttttcgtgagcctcttgtaccatctccagtccttaggcctcctaccgccacaaagttgagggatgggcactggccccgcaacaaggcagtcacccctgctaaatcgcccgtagaaagtccgcagctcgctagaatgacatcgcgtagttacgtcgcatcagggacgtatcaagtcacctgagctcaccatagtctaatagaaaacaaccgaaaccaatataattcaagcactgctcattacaattttactgggtctctattttaccctcctacaagcctcagagtacttcgacgtcgtcccttgcaccatttccgatcggcatctacggcctcaacattttttgtagccacaggcttccacggacttcacgtcacttattggctcaactttcctcactatctggttcatccgccaactaatatttcacttttacatccaaaaatcactttgggcttcgaaggcggcggctgatactgacattttgggagatgtggttggactattgccgtatgtctccctctattgatgacggtcttaacccaaaaaacaaggcgcagacactgcgccccaacaaaaccagcgcgcgctcacataggcgggcgacagcaatctccacgacacggccaccgcgtatccccaccaccgcgcttgcacaagagaacacgccgcaaagagaggaaataaaccacggggctcacgacacacgacggacgaacaccacaccagacacgacgatcacacctgggaccaccggggaaccagaaacaagaacgacaaagagcacacacacgaccacacaagacaccacaccgatcgaggccctacaccgcgccgacccagacgagcc

SEQ ID NO: 499340 - DNA, 781 bp, Homo sapiens
ggcctgatgttggatgtgttgcttgcagcacgagtgctgggatgctgtggtgagaacctgtggaagtgctgcaaacctcctctccatgctcaatggcctgactgtcaacctgtcccacatgctgaaatgatgtgtgtgccctccatgtgactgccctgctgcagtgcttgctgtggttttgttcttgcgagatgactgcatgatgtgtgcatgcctgtcaccactgacgtgagcctgtgactctgcgggatgctgctgtgtgtgatgctctgacctgtgacttgactgctgggctgcacgtgccatgtgccccatgtctgacacgctgtgacaggaacgcactgccaaaattcacttctcgcttctatgaacaaacgaatttacgttttaaacgaccttgacgtgagacatgcacatggttgtacactgtgacacgccacccaagtgacgcctagctgagaagttgttccgacaccgtgatgtgacgaatggctgcaagcaaagatgtgcagaactgcttagcgtgcattggcagctttggtaccacatgactcagtagggtaacacctattgaaggggaatttcacacgcgtgggaatgacatgccatgaattcttgttgggacgatcagtgtcgtgagacgagccaaccaacggaacaactagggaactgcgcggactggtccacgcaaggaactgcccttgcctccttcccgggacattggacacgttgcgatgggactcttggacccaaaaggacaccgctacagaagaaaccaagg

SEQ ID NO: 499341 - DNA, 294 bp, Homo sapiens
  misc_feature (171)..(171): n is a, c, g, or t
aaaaaacatgtcctggaaagtttctggaagcagaggtttgaatcaggtggctcagatgtcacctcccgggctcacatactcagaaaaggccaaattctgcaagtctaagaataactagttggtaccagtgtatgagctacaagtaaagttttactctttttttctcttctnttctggaatactttttaaatgatgtaatatatcccctacggaagattaatttgaacatagttgttttaaagaataaagatcacccaagccagtgactcacccctgtagttccaacattttgtg

SEQ ID NO: 499342 - DNA, 396 bp, Homo sapiens
aagggaaaaaggaggaatgttgggttggaggcccctggaaccaaatggcaaaagggggccagcttcctttcctggggggactttggccagttcctttaaaaaaaatggatgcccaaaggcctcccaaccctgggttggggtcaaaaaacagccaccaaaagttaggggccttagggcactgggctgttgttccattaaaaccgactttggccctggcccttacttggttttttagctttttaggcctttccagtttgcccctgtcccccccctccaataaattgtcctgaagcaaaaagtcccccctcccccttccattttcccccactatttaagcacctccaggcccggggctataaaacctacctgtttttcaataaaccacgggttaagcca

SEQ ID NO: 499343 - DNA, 294 bp, Homo sapiens
gggcttcatggtgcgcgtgaagcgtctggggctactgcgactctagatccgacttgcccaatgtgacatacatatgaccctgactttgaggatagatgtatctgggggagacagagacagtatatcgtgccatgcaagtaagaccattggacattctgttgcttgctgtttacatgagaaccagactgctactaagctcatgacttaagcctgatacgggttgcagacagagagtcctgctaagtttagaggagctggaactgacacagattacaatcgcgactttgtggtccg

SEQ ID NO: 499344 - DNA, 388 bp, Homo sapiens
  misc_feature (11)..(11): n is a, c, g, or t
  misc_feature (13)..(13): n is a, c, g, or t
  misc_feature (145)..(147): n is a, c, g, or t
  misc_feature (192)..(192): n is a, c, g, or t
tccccccccananaaaagagtttttttctccccctttccttttaaaaaaaagatccccctcctataaaaaaaaaaacccttctcccaaaaaaaaaaagttttccaaaaaaacccctccccccagtgggttcctcccccccccccnnntttttttttttttgtcccacaccccttttttttttaaaaaaaaantttttttttccccccgggggaaaaaaaaaaaaatttttttccccaccctttttttttggggtttttttgcccccgggttttaaaaaggtttttttcccaaaggggatttccccccaaaggccggttttttagggggtgaaccccatcccgggtttgatccagggggcaatcccaggacggggttctaactcgtgca

SEQ ID NO: 499345 - DNA, 214 bp, Homo sapiens
  misc_feature (62)..(62): n is a, c, g, or t
tagaggatcctgactaaatggctgtcactcgaaagagacgttatgaatgcagggtgcggganagcttaattctccaattattcaatccatcaagaactcacactggaagaggtcctataaatgtagggaaatagtgagagccttcacagtttccagtttctttcgaaaacatggtagaatgcatactggaggaaaaacgctatgaatgtaaata

SEQ ID NO: 499346 - DNA, 347 bp, Homo sapiens
ccatgccggtggagctctaccggaatggcatcatgatgctcgacggtcccttccagcccttctacgatccctccacacagcgctgcctcagagacatatgggtcctctttggctgcgtctgagctccagcgactgggccccaatgatttttttttgcaaggcgataagctgctcctcataccacacctttggggatgttgaagggagtggggatacacagcctccccagacacctcccattctgaggggaagccgctgcactccctgggggaccccagtctgatgccctccaggaggataagtctgaagccgggctgggaagggagcggagaggcccgaaacagagc

SEQ ID NO: 499347 - DNA, 223 bp, Homo sapiens
  misc_feature (1)..(1): n is a, c, g, or t
  misc_feature (5)..(5): n is a, c, g, or t
naggntggtaggatcacttgagctcagtcaaaaccagccaagtcaacacagacctcatctccatttaaaaaaaaaaaaaaaaaaaaaaagattggtttggcccccccggggaaaaaattttcgggccccccacgggggggtaacttttcccttttttttggatttgggttggacccatgtaatttttttttttttttttgggaaagagaggacaccctgtgtt

SEQ ID NO: 499348 - DNA, 403 bp, Homo sapiens
  misc_feature (30)..(30): n is a, c, g, or t
  misc_feature (167)..(167): n is a, c, g, or t
ctggccaagggtaacatcctcgccgagagntacacctttttcattgacatcctgctcgccactatcagggatgagatcgctgggtgcatcgagaaggcctacgaaaaaatccttttccctgaggccacccggatcctttttttcaacccccccaaaaagatgccagncttccccaaaaagcgagggtgggtcttgggccccaacaacttctacagttttgccagccagcagcagaagccggaagaccccccctttccctccccaaaattggccaaacaggtcattgagtatgcccggcagctggaaatgtttgtttgagccccccgggccctgggtggggcagggcccgagtttttttaaacagttcccctgcagggttttgcccaataaaggtgggctgcca

SEQ ID NO: 499349 - DNA, 241 bp, Homo sapiens
  misc_feature (22)..(22): n is a, c, g, or t
tgctattgtttacatagtaagnccacatttaatatcaggtagattattggaaactgcaactatcagcaaaatggtgaacaatgaaacaaattttaccataggccaattgatacaacaagatataagttcctactgcatatttctggtcacaatattatcactgtacttctaaatggagactaaaacacttataacattcaacactgaaataagtgtgaggtatcatcatttttaaaagatt

SEQ ID NO: 499350 - DNA, 152 bp, Homo sapiens
ccggtacgtacgccacaggactccagcacaggcgacagagtgaaactcatctcaaaataaataaataaataaaaatacaaaagttagccaggcgtggtggtgcgcacttctcgggaggctgaggtacaagaattgcttgaatccaggaggag

SEQ ID NO: 499351 - DNA, 242 bp, Homo sapiens
ggttacatttatgatgggaatgaatggacattatcttagacttgcagttgtactgccagacttatctacagcactagagtaaaagaagggtctgcaaacttttactgtaaaggggccgatttataaatattgcagactagtgtcaggctataatatatggttcacacatgtgcagcaggagatgcagttcatcagctattccttgactatcagcttctgaacaaccattcagagaatattaa

SEQ ID NO: 499352 - DNA, 1034 bp, Homo sapiens
agcggagttgggagccgctggccgtcgccatgacccgctggtaagccagactgtgagctcgacctcgcgcagaatgaatatgaaaacagcacgagcgactcggttaagggaaagcgccgagaatgacgggcatttctgctgactggcacgaaaagcagatgggtacatcgagagcatcatgtcatcagcaagacacgaacataggccgaaagcgagaagaacgatggaacactcaagtagtcgttgtgtgcttcgatgtcccatatcctcattgactccttcggactgattgtgcgctggaggccgagtcgctcgattcacagctcggcgttgctcgtcgctgtacgatgctcctacaggtcctcacgtctacgcgagtggtcgattcccgttgtgtcacctgcagtatgctagcgggggtcgcgctgtttgtgctttgcgcttacgcctcattcatggctatgaactctctcatcgctcacgtgagggccatctaccgcgtgcgtggtgagtggggggttatcacctttcccatgttggtctgttaattcgctgatggcgagcgtcatcgccaaagatattaaagagtacgctttgtacatacatagagaaagaaataaaaaataggacactgtacactagggtcttggaaatcacgggaccatataggagggggggcgaaaatggcttctggagtgggcgggtaccagggtatgacacggaatatgtatagtgtgtcctccatataaggaagagcgggcgttgaaactatactcaaggctagggaggttgaaagcggactggggacacaaattaggagcgtggtaacccggtagggcgttagagaagattgggcgtagacacccagagtacttcgcaaggtttgcccaggcatgactcgtgggggaacgtcaccacaaaaacctatgaggttcgcgggttgggggtttttcggaaaacccgagcggaagggtggcccgcaggtaaaccaaccccaaattatccctttgggcaagccctgtcccatgtgatag

SEQ ID NO: 499353 - DNA, 152 bp, Homo sapiens
cccttgtgacgaaatacggactccaggcccaatatcagtctgagaccctcaaagggcagatcgccttagacctcaagtttttcagaagatctgaacccactgggggctcctgtctcctcttgtcctgccccatgcctaaactaggtattcca

SEQ ID NO: 499354 - DNA, 317 bp, Homo sapiens
atatagccgacgatggaggactcagcagttagatgcagaaaagagtcaattcagtgaatgtttaaaagagactatttagttagacctgtaggatgtcattagtgacttggccaggaattttcatttcagtagggactacaaaaatcagctacagtgatttaagagcaaatgagaaacaaggcaaagtatttactatggaaaaggaagagacgtgtatatcatgaagttgggggtgtctctgaagagaaaagtaatgtttttgtaatcacccctcaggaaagtcactgactcagtacatgtcaaagaaatgcttaggg

SEQ ID NO: 499355 - DNA, 127 bp, Homo sapiens
ctcggtgtatctttccagtacaatggatacaaccataagtaactctacaacgatcttgtctgtactgtgtgctggtcaatatatcctcaatgtgtcttcaacacattgagagagacattcatctcat

SEQ ID NO: 499356 - DNA, 431 bp, Homo sapiens
  misc_feature (70)..(70): n is a, c, g, or t
ggaacgcaacaatggcaggtagcagcgggtggtgaacattcacaggtgctctctagcctgcacaatgatngacaagagatcacccaaaggattatttctgaaggtgtttttttctttatttctttttctttttttttttttccttttcctttttttgggcacatgacagtgttggtttgggggaccttccagggaagagggatgctgtgcagtggtgccggggtgcctggcctccagtgtccccacctctttcaccaccccattgggctccttggccatctggatgctgaggttcccggttgggggagactcaggtggttgggggtaacaagaagggaaagggcttctgagggcttggccacaagcttacctgggggttcagtcctgagaggccaccaccagttcccatcagcacggtctccatgcagcag

SEQ ID NO: 499357 - DNA, 977 bp, Homo sapiens
atactatacaatggaaaattatttagccagaaaaaggaaatgaaatttgatacatgcttacaacataaatgaatcttgaatacattctgctaaggtgaaataagccagacatttaaaatgacaaatactgtataattccacttatgagatacccaggaaaggtaaatgtatagagacagaaagtagactagaggttcccaggggctgggaggaggcgaaaatgaggagtcactgttcagtgctatttaattgggtacaaagcaggaaaatggcttgaaccccctgagacagaggttgcagtgagccgagatggcgccattgcaattccagcctgggtgacagaacgagactccatctaaataaaaaacaagccacacaaacaacaacacaaaaaaaaaaacatgtttggtcggcccacccatcgcggccccctaagaaaaacggttctaaagacacaacttgcggatggcaggcagggaccacaaagaacgggagcagctggaacaattggtcatacaccgtgtaccccaagaagaaactcccctgtggcaacaccaacaactgtggctggagctccaccacccacactataacaaaaagcgcgccgagggcgaccacacgaaccggtctatgcgaaccaaagaccacaacaggtggtctaacggggcagacacacgcgcaccaccagaggcgcacacgaacacgcccgaaaatcaaaaatacccccctccgggggaacaaatgccgcacacaggcagacacgacatacagagacggaaccacagacgcacacaacagaacccgaaaacgctaagcgcacgacctgaatgaatgacggagaagagccacgttagaaacagcaagactaccaaacatgaggtacggaactacgacacagaaacagtcacacaagaatcagacgaacgagaggctacaaacacgacacacacagacgaaacacaacgaacaagacgata

SEQ ID NO: 499358 - DNA, 1263 bp, Homo sapiens
tgttatctctcttgtgtttccctcgtttggttttgccgtgttgatgcgtgttgaatgtcttgggctgtagttgcttgccaagggtgattgttaacttcccttgtgcgttaattggctgttgtctgttagctgttggctctcccgctctttttgtgggtttttgttgggggtttgctcctcttggttatgtgttcccgccatacccaagtgggagtctctccgttcgtggtgttatggggtgccgtttattttgtctgtgagggtgttgtacctccttccctgtgtccatgttgcgtttgtccgggccgtgccacggcgttttgtgatgctgttgttgtgagtgtagtggcaattgtgggtgcaatgttctgttgtgcgatgtgttggtggagtggcgttgtgtcgcactctgtattccgtttcctctagttgtggtgttctcttttgtttactcatcttgtgtagtcccacctgtggggtgcgtgatttttgtgtcccccctccccactgtgtgcgcctcatcgttgtgggttgtgggggtttggtgtggtatcgcctgtcgacctcgccgctgtggaaaacgcggttcaccgatgtgtggccccgtgggcgcgtcaatatatggaagtgatggtgcacgtttcgtgttgtatttgtgtactccccactttgcgttcaagtgtaagttaaaccccctgttgttgtaatggctattaggggaaaatattccacgcaaagaaacccacacgttttacactctgtgtaaaaaaggtagaatgtgtgtaccccagcaccattgtacccacagcttgcttgtctcctcagccctccttatatagaaaaagtgtaatggtggagagcagttataaaatatataagtgtacacttaccccccttactcctgataagagtaccactgcgccctggatttccatgtgattgttgctggcccaatgtatgttgagcgattatgtgtaatggaatgccatgatgtttagttgagacccgtgttacatgttgccttatacggaccattggaacgtgcgtgtgagccgagcctttagagctgggctctttgaatggacctttactctggccagtggatggttgggacgtggaccagatctgctggcccagccccggtgtggtgaagtgagtgatggcccagaaagagcttcagagtcttcttcacgaggataaaacatgattatgaaatcttttgtaaaacttaacggacactcccgtaaagacataacaaaaaaa

SEQ ID NO: 499359 - DNA, 392 bp, Homo sapiens
gtttctgtgataccaaagtctcaagaaggaaaactacagaccaatattctttatgaaattagacaaaaaaaaaaaaatcctttaaaaattattggccaggcacagtggcttacacctgtaatcccagaattttgggaggccacagcagaaggtttgcttgagtctaggagttcgagaccatgccaggcaacacagtgagacccccatctctacaaaaaaaaagtatatatataaaaatagctgggtgtggtgatgcatgcctgtagtcccagctgcttaggaggctgaggtgggaagattccttgaacccagtaagttgagactgcagtgagccgtgatcacatgccactacattccagcctggacaacagagtgagaccctgtctcaaaaa

SEQ ID NO: 499360 - DNA, 373 bp, Homo sapiens
cttgaggatccctgtaaccctcgaggacgaaagacgatccttcgtatctgatcggagtatggaggtttacacagtggacagctttcggaattttaacacaagtgaggtgagactatctaccagcgctttgagaccatactctatcttttccatatgatcctcttctctaaagccgcgtcacagggaaaaaaagggtttaaagagaaataacttctccgggcaaaaactgaggttagcgggcctatcagctgtttcttctcactccaccactgctgctgactggaggagcagcctggaaagcagccgccctcccgcaaacaggtaaaccacattacctattcctgtggcggaggcaaatggatggtcaaaccta

SEQ ID NO: 499361 - DNA, 279 bp, Homo sapiens
ggccttggaaaggtatcatacataggggtatgccagagtaaattccatttttttgaagatcagccccgtggggctggttttggtccccagcataacaggccctgcctccttacctgtgaggaatgccaaataaagcatggattaagttagaagggagactttcagccttcagcttcctaaattttgggtctgtgcctttcgaagttttttaaacctttgaatttggacccctttaaaatttcaagtgtcctttaaaattaaatccttttaatgggccca

SEQ ID NO: 499362 - DNA, 896 bp, Homo sapiens
  misc_feature (148)..(148): n is a, c, g, or t
  misc_feature (528)..(528): n is a, c, g, or t
  misc_feature (856)..(856): n is a, c, g, or t
agcggaaagaaatgctattggacaatggcttatagaacatgctgtggcccaatattattgaaagggacgtattgagtgcagatcaaaacctgaccacatgtgaactcttcttctctccagctgacgagttctatattataacggtatngagtattacacagactgccctatgctaggaagaggcagtattatctggtacagcttcagtatattgctggctctttgtaataaagtctcacatttgattttcctattatttaacctatggtatgataaggggaacagagatttgcattaagatttcaatggagagaatgattgtctatcaatcgaatcttgagattccgtcatggtaccgtctcgctactcgagccgacaagatgagttatacaggaagtgtcgaagtaattcattggtacacaatccgctaatgagagcagatacaatgaatactcacgtatcagatcatctaatatatccatgcgtagaagggccgtatatttttgaccatgtatagggcggacacanttgccagtcttcgggtgcgcattactgcctattacgacgtagaatcccacactcgcaagcgaaggactctcacattgtaagattactgtgcgtgtccaaaaatcagcttataaactatactaatgtgggataaaagcttggcgaattaattagaagttacgttgtcgtaaagttataatactcattaatactaatttgctcaagatagctatttccaaataggaggatttacatgggcataaacattagttagcattgacttttacttgtggtgtcacaaaaaggggtagttaacgtaaagaggtcaaactttcgtaagggtaatttntcgtatgtaatataatcgattgtttcccgtaaggttaaga

SEQ ID NO: 499363 - DNA, 914 bp, Homo sapiens
agcggtggcgacgcagagtcttgagcagcgcggcaggcaccatgttcctgactgcgctcctctggcgcggccgcgattccctggccgtcgagtggatcggggaagcaccggcgggcgcgcggttcgtgtcgtctgcgcgccaatgctagaactatgatccgcgcgtcctggaggatcgaggcgggagaaccagttactgtgctgacgcatgcccttacagtgacgccgtggatgctaggagtcggcggcctacgccgtcggatgcagcgagcgacggtgacgtgccttctgaggcccataagaggccggaccgcctacttcgcaacgttccccgcgccatagatttctaattgctcggaccatgccatcgaccgatcgtctaactgttcaccgagagaacatggtgccctaagtcgctgaggtcgtacactcccttggagtttgtatggcatcgacggagactgtaccagtcttgtagcctgcgtcctgtgaagctgagaaaatcgtgtgatgcttgctgtgatgacatgatgcctcttgtgaccagatctttcattaaaaccgaaacaaagcagtgaagtagtctgctagtatcgaagtatcttagagctctagagaccccaccaagtactttagcaagtctaagttgctgtcctgtcggtttcattatgtctgactaggaaggatcagggatttgccgtcagtcagcagaatgatactcttgaagcgaaagctgcaataaagcctactagtgatttgagtgtctttgcttaaggtatgagatacttgatgggggctttatcatgcagcatgagttggcttaccttaagaattgcccaaaaatgactgaccatatgagcttgtcagttaaacatactcctataaacattttccgggatttactactaagatgg

SEQ ID NO: 499364 - DNA, 388 bp, Homo sapiens
agaggatcccgacttgacttgtacttaagtcctccaggctgtaagatgaggagacctactgcactggcgtgttaggaggttgaaatgaaatgaggtggctgggtgtggtggttcatgcctacaatcccggcactttgggagtctgaggcgggaggactgcttgagcccaggagtttgagatcagcttgggcaacagagtaagatctcatctctacaaaaaaactaaaaattagccagttgtggtgatatgcacctgtagtcccagctgttctggaggctaaggtgggagaatcgcttgaacccggaaggcagaggttgcggtgagccgagatcacgccactgcactccagcccgcgcgagagagcaaaactcctttggccactcaata

SEQ ID NO: 499365 - DNA, 114 bp, Homo sapiens
  misc_feature (47)..(47): n is a, c, g, or t
tagaggataccctatgcccgtctcgcctctttctttcttcacgcagncaacacaacataccccagcaggcgtgacgctccgcttactgatgctcccttatgctccgcttactga

SEQ ID NO: 499366 - DNA, 121 bp, Homo sapiens
cttcacatggctggctgcacatcactcgatcttcttgagcagccaatggagtggggtaggccgctcttattgctcagtgttcacatttcgcatttctaccgagaagcagcgacaccatgtc

SEQ ID NO: 499367 - DNA, 462 bp, Homo sapiens
  misc_feature (97)..(97): n is a, c, g, or t
  misc_feature (239)..(240): n is a, c, g, or t
  misc_feature (254)..(254): n is a, c, g, or t
  misc_feature (273)..(273): n is a, c, g, or t
  misc_feature (331)..(332): n is a, c, g, or t
  misc_feature (341)..(341): n is a, c, g, or t
  misc_feature (348)..(348): n is a, c, g, or t
  misc_feature (353)..(353): n is a, c, g, or t
  misc_feature (382)..(383): n is a, c, g, or t
  misc_feature (421)..(421): n is a, c, g, or t
gacgccttccctaacatcgagaaggtgtccaatatcacgtctcccgtgctcatcatccacgcacggtaggacgaggtgatcgacttctcgcacgggntcttgtacgagcgctgccccaaggcggtggagccgctgtgggtggagggcgccgggcacaacgacatcgagctctacagccagtacctggtacgcctgcgtcgcttcatctcccaggagctgcccagccagccgctagcggnngccccaaccggccngacctcagcaaaaggcggnccccggacctcaccccggccggccccccaggggctgcatgtggacccccgggcggccnnggggacccngccccgngccgngggctgtggacgatgtacaggcaacaganntacgcactcctttccttttggaagcaagaagaaaatangtgaaaacggaaattaaagatttaaaattttagggctaaaa

SEQ ID NO: 499368 - DNA, 324 bp, Homo sapiens
gcacgaggcaaatacaaaagataacagcaactctgatgatgaagaacattcttcaaaaaaacgtaaaacaaaaaaaaaatcaataacagatttcttcaaaaaacagaaaaagaacgaagatacaaccacccaaaacggcgcaccagacgatgcagcaataaagcaacctcgcctattgaaaaactgtattttaaaaccttaccaactagaaggtcttaactggctgatcactctttatgaaaatggcctgaacggaattcttgccgatgaaatgggtcttggtaagactgttcaaagtattgctcttttggcgttcatatatga

SEQ ID NO: 499369 - DNA, 116 bp, Homo sapiens
gcaatgttggtgtatctttggaaagaagggaaggtgaatttattatgcaccatatgtccatgtgtggcacagcacttggctaaacagtattttggagaaatatttggtcttcaaca

SEQ ID NO: 499370 - DNA, 143 bp, Homo sapiens
catcataacggaataacatctgtcgaaatgcaccctgaagctttgagtgaagctcttcctggggacgatgtgggcttcaatgtacaagatatgtgtctgtacagggatgtactgtcgtgacacgttaagccttggtgcacagc

SEQ ID NO: 499371 - DNA, 362 bp, Homo sapiens
tggccggacacgttcagaggatgacgaggatattactattgacctgtttggctgtgacaatgatgaggatgacaattgagtgtggctcagctgcgggaggagcggctacgtgctgtacgcggagaagaaggccaagaagcctgcactggtggccaagtcctccatcctgctggattgtcaagccttgggatgatgagacggacattgcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagata

SEQ ID NO: 499372 - DNA, 141 bp, Homo sapiens
  misc_feature (11)..(11): n is a, c, g, or t
  misc_feature (27)..(27): n is a, c, g, or t
  misc_feature (78)..(78): n is a, c, g, or t
  misc_feature (82)..(82): n is a, c, g, or t
  misc_feature (104)..(104): n is a, c, g, or t
  misc_feature (116)..(116): n is a, c, g, or t
  misc_feature (118)..(118): n is a, c, g, or t
  misc_feature (123)..(123): n is a, c, g, or t
  misc_feature (134)..(134): n is a, c, g, or t
ccctgagtagnggatgctgctatgcgngagttcatggacacaagttgattacatggtttttagaattataattatggnttcntcttatttcatggtaggttgtntttaaagatatnanaattnggatgcctttntgaagca

SEQ ID NO: 499373 - DNA, 133 bp, Homo sapiens
tcttagaggatcccctctaatccctaattcattgcaattcaaagatagagtgaatgtcacacggcattatgcacagacacatttgggatagagaaaacagagtgttgtctgcatagtccaaaggcaggacaag

SEQ ID NO: 499374 - DNA, 226 bp, Homo sapiens
tgggacacgatgaacctttcaccagccagacctatcacctatggcagccagagacaggaaagacatgatccttcagactcatgacgccacccaggacttccagaacaactgcagaatgaaagagtccctcatacggctccccagaccccatgctgccatcatacaagcacgggtatgggattgtatttgtccattaggcggcatctgtccataaatttgacgagca

SEQ ID NO: 499375 - DNA, 881 bp, Homo sapiens
gatttatttaagttgcgcgaagctaaaataaatcataaaacttgaaaaaaaaaaaaaaaaaaaaaaaaaaaaaaaaaaaaaacaaaaaaaaaacaaaaacaaaaaaaaaaaaaagaaacaaaaaaagaaaaaagacagagcagacaaggcacacaccacacagaccgaaaacaacaagagacaaacaaggaggcgacagagaaccagggcaccccacgagttaaaaacaacaggcaggagagaagaaacaagaagaaaagggggacagagaaaacagacaagagaaaacaagccgcaagcagagagacacacgcgggaaaaaagaaaagaaaagaacaaaagaaagcacgaagagaagaaaagaaggaagagagaagaggaacagaaaaaaaaccaacgcagcacacaacacaacacgaacaagaaagacagaaggaagagagaaagaaaaagacaaacaacgagcaaacacagagaaaagacaaagagaagacacaagacgagagacaaaaacaccagaaacactgaagcgagaaacaaaagcagcagaaaggacaacaacaagaaagaagacgagaacaagagaaacaaagagcggcgacgacgagtagagaaaaagagcaacagacagaaaaaaagaaaagaagaaaaagagaaaaaggaacaagaaaaaaagaaagaacagacaacacaacacagaaccaacacacaacgagacagcaaaagaacaagaacagaggagaagcagagcaacaagacacttagagaagacaagaacacagataaaagaggacaagagacaacgaagacagaagagcaacagaaaaaacgcgacagcaaaccagaaacacaagcaaaaacgccgcaagagagacaaacaa

SEQ ID NO: 499376 - DNA, 195 bp, Homo sapiens
atgaagtacgagtgcaggtgtcgttaggtagaagtggttccttttcctttgggtagatacccagaatatgggattgctgggtcgaacggctaattctatttatagttctttgaggaatcttcacaactgctttccccaggtggctgagcatattttacagttcccagccaaacaggtgctagggttaccgatgct

SEQ ID NO: 499377 - DNA, 442 bp, Homo sapiens
ggatgactatgaaacaggccgctatgggacaggggtctttgaccagaatgagtacctacgctatcaagaggccctgaatgagctggccactgcggataacgcacgaattgagagctctcagcgacatgaccagacagcagtcaaagacctaactcaggtccctgaggtctccccaacaaccatgcaggtgacatacctcccctacagtcagaggagtaaacgtgccaagcactaccttgaattgaagagctttaaggataactataacacattgtagagtactctgtgacggagctgaacgactcttgacgcatactaagccagtcagttgcaatgtgcaagacatgctgcatgccggacccgcctcgtaacatctggcccagcaggcccagactgtatccatccgttcccgctgcattcacagctcttaggcttgtgtctg

SEQ ID NO: 499378 - DNA, 684 bp, Homo sapiens
  misc_feature (175)..(175): n is a, c, g, or t
atggggacaatccgctcaggaacttgtggatttttataggcccgggtccccttgtgttcacagatggtctaaccctgtagacccactcaatctccccccttgagattattgcacactgctcccagggtgttggccacgaggctttctatagtgcccactttaaagatattttganaacggcttgttcacatcttgttgctgtgccgtgaactaggaggactccctatgcttcggcacaagtagcccgtaccataaccttcaagttttcttagtgtcggcccatataatgtctccagaaatgacctctaactcctcttaagccttatgtgtagtaatgttttccccttcatgcccgaggatcatattgtgtgctcagtatgtagaggtcaaagtcacggtttagctaccataatggtagcacgcgcctgctcctttcgcttagagacggctgtaaagcggtctgacatgcgattcagtttttttgaagattgtcaggctgtgccggttacataacccccaccgcagaagtcgtctgagtctatgcctccgcttgtccataaagtggggtctttgggcttttcacatgcagtcggcatttctgagaattaatgtatggggccctgcaaggttctctatcgttggatctgtagcccctgcatgcttcttgataaagcctgcttgaac

SEQ ID NO: 499379 - DNA, 236 bp, Homo sapiens
ggtcacaaaggagaatgggtccgggcacagtggctcatgcccgtagtcccagcactgtgggaggctgaggcaggaggatcatctagaggccaagagttcaagatcagcctgggcaacatagtgataccctatctcttaaaaaagaagaagtttttaaattatgaaataataataggtactggatttatgcaaaatgtcttttctgcgttcttttgagcatgacgtatcagcgtttt

SEQ ID NO: 499380 - DNA, 883 bp, Homo sapiens
taagtaggggtgatgaggaatagtgtaaggagtattgggggtaattatggtgggccatacggaagtattaagttgggggcattttaaattcttagagcgaaagctataatcatctgctcatcatttacccaaccacccaatttatttcttatacaacctaagccatgggccatccccttaatgagagcgggcgcaagaggataaataaggggcttgtacggcttctaaagattaaaaatggcctctaagccccatatttctataccacaagggcaacactcttaacagcccttaaataccccataactaagttatatatccagaaacccatacaggcctaatcttcccattacaaaaccagataatgcccctggggccccgagaacagcggccataaaaacctcctgtgtaaaccacatatatctcttgggggagggggcccaaccccctgtactcttccaataggcgatccctaaaaatttgggaggaaagtgcgcggccccaccccccctaaagacaagaataaattcaccatcccatgataaaacctcttattctctctctctaaacacagctatatatatacatttccttttaccaccacaaaatctctctaaagatgattactcaccgtgggagctatattccctgaagaaacaactacctggctgagtgaccggcctataaaaatccccaacaagtctcttcacgtgttttctaccacacatcttttcttaatgtaaaagaggctcttctaaactcctggggcgacaagcaacaaacccatcttttcaaataccacaacacacaagcaaccacacacaacacacacacatccagcagaaggggagaacacaccacaataggacacagagggagacgg

SEQ ID NO: 499381 - DNA, 637 bp, Homo sapiens
agcgtgctactgcataacaagcccacagccatcacgcctgatgagtacttcactgaagagttgtgatctgaaagacagggacataggaaggccgaacgagctgacgattagaacacagaagctttaaagcaatgtagtggatgtgtgaagagtttcccctctctctggaggagcaggtcattcccatcattgagctaatggacgtgcgaacgagtgctcatggcgtcgaagactgaggagattcatcaaataggaattcgccaccctggtatatcgctgtaagaataaaaattcccttgcttgcatgtcttaaatgcgcggattacatttggaaatgtacctgggtgtggcagtgccgaataatcggtatctcaaagtgtggatgggacccaggctgaattcaggaacgttcaggaccagcttcgtaagtggaggtatctgacagacaaacacctatgatgcccagtatgagagggccatccagggagaagcctcctcaccagcacagaaggcctgtgccccagcgccctgagcgagacaagccgttttgataatgacttgcagctagccatggagctctctgccaaagagctggaggaatgggagctccggctccaggaggaagaggctgagctcc

SEQ ID NO: 499382 - DNA, 353 bp, Homo sapiens
tgagccacgtgcccggcccattttgtattttttttagtagagacagggttacacgatattggccagtgctggtctcaaactcgctgacctcgtgatctgcttgcttcggcatcccaaaatgctgggattacaggcataagtcaccatgcttggctcctcatttttgtattattagtagatactggggttctaccatgtggggcaggctggtccctaagctcctgacctcgtgatccgtccacctatgtcctcccacagtgttgggattacaggcgggagcaaaagagctcgcccatattatacctatttctcattgagaaaacatgactctagtttgcattcatattacagtc

SEQ ID NO: 499383 - DNA, 330 bp, Homo sapiens
aattcacacaggcaaaggcactgactacaagagaagagacgagatgtgaagcaactttaactcgccaccctcaatacgggcagcaggagtgtcttaagcacagggcccgttctaccccctgggagctgcctggggccagcccctcatttctggctgttgacagtgttccccattccttagctccccggtatcttcattgggagtgtccagtggaccctctatcttccagtggccactttctgcaggagcttcgggttcgagtgtctacgttgtccagaacagctcttgtctctgagggctggtgtgcccgggttcccatccgcatctcgt

SEQ ID NO: 499384 - DNA, 1527 bp, Homo sapiens
gcactggccatgtgaggtgctgcctgcgcggagtgcgctggggcgtgtcatcctgtcaaaagccatgctcggcatgtgtctgggtacctgtggctgctgcccctggggtgatttttgacctgcttccatgcatgtcgacgcttctggctttcttgtgtgctctgcagaacggtgctgcttgtcccctgtgagctggtggcgtgcgtgggggacatgtgggcctgattgataccccaagaagacatggcccataccttgcactcgtgtacaatggccatcagtcatgtattcctagagaggatatcattgactagcatagataatggtcacacttcacccaattatccatggactaggttttgcccttgaaaggaaatatggttgaccacaaaacgtaacagaaggctgagaattgagtagggtagtaacaccagcccatggagagacacagggaatcacagaaacaccacaccaaggtgggaccatggagacactgggattccattgcatccattgcccagctttcaagtttggagatccatgtatcaaagaaggagggttggagatcctttgaacgaggaccaacctgaaggcacatgttcaaaagcaggtcacacattcagcccttgacacaggcatagggcccgtccgtaaatggtggcacctggtgagctttgtcggcttgacccagggtagagagaatgccatggatggttcccaaagggaatatcgggcaaattcattgggcggaacacacggtagatttgacattcggtccggaggatagcaattgaacctttgggtggaaaaaagggaacacccttggtaactaacaagagtcccacaccaaacagagcagtatggaccacatgacacacagaggaaaatctggcccacaagttggagcccaaacagtgggcccccgttggctgccaaacactgaaaggggcaccccagctatggacgttgtggtaaggacacattcccgacgcaattgtggtacggaaaagtgccatccaaaatgaaattccacaggcagagaaacaccaaagagactttatacctatggacgatggggaaatgcgatagtccgaaccagggaacatggatgtgaaaaccataggaggggaccatgtgtagtagcaggacctagggcgacagagggatacgaacaacccggacggacgtatggggaacaagccagacgggacaagcagcagggagacgagaagccagtgatgacaaatccaacaagagagaactggaccacacacaaacgggagaagcagagtgcgacacaaaggctaattgcgcgcacccaacagagcgcgatggggagcacgcagagagagacgagtccagaccgaaaagacagtgagacacgaacatggcgaagcagatatcacacgtgggagacaagcaaaacagcagtagagaaacctcacaaatcggagcagcaggacggatgacacacaggagaaccaccacgagagagacgaagagaagagaagagaaagacaacgtgag

SEQ ID NO: 499385 - DNA, 817 bp, Homo sapiens
  misc_feature (265)..(265): n is a, c, g, or t
  misc_feature (277)..(277): n is a, c, g, or t
  misc_feature (531)..(531): n is a, c, g, or t
aactttggaaggggtgggatttgaacagggcgtctacaaatagtgaagatcatggagttagaggaagaacaactagcttcagggcatggaatgagaaaggctctgagtcagaaggacctgggtcttatctggaagtggctatcatttgcattatttgcactgggtccagtggctgcagctggacgcagagtccctgagaaaatccatgcttggaaactagaccaggaatagtaagctgagaccagaaatgccatctgggggtgtntggactcatttngtgtgcagtaaaagccactgaaaacaagggaatctcgtgttccagataactgaggtggccgtatagaaagctgattatggcaagataccagcaataaaagtcaagtaggagataagtagtccaaatgagagaggatggacacttaaaccttagtagaagcagtgggattagagatgaggagacaggatttacttttcactaaatgtaatatgccatcaatgatgacacaaccatttttaaaattatagctcatntaaaaaagctgcaattcaatgatgacacaatgctaagacactgggcattgaaaaaaattgcatctttatttcagaggttaaaaaaggtgtccatcttagaactgatgaaattacaacagaataatttgaagaaggatggacatttggcattttgggaccttgagcaggtggtggaggtacatgatgccattaatagcgaatcatgggaaacatgggaatgacgaattgagtccaaaggaaaagaaggattctgcttggacctattgggtggtggcctaaaaatttg

SEQ ID NO: 499386 - DNA, 130 bp, Homo sapiens
tgcagccccagggggatactttgaacacgtcaatctcccaagccaaaggtgcggtataaccccagctggatggcaaaatgaagacttatgttcccctggtactgaatcccttgatatggctaatgccaca

SEQ ID NO: 499387 - DNA, 316 bp, Homo sapiens
  misc_feature (20)..(20): n is a, c, g, or t
gtgcaggggaatggaatggnatggaatggaatgcaatggaattgaatcaacacgagtacaatggaatggaatggactggaatggaatggaatggaatggaatggaatggaatggaatgatacggaatagaatggaatggaacgaaatggaatggaaaggaatggaatggaatggaatggaatggaatggaatggaatggaatcgttccgagtggaataggagggaatgcattcgagttgaatggaaaggaatggaaaaaacctgagtggaattgaagggaatggaatagaatggaaactaatagaatagaatcaac

SEQ ID NO: 499388 - DNA, 173 bp, Homo sapiens
cagctctccgaataggagggcttagagctgtgcctagtgactccagctcatgcgctgaataataggtatagtgtcccaactgtctttgtgagtttgtatgagaatagtcaacgtgtctggcgaatgatcgaggccacatgtcttgcgctgatccagcagtcttcgcagatgtt

SEQ ID NO: 499389 - DNA, 223 bp, Homo sapiens
ggagagaactagtctctcacgtcggctccccgccagtctcgggagcctccgcttccctcggctcccgctagcgtctgctgggagctgtgctcagggaagcttcgctgaaagcggggacagagggaaggagtggggaaaagagccatcgcaagagggggggggggaatagagaggacgacagggaggggtgtttgggggagaggacaagaacggcgagaagaag

SEQ ID NO: 499390 - DNA, 261 bp, Homo sapiens
attctgcaccacagtcatgctcactggttatacaaaaaaaactgacagcctgtatcaacgttgccagagtctgagggaccccaaatgatcaatgtgccaatttgcgtcatgattaggagcttattgtgcgataaggagataatccctatagtcataaatagtacatgtacagaagacagagacagtagaggtgtgcaatctaaactaaatcaggcagcgtattttgagtgagccctccgtatatcttttttctagaatgct

SEQ ID NO: 499391 - DNA, 156 bp, Homo sapiens
gcagcatcttcgggagccttaccctgtacagtacatgctgtacaggtttgtagcctacagtactaggctgtaccaaatagcctaggtttttagtaggctataccatctaggtttaggtccagtgacacaattgcgtaatgagggtaccgcgctcga

SEQ ID NO: 499392 - DNA, 118 bp, Homo sapiens
  misc_feature (5)..(5): n is a, c, g, or t
ctaanagcaaaccttctatcctaatatacgtatacacacacacacacacgcacacacacacatagcggggaaggggggggcacacctatagtcctagccactcagaaggcgggagcag

SEQ ID NO: 499393 - DNA, 620 bp, Homo sapiens
aatcacgccactgcactccagcctgggcaacagagtgagactccgtctcaaaaaaaaaaaaaaacccggatgtttaggccatgataataaattttggaggcggggggataagtccttttggtaacccccacttgtctgggggaatgatccgccaggcttgggagaaaattggatgttttgggactgaaacatggacgcctatcacggctttttcctgggtccctattgaagattcgggaccattagaaaacacaaaaactcacccttaaaatttgacgcaggggtcgtgtgatgcgcaacaaaatattttacgggacaaagcggaatatccttatggaagtaatactaacagttaaagggagcgtgtggcccattaactatttggctaagttttctatacgggctgtcacaggtaaacgtacatttggttcacaaacgtaggtttggtgtgtgtgtgcctaggttgtaacaacgacctggacattgggatggctaacaccgcatttgggctccgtccttttggtattcaaaattgggcctgcctcttaattggaggggagagcctgcttatcacaccttcggttatttatcacgaggcagtttgtaagacaccctcattc

SEQ ID NO: 499394 - DNA, 228 bp, Homo sapiens
caacgccgaaacttaaaggaaaggggggaagggcaccaccaggagaggagccgccgcaagtgcacaccatggtggtaggagcaaaaattcaaacgagaactttgaaggccgaagtggagaagggttccatgtgaacagcagttgaacatgggtcagtcggccctgagagatgggcgagcgccgttccgaagggacgggcgatggcctccgatgccctcggccgaacga

SEQ ID NO: 499395 - DNA, 331 bp, Homo sapiens
  misc_feature (11)..(11): n is a, c, g, or t
  misc_feature (48)..(48): n is a, c, g, or t
  misc_feature (96)..(96): n is a, c, g, or t
  misc_feature (168)..(168): n is a, c, g, or t
  misc_feature (183)..(183): n is a, c, g, or t
  misc_feature (277)..(277): n is a, c, g, or t
  misc_feature (289)..(289): n is a, c, g, or t
tttaagccatnaaatgtggaacctatggaaaaggagtttgggctttgnaaaactgagaacaaagccaagtcgggcaaacagaccttaatgagctgnactgtcaagaacttaaaaaggtgattgaagcctacgatgttgtcctagaggtgttggatgccagagatcctnttggttggagatgtntttaggtagaagaggccattgtccagagtggacagaaaaagctggtacttatattaaataaattaggtgagtaaagagggtaccctttgttttntgtgtacatggntgaggtacgaggaataagtttgataggtattgaagactgatt

SEQ ID NO: 499396 - DNA, 186 bp, Homo sapiens
cgggacagtgtgacaacgtgccgggagatcttgtctgtggactgttccaccaacaacccctcccaggctaagctgcggcgggacgtcgacggaatcccttccaggtcgctgagagggttgaccatggaaatacaactgagctgctaaaagtccttaccatgtggaaggatgctcaacaccttcctt

SEQ ID NO: 499397 - DNA, 178 bp, Homo sapiens
aggctgatctacaggacgcttatcttccggccacatacaggcttggctgttaagccaaatggatcaaagaaaacattccccagtgaagacaaaagcaacaagctcagggctgacatcaagatacctcccagaaagaggtagctacgtcgcgcctgtgcatagagtgcactgacgggtg

SEQ ID NO: 499398 - DNA, 181 bp, Homo sapiens
  misc_feature (14)..(14): n is a, c, g, or t
tatagtcccaaatngaaaaacaagaaggagtcacactattaaaatggtacagatccctcttttctatgaaaaacttaaaaataaattttaagaaacaaaacaaagtagacttagaagagaaggatgaaccttgcttgatccacaatctcaggtttcctgatgcatggctaatgacatccaa

SEQ ID NO: 499399 - DNA, 190 bp, Homo sapiens
ggacagaggcattcagctgtatagcactgctgctagtgacctagcgccactacccgcgagttaccctacggtgacgcctcctagacaagtactggcttctgtgagcacgtgctgacctccaaataccgttaagctggagcctcggtagccgttcctactgcccgctgggcgtcccaaggggctctactcc

SEQ ID NO: 499400 - DNA, 182 bp, Homo sapiens
ctggaaatattacataaaagtggagtttgccagggtgcatataccaaattgcttaacaggctgggtgtagtggctcacacctgtaatcccagcattttgggaggctgaggcaggcagatcatttgaggtcaggagttggagaccagcctggccaatatggtgaaaccccatctctacttaaa

SEQ ID NO: 499401 - DNA, 1049 bp, Homo sapiens
  misc_feature (205)..(205): n is a, c, g, or t
  misc_feature (217)..(217): n is a, c, g, or t
  misc_feature (228)..(229): n is a, c, g, or t
  misc_feature (267)..(267): n is a, c, g, or t
  misc_feature (294)..(295): n is a, c, g, or t
  misc_feature (326)..(326): n is a, c, g, or t
  misc_feature (344)..(344): n is a, c, g, or t
  misc_feature (346)..(346): n is a, c, g, or t
  misc_feature (352)..(353): n is a, c, g, or t
  misc_feature (369)..(369): n is a, c, g, or t
  misc_feature (414)..(414): n is a, c, g, or t
  misc_feature (496)..(497): n is a, c, g, or t
  misc_feature (502)..(502): n is a, c, g, or t
  misc_feature (524)..(524): n is a, c, g, or t
gcaagattgtgaaaaatgtaaataacagactcctatgcggactgatcagtgggagaggaggccccttcccaccggaaactctgagtgtgtatttcgcctgctgtatttgtaatccactcgtggtggtggcttttttttttttttttttaaaataaacagatgctctcaccggggaagaggagacagggaggggaaccaatggaanaaagaggagaanagtcttagagnngtggaaaaggcaaccaggtgggccgtaaggtgcctgcntggaatgcgtgtgcctccacacgggtnntgggcatccggactgataaccagccggccanactgagggatggaaggcncntgaaanngggggcccgtccaggnggacacccgcagaaagggagcttcgggggtctctggcactcgggntgcctctggccctctcggggtctctctttctgggtctctccctctctcctcctcagccgggtctttctcttgggggcacacnntagtnatggtggtgagcaagggaagtncaaaggaactccctctccagctcttctgaatctggggacaaagccttaaaagaggacaaaagagttagaagacagcatagcaacttcagctcagggagctaccagaagaaaaatagcaatggatgtggggtgctataaaaaaatgaatggtccgacaactgtggacattaacagaggcaatgagaaggggtgcaacaaaaaccaacaacaagggggggcgccgaaaaagaagaaaaccccagaggggggggcaccaagaatataagaggagaacacccaattatcgtggacccaagggggccccaaaaaggagaaagcgaacataaaaagcacaacggaaacggggcgcagcagaatacaaaacgctacagacagagggaacaaccggggaaggagggaacactctggagcaacacacctatactccggggggcggacccaaatgggaaacaaaccctcaagaagataaagcgccgcgaggaaaaatacaaatgacagcggatcacggctgtcaaccaacgcgga

SEQ ID NO: 499402 - DNA, 573 bp, Homo sapiens
gaccgccgagaccgcgtccgccccgcgagcacagagcctcgctcttgtgccgatcctgccgccctgtccacacccggccgccagctcacctatggatgcatgatattcgccgcgctcgtcgtcgaacaagcggctcccggcattgtgcaagggccgggctttcgcgggcagaagattgccccccggggcccgttcttccctcttccatctgtgggggccgcccccagggcacacagggccgtgatgcggtgggacaatgtgcggtccagaacaggaattcccattaatgcttgggcagaacggagtgccccaggatgcaaagacagaggcattcctttcaacctctggaagtgtaacccccaattcgaggccacgggctattctggtcaccaaatgtggggcacgacattgcgcagaacaatcgtgggcaccaacaacctttcttacacattgaagcgtgcgttggtgggctcccccggagtgagcaacccccggtggcttggcagtgacccggaggtgccccccgtggaaactccatataggggcacaacggcaaggaaagattggacccta

SEQ ID NO: 499403 - DNA, 100 bp, Homo sapiens
taatcagtcggtccctcttacaacaccctgttggacgcttgctcccacccaaggaagaggttgagcccattctccagtaaatatatatccccattgctta

SEQ ID NO: 499404 - DNA, 166 bp, Homo sapiens
atctctcaacatcacctttgatgatactcatgtactggtattactgtattcagttcatctagcttgttaaacaaatatttacaaagtgctaagcagcatgctcaatgctgaggacatggcaaataacagagacgataatccctgtccctggagtgtgtacattcgt

SEQ ID NO: 499405 - DNA, 1208 bp, Homo sapiens
  misc_feature (485)..(485): n is a, c, g, or t
  misc_feature (563)..(563): n is a, c, g, or t
  misc_feature (570)..(571): n is a, c, g, or t
  misc_feature (588)..(589): n is a, c, g, or t
  misc_feature (600)..(601): n is a, c, g, or t
  misc_feature (626)..(626): n is a, c, g, or t
  misc_feature (668)..(668): n is a, c, g, or t
  misc_feature (672)..(672): n is a, c, g, or t
  misc_feature (750)..(750): n is a, c, g, or t
  misc_feature (761)..(761): n is a, c, g, or t
  misc_feature (793)..(793): n is a, c, g, or t
  misc_feature (809)..(809): n is a, c, g, or t
ctcttattaatgtaaacacttgattatattatgcttctagctactatatgattataaaactgaaatggttttataggttaaatataatcaaaactatagctgataaaaatacagattaagagcataatattatatgccacctgatgtttacttgaacgcaggtttctgttcatagcaaaaatttggtactgacttcttagaaacaaatctgtttaattttggcttgcctgttctgtggatggtgtgatgactcaagtcttccaccatttcctcttgtttgaaatgctgtaaaactttagcataacttactgtggcttcatttggcgtgaatgcatcgttctttctctctctctccctctctctcatacacacacacatacacacttattttttggtctgtgttctcttctcattagccttgagattgtgtggtgatactcagttatgagaagatcattctgatgagcacaaataagcattaattntaagcttaaggattttctagagccccaatttgagaaacacttatttgcatggtagatatgaagggaccatagcacttnagtcagnnttctcatttaacatcanngagacacacanncagccaaagaatctttgaggcccgntgcagtggctcacgcctgtatcccagcactttgaaaggccangcangtggatcatgagtcagaaattcaagacaagctggccaagattgtgaaactcattttactaaaatccaaaataagcggncatggtgcggntgctgtattccagtacttggaggcttaagcanagaatgttgaacccgnaggcggaggtgcagaaccccagacgggccatgattcagcctggcaacagatcggacttggccacaatatatgggcccatttgggtatttgccaattgcctaaggggcgttaaaatattggccgttttaaacgcgcatggaaaaactcgggtacaattaatgccttgggaaacccttttcacgtggataacaaagccccccatggcttccaaaaggcaccttgtgctagaaatttcgcgtaattttaaaacgcccaatttgtaacaccactttcaaagcggctgcggaactctataaaaaaacacacccgcatcgggttttccttacagagcctttggctccactcctagttctcatcacactttctgggcccacccccccccatcatatctgggggccc

SEQ ID NO: 499406 - DNA, 543 bp, Homo sapiens
  misc_feature (502)..(502): n is a, c, g, or t
  misc_feature (515)..(515): n is a, c, g, or t
  misc_feature (535)..(536): n is a, c, g, or t
agattcaccaagaaataaagtcaaccaaagaagcaaagtcatggaaaagaaatgcaaatctccacaaaaggcagcttttcagggctattcctgtctacacgccctctgaataaccatctcaaaatatgttcaagaagtatattttggaggtggcattgcagatgggatctcaaagccaagtctctacatatgatacaggcaaacagatgtttacatgacttgctcctccttgccttctgccatgattgtgaggcctctccagccacatggaatttttttcatccagtgactaccaaatggaggaattatcgtcttgaaggggaacgtatcaatcacttaaggaaactagatgggagactgaaggtggcaaaaggagaggcatagcaaatggaagaaggtgtcctagagtcactcttaaactttgagaagtttgagatattaggttggtgcaagagtaattgcaggttttaccattacttttaagagcacaaggaccaaacanatgaatatttacnctaaaaaataaactagagtnncttcaaa

SEQ ID NO: 499407 - DNA, 226 bp, Homo sapiens
cccaggacagagtctaatttccagggactctttacaggtggggtgggggaggcctgaacagcagcgcatcagctatgaacttccaccctggaagaccaggcaccttaggaaactgtccaggttgccttgaccatcagccttctgcctacttccacatgggactactctagtaggtataggtgacgctgtgctccccagtttccatcggaggtagctgaaatagtgc

SEQ ID NO: 499408 - DNA, 910 bp, Homo sapiens
  misc_feature (351)..(351): n is a, c, g, or t
gacgcgtgggtcgcccagcgtcgcgtgaaggaaccagtgggaattgggttcggagatggaaatcatggaggtccagaaagtgatgcgcaataccagtcatggtataaaaactattcaatcttatatctcaaggtcgaatgaactgtgtctggccacatatggaagcatgtgcattgatggtcttatatttcaagtgaaggtccaaaaaaactccagctgtgaaagcaacataaatggattttaaacggtctacggttcttaacctcatcgtgttaagttcccatgcctggagaagctaatgccaactcatcatgtgataattcacttgtgtacaataaattatgaaccctnggaaaaacaacacacaaaacacaccaaccgtagaacacaaacacaaacaagacaaaagaaccaacccaccaaacgacacacaaacacaacaccctacagagggcggtgcccccacaccaaagaacacaccaccgagagaggagagcacacgcaaagtccaagccaggccacgcacacattatctaacggaaccagcgagagccaccctaaagacgaccgacgcacttaatatcaaccaaggcagcgaccgcgagcccatcaccacacacaacacccgctgcataacgggtcaaccaaatctctcttcattgcacgctcacatattacgtagaacacgccacatacctccttcgtcggccgcagacagacaatatatgtaccgacgccctcatccccacgagcatcaaactacgcgcacgacggtcaaaaaaccacgtcccagagcgataatttgtggacacaccccacgaagtcacatcaccgcacaccacaataccatgtcaccacgataaaaacactaaaacaaaaaaatctactaaccagcccccccgcatcacac

SEQ ID NO: 499409 - DNA, 356 bp, Homo sapiens
  misc_feature (19)..(19): n is a, c, g, or t
  misc_feature (35)..(35): n is a, c, g, or t
  misc_feature (88)..(88): n is a, c, g, or t
  misc_feature (95)..(95): n is a, c, g, or t
  misc_feature (186)..(187): n is a, c, g, or t
  misc_feature (199)..(201): n is a, c, g, or t
gttgaataaattagggtgncttcatctgggttttntttagtacctaagtctacaaccctttctctttttctattgtgtttcgaactcnacattgnaatactatgttgtcatggaatacaacctttagatgtttactgctgaagtaggtcagaaattgtattatttgatttgcctcaaacatccacnncccccccaaaannnaactttttttgaagcatgaactctgaattatgtttttataaatctgactaggcaaacctagattctggtttcacaatggatttattttctctctcagtctccattttaacaagtgcttttgaaagtttataccagaaagctttaaaaagttaggt

SEQ ID NO: 499410 - DNA, 807 bp, Homo sapiens
  misc_feature (177)..(177): n is a, c, g, or t
  misc_feature (190)..(190): n is a, c, g, or t
  misc_feature (196)..(196): n is a, c, g, or t
  misc_feature (246)..(246): n is a, c, g, or t
gagcttacggctagtacgaggccgtgttaatcggcagaggctaaacaagagctcagtaattgggagatatatacacagttctcagcagtacaaatcaaataagctcctcattgcaacctttgacttctatttcttggcctttgttcttttttttttcagaatcaaaaagaccctctngctttggacaaantatatnaaggacctggaaccagtgtagagatggcaaagtgggcttccagagcttcntttccctaattgcgggcctcaccattgcatgcaatgactattttgtagtacacatgaagcagaagggaaagaagtaggcagaaatgagcagttcgctcctccctgataagatttgtcccaaagggtcgctctaaggaagtctgccccacagcttcccccatagaaggatttcatgagcagatcaggacacttagcaaatgtaaaaaataagatctaactctcattctgacaagcagcagaaagaataactgtttagattcaccagataagctttggattctttgtattgtgtgcatccccttgccctcattaaataaagttgcttttttaggttcccatagaagtaccctgagaactactaactacagatgaagaaagaaaaattggcggagggaatgttttttggggtggggtgaaaatgaatggtccagaagtgggggcctggaattgctgtcttcccagaacccgttttgtgtctcagatggggaggcaaggggcggggccctctaagaggagcgcctgatattgtccagaaccgggtgaccgtgttatacggggaga

SEQ ID NO: 499411 - DNA, 631 bp, Homo sapiens
catgttatctgctcctcgtggtaatcatgtagacaatgctcacctggggccacatgagacgtcagtgttttaaagatacatgtggtattgattcaccacttttcccatgggaaaagtggtggcactgccaaaccatgattattttaactatcttgaggacatgagaataagagatatttagatgccatggcgcggaggactctcttattctcatgtgtggagagccgggtatcccctcatggttgtctttggaacatcagactcatgtgtacctcagcaattctaaaaacatgggaaaagtggttcagtttatcgcatgcatttcaataacatggtctagaacatgttaaatggaaacagaaggctgacatgatggcgtgcaccatcctggccaacatggtgaccacgggcaccacttttcccatgctcatagcagtctcttattctcatgtttcaatgttagagtgtcaaacatgctaagacttcacaggccagactcatggacgaccccgacaaaagcaaaaacatgggacaaagtggtgactgaagagtccatgactgtattggactgcatacattccatggttgtggttaaaattgggctcccatgttacatggcaaagctgaggta

SEQ ID NO: 499412 - DNA, 208 bp, Homo sapiens
  misc_feature (199)..(199): n is a, c, g, or t
tagcattcatactgtccatcatggatctgtttagattagttgagtactgttctacttacatgttgtatttatcgttatttaccagtgacagatattatcattggtctgacaatcattctcacaggtccgagtaaatgtacaaataaaaagagtgctaaaattttacctaacagttttttttgttagtgatagaacactngtttgtgag

SEQ ID NO: 499413 - DNA, 767 bp, Homo sapiens
  misc_feature (82)..(82): n is a, c, g, or t
  misc_feature (137)..(137): n is a, c, g, or t
  misc_feature (150)..(150): n is a, c, g, or t
  misc_feature (156)..(156): n is a, c, g, or t
  misc_feature (206)..(206): n is a, c, g, or t
aaatggaacacgccatggaaaccatgatgtttacatttcacaaattcgctggggataaaggctacttacaaaggaggacctnagagtactcatggaaaaggagttcctggatttttggaaatcaaaaagaccctctngctttggacaaantatatnaaggacctggaaccagtgtagagatggcaaagtgggcttccagagcttcntttccctaattgcgggcctcaccattgcatgcaatgactattttgtagtacacatgaagcagaagggaaagaagtaggcagaaatgagcagttcgctcctccctgataagatttgtcccaaagggtcgctctaaggaagtctgccccacagcttcccccatagaaggatttcatgagcagatcaggacacttagcaaatgtaaaaaataagatctaactctcattctgacaagcagcagaaagaataactgtttagattcaccagataagctttggattctttgtattgtgtgcatccccttgccctcattaaataaagttgcttttttaggttcccatagaagtaccctgagaactactaactacagatgaagaaagaaaaattggcggagggaatgttttttggggtggggtgaaaatgaatggtccagaagtgggggcctggaattgctgtcttcccagaacccgttttgtgtctcagatggggaggcaaggggcggggccctctaagaggagcgcctgatattgtccagaaccgggtgaccgtgttatacggggaga

SEQ ID NO: 499414 - DNA, 465 bp, Homo sapiens
gatggagtctcactctgtgaaagacgaaagaagatgatgatgatgacacagacactcataggaaaatgcattatggagatgttggcagggattagagcaagacttctacattctattgaaaacaggattgctggcagccaccaagagctgggagaagtgaaaaatagattatcctgtagagccccttgagggagtacagtcctgccaacactttgatttgagacttctgggttcccagactaaatgaagagactcctctatgccattcaccactgtgttaaatacttgcaaggaatcttacaacaggtggtgtcggacaaacacaggtgcgcatacactaagacatccatggtatctacagatacctacacagcatgtactgtgagagggaaggtgggccaagtgtgatgggtgcggtattactcatgtctcaccactacagagaacaagttctgcagaatttct

SEQ ID NO: 499415 - DNA, 686 bp, Homo sapiens
gggctgtaggccacggatgtatacggtgcaagctgccagatcctgctgcatctagcgcattctcgacaaaaaacctatacagtgctggcccatggacatgcctttggacctctcattcgtcgcggacagaccctaatatattctcaacaaattggctcaaacctgcaacatcatacttgtgaagaaacttgtggcgtcgtaattgcccccatagacgcgaccacggacgacacctgaacttgcgacaccgacaccttatcttgctcaccgcccttgccccacccaggaacacttcgtacccaatgaaacaacctactataagtcgaaatactggtggccttccgtaacttcactcttggggccattctcctacttggcgccgccaccttggcccctcatccccctccatttgcgcactcatatcttcaccaaaagcttgatgggggtaactcctcacggttgttcccaaactgttgggccacactccttggcggacttaagaccgtttccgctgcgcacgcagctaacaccgagcacaccgcgcaacgcgcttataccacgcaagcacgctgggttcaacacccgcttcactacaaccgcgcccaccgaatgacctaagcccacaaccttaccacaacccgtgctgaccacaacatatcccaccgcttctacaccgggccaacaca

SEQ ID NO: 499416 - DNA, 182 bp, Homo sapiens
acgagatcttaagcaatggtcagcaaatgtcctctgtatactagaataacaatcatgcagtcacagtatccagtattgtctgcaagtcacttcacaaaaactacttattttctgttattcttatttgggaggcacatggaactgaccgatgtagcagaccaattttattcaactaccccacc

SEQ ID NO: 499417 - DNA, 245 bp, Homo sapiens
gcgcacaaaacagccaccgattttgctatgtctctgagctgcgagataatcagacagctaaatggagactgagcagctggtccatagaggctactatagaaacagctacaacagtctaacaagtgcaaggagcgatgaggaactttagacggagcagctgttattatggactttcaaacatctgaagatgacaatttattagatgctgacactgcaggtgtgactcattatacaatgacaaatgg

SEQ ID NO: 499418 - DNA, 636 bp, Homo sapiens
ctaattttttttgtatttttagtagagacgggggtttcaccatgtggccaggttggtctcgatctcctgacctctggtgatccccctgccttggcctcccaaagtgctgggattaccgacgtgagccagcgagccaccgtctcctggtccagagaaatctttaagagcagtagtaactccttcagcaccaccgtgtgccacccccaaaagcgtgattgagattgaacctagaggctagagcagatgaggcgagcaagaaaagagttcatgcatgaaggaactccactagaaggcatagttgcacttgtcggcatcttcaggttagagactagcagaatttagatgttcaaggacataagatactgaaattatcagatgtggactgtaacatctgatggatggaatatatacactagtggaagtataaatattaagggtacattttatgtagcatagaattcataaggtggactcagcaagaatgagcaaggcaatcaggaggtgtcaataagatgaccagatgaattttcaaagagacgaacaggataatagaactttaaaaggagtttaattgttgaaagtgtagaagctctggtggaatgggttcaaacaggagattgtatacagtaaaggaga

SEQ ID NO: 499419 - DNA, 463 bp, Homo sapiens
  misc_feature (19)..(20): n is a, c, g, or t
  misc_feature (70)..(70): n is a, c, g, or t
  misc_feature (89)..(89): n is a, c, g, or t
  misc_feature (100)..(100): n is a, c, g, or t
  misc_feature (114)..(114): n is a, c, g, or t
  misc_feature (250)..(250): n is a, c, g, or t
  misc_feature (342)..(342): n is a, c, g, or t
aaaaaaaataaaaaacaannaaagtaaaaaaaaaccaaagaaaaacaaaaaaaaaaaaaaaggaaaaaanacaaaaaaaaaaaactaancacaaaaaacnaaaaaaacaaatanaactcaaccaaaacaaaaaaaacaaaaaggaaaacccaaaaacatgtcttcaaaaaggaagaactacaacccatcaataaagatccaggcagtgagcgaactttttacaccctgtagaattgtgggctgaagcganactctgattttctgtctagtatcagagaatgctggtagcttaaaatttttattttaggacttgcaaaaaaattttcaggaaccgtcaaaagngaagcagcaaattcacatattttcgacttgagaaatgcttgtggtatgtgttttccaaactgccccctatatgtaaagttcagtttaaccactccttgccttgttattactaggttttttg

SEQ ID NO: 499420 - DNA, 618 bp, Homo sapiens
  misc_feature (151)..(153): n is a, c, g, or t
  misc_feature (155)..(156): n is a, c, g, or t
  misc_feature (207)..(207): n is a, c, g, or t
  misc_feature (245)..(245): n is a, c, g, or t
  misc_feature (247)..(247): n is a, c, g, or t
  misc_feature (276)..(276): n is a, c, g, or t
  misc_feature (301)..(301): n is a, c, g, or t
  misc_feature (406)..(406): n is a, c, g, or t
  misc_feature (475)..(475): n is a, c, g, or t
  misc_feature (484)..(484): n is a, c, g, or t
  misc_feature (530)..(530): n is a, c, g, or t
  misc_feature (603)..(603): n is a, c, g, or t
  misc_feature (617)..(617): n is a, c, g, or t
atcaaactggcgcagatcaggcctctataaccgccagagatcacattcagctggtgaaactgcaggtggaagaggtgcaccagctctcccggaaagcagaaaccaagctggcagaagcacagatagaagagctccgtcagaaaacacaggnnntnngggaggagcgggctgagtcggagcaggaggcctacctgcgtgaggattganggcctgagcacactgccctgtctccccactcagtggananagcaggggcagatgcaccaaagctttgcnttggcatgactgtctgtgcaccganaagaggcggcagatcctgcctggccaatcaggcgagacccttttgtgagctgtgagtgcctcctgtggtctcaggcttgcgctggacctggttcttaacccttgngacttgcaccctgtttaacatttcacccactctgtacagctgctcttacccattttttttacctcacanccaaagcanttttgcctacctgggtcagagagaagagtcctttttgtcatgcccntaagttcagcaactgtttaacctgttttcaatcttattacgtcgtcaaaaatgaattaagtacttgttccccnggttgggaatgcang

SEQ ID NO: 499421 - DNA, 364 bp, Homo sapiens
  misc_feature (205)..(205): n is a, c, g, or t
  misc_feature (278)..(278): n is a, c, g, or t
tagagatggagtctcactatgttgcccagagtggtctcaaactcttgagctcaagcaaagctcccaccttggccttccaaagtgcttggattacagatctgaaccacgacacctggccctgggctctacttttcataaagtttcacattttagactttaaatccaaacccagaaactatctcaacaagagttaataaatagactncaactctggggaatttttaagattacttttttgatacgtaaagtggcatagtcacacataggaaggcaagggntttttttttatttatactaaaaaataactaaaaaggcactatttccctaacatttttgaaactttgactttaaaaggcacttttta

SEQ ID NO: 499422 - DNA, 109 bp, Homo sapiens
gtgacaacacgatcggcatagcgcactacaggccagaactcctgggctcaagctatcctcccacctcagcctcccgagcagtcccaattcggcgacaagggcaccgcga

SEQ ID NO: 499423 - DNA, 512 bp, Homo sapiens
tatgcgccagggtcaggaaaaaaatgagttcataatacatttgttacgattagaaggaagaaaacaaacaaacaaaaaaagatggcatgtgtcgaggcaagaaaatagacaacatattccagaatgaaggcaaagaattataagaggataaaacagcagtaactaaaaatgataagtaagcgataaacacaatgatgagtaaaatgtctattcctgaatccgagacggtgcttcacaaagacagcctcagaggccacaattccaaagcttttttctacgtacagatattctccccgatgcctgggttaatggcgcccgaactgcagaaaacataacctcaaccgagttttctgcttcaatgacaaatgacaccagagccccaccaccaaaccatggctggcatctatttagttctgagcactgctctgacagaatgcatcagtcttgctttgctctcagcaaaactgggtgcagaggggacggctgttagcctggtcgttgttacacattct

SEQ ID NO: 499424 - DNA, 257 bp, Homo sapiens
ccaagtaagggtactgtaggatacgagaatgggcggtaagagctgatgtcagtcaggggaggaccagatatgtgccatgggaagggcgctcaatgtgtgatatagtatattacaaagtgatgtggctttgcatggttagaatgcgaaccaaaaaacaagtgagatagagtgtacccctaaggtaattatgaaccgtccagagcatctggaatccgagaatataagcatataggacgtgctgatgatgctatacaaaa

SEQ ID NO: 499425 - DNA, 391 bp, Homo sapiens
  misc_feature (14)..(14): n is a, c, g, or t
  misc_feature (17)..(17): n is a, c, g, or t
  misc_feature (42)..(42): n is a, c, g, or t
  misc_feature (109)..(109): n is a, c, g, or t
  misc_feature (112)..(112): n is a, c, g, or t
  misc_feature (239)..(239): n is a, c, g, or t
  misc_feature (276)..(276): n is a, c, g, or t
  misc_feature (336)..(336): n is a, c, g, or t
  misc_feature (376)..(376): n is a, c, g, or t
  misc_feature (390)..(390): n is a, c, g, or t
aggcagccacctgngangtctgacatggctgtcagcgacgcnatgcatcccgatcatttctccacgttcgcgtcatggcccggcggaagggagaagacactgcgtcaanagntgccccgaataaccgctggcggatggagctctcccacatgaagcgacttcccccagtgcttccggccgcccctatgacctggcggcggcgaccgtggccacagaccatggagagcggcggcgttgcnggcattgcggcggtacaaccttggcgcccctacctcnggagagagaccgaggagttcaacgatctccttggacctggactttattctctccaattcngctgacccatcctccggagtcagtggccgccaacgtgtcntcgtcagcgtcaant

SEQ ID NO: 499426 - DNA, 1190 bp, Homo sapiens
gagcggggctgcggcctgcggcggcggctgcttgcagccgctgatcttgaagcaccgtgactgtgctggttcacgcagtgctactctatggcagcgtgggacgtggcgggtgaagcgttgcatgccggcgatcggtcgtttccggtccgtctagaggcgcacggtcggcggcttgctccattggaagtagatgtattgtgctggcgcttgagcacatatagcgccagtctccgtcctcgtgcttcgcttgtctaactatagatggtcccagggaacgtgactgcagtgaagcgacgacactggctagccatatattgcatagccgggccaggcgtcacaacgcgacgctgttcacattattccgccaccgcgctaccgcgtgctctcctgacgtacccaacgcttaactatgcgctcgtgtacatctcccgtctacagcgtgaccctatacgggccttgtcgacactctgtaccgcacctccacgcctctccggcactgccccgtcgccatgcgtcgtaagttcctcaggcaacttgcccttcctctttacatacgacggagttcttaaccattgcgcccacgccacacgctcaccacctacttgtcgcgcgcagctgttcaatgtcaccttacaacttgcttccacaagctggacgacactgggctatcaccacagggcgctaagttgttacaacagagagcccattatagttccccaatacctgccaccgcccaaatgcgaacgtcccctctctcgccaaccggcgtcacgtcgtcgccgacctaggggaagagttcaccccccacgcagagaggaacaccacaaacgttaccttacgcatatgcatctgtgggtacccgcgaaacacctgtccaacgccatatgggcccccttatccccgcgacctcccgccaccccgtcacactgttcaagtagcttacttcccttgtcttacccagcgctatttactctgtcggcgggtattgcggtccccgtgtcaagtgaggcaacctgtgccttgtcaccatgtggcccgtcctcgaccaaccaaattctcaaacagcacgcgttctagtgcaacagcgcaacatgaggacagttgttatatcctgacagtggctcgcaagccttagctacctttctacacgggtatccctgggtcgtgtttaacacacaaacacccttgtg

SEQ ID NO: 499427 - DNA, 419 bp, Homo sapiens
caggtcacgccgtttgtgctcaactctggcaagtgcaagctggtggtcgaggagtactacgaggtgctggaccactgctcttccatcctcaacaagtacgacgacaacgtcaaggcctaacttcaagcggggcaaggcccacgcggccgtgtggaatgcccaggaggcccaggctgactttgccaaagtgctggagctggacccagccctggcgcctgtggtgagccgagagctgcgggccctggaggcacggatccggcagaaggacgcacagcccacaccccggttcctggggtttttgttccattccagcagcacttggtcatgcgtttcgtcacgagtccagtcctactgttgccagcccccctgtccgtgatgcgtctggtttctgtgtatattatgtccttcatttatctatc

SEQ ID NO: 499428 - DNA, 659 bp, Homo sapiens
  misc_feature (2)..(2): n is a, c, g, or t
  misc_feature (107)..(107): n is a, c, g, or t
  misc_feature (165)..(165): n is a, c, g, or t
  misc_feature (231)..(231): n is a, c, g, or t
  misc_feature (348)..(348): n is a, c, g, or t
  misc_feature (419)..(419): n is a, c, g, or t
  misc_feature (649)..(649): n is a, c, g, or t
tncctttttcccactccattctgtcatttttttcacatatgtacaagaaaaatgaaagagtctctgtgtatgtgtgtgtgtgcgagtgtgtgtggtttgtgttgttnttttcttgttttaaaaagctctgctggtcgggtgggtgggggggtgggcgggggggcnggcggcgcggtcaggtgggggtcccgtggggggtgtccggggcctctgggggggcgcctccaggcncgggctggaagggcatggggatgggggtcttcaccgggctctgcgcgggacagccccccgttgggtggcctgtgtttgcactgcatggggggcatggtcgccgggctgctcagcggnagcggcgggttgctgctgggcgcctggtgggagtgtccggctggtgccgtggctgctctgctctggcgggngggtgctgcccgcgagctgggtgttctggtactcccgtgtcggctccaaggtctgggtgggagccaggccccccatctccagggccgagagctcaatcgacgctggggaaatctgcttgtgagcaatgtcttcatccatgaggctgttcatgcgccggtgggcctgctccaagttctcttctttgtcctccttgggggtctcctggtggcaccggttgctgttcccccanaactccaggg

SEQ ID NO: 499429 - DNA, 2187 bp, Homo sapiens
atactgagtatgctacttaaaatttgatcttcattttcctctggaaataatagatacatttagcctcactggtaaaacttaatagtttaaacttatcaagcatgttaaaatttggggagagtttgtaagtaactccccaggtttattaagtttatattttgggggcaagtaataacatgtacttgacatcagccagaatttttttgccctaaaatagaagacaaatggtcacttttttttttttctgtagctagtgtaaagatagttgtatagaacttttgcttgcattgattggcttccgagatgcagtcaagtttactattttctgtttagtatattactagtttgaaagttctttttggaaacctacttgacttcagtgcttggcagttcatggaaaactaacttaatgttaacttattaatccgggttctgtctgctaaaacttatgtgactttcttgattaacacttcttttgaaacacttttcttctttctctttcagtcttggtctttgtaatgggaaaagaaggggtccatggaggcggattgaataagaaggcatactcaatggcaaaatacttgagagactctgggttctagctgctaggcagactgttaagtattaggggaaaattgctcttaaactttcctagctataagcttaagtcttaattctggaaattttattggcaatgcagggtgatggggtatgaacctgtgtctcctttgtatccctctgttggtggggaaaggtgtctttctttctgccctccccccccaaaataattctgttcacttttgttttgtttccttgtgtactccagtattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttctctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgcccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccca

SEQ ID NO: 499430 - DNA, 2021 bp, Homo sapiens
  misc_feature (1641)..(1641): n is a, c, g, or t
  misc_feature (2021)..(2021): n is a, c, g, or t
acacaagtggatgagtacgaggtctgcctgaaaggataggcataagctctgtggtaatgcgatgcgtagactcgcgtgtctcgtgggagctgtcctctctaccgatcagctcggtctcggatgtgcgcgagacgcctgtggggcttgcccttgttcacgaccgtactcgcgtgaattgtgtgggtataggtctgtgtgtcctggttcgggcccaggatgctgcgagcagcttgcatagtgtttcctctaaaaactcgcggcggtgagttgcttcgagttgccatagcgttaaagccatacccattgtgcgacaatggtcaaacgaaagcttgcaattgtaatacacatttcctcgatcttcagagattggccaagcccaaatagcatatgccctttgtggcaagtcgcaatagcctcctatctcgttgaggcgaacaagaagtgtttgcgccgcatttacaaacttgtacaagcagaaagtccgtatgtcctatgtgcaagacggatattatgtgtgcgcgtaccagtaatggcccaaacccgtatatggttatggggtggggaaattaggccaaagagacagatgtggttaactccgcatccccaaccatagtggaattacgccctagggcgattgagcacgttataacaagcggatatgggccgtgcacaatgggggttagggacttttggaccttctgcccatagagagaagcgtcggactttccaccttatggtgggggcaacaaagacgtcatcaggggccgttcacccgagcgctttggaaatttgtaccacgccgcgttggggtaacctactgggcggaggtttagtgggcgaaaaccatagttggagggggctgccgaacccgattctctggcgaagtttggtcccatattgctaatggtgggtcccttggggaggggcatcacggatgacgtggcgcagcccgcccagttggacgtctctggtattccagacgcgctgcttttccctctcggattttaggaaccaccacgcgccatggcgggcagaaggcgcaaattcgaggtgccctccctgtcggccatttgttccctccttgaggagactgtgtgctctttggggatccgcattggagcctctggcgaccgaagtctctcggtttccgcaatctcacatatgggggcgtcgtccatcggcgcaagagattgggcgcccgggcttttgaatgtttcggatgagatgggaaggtcacccggctcttttatttgtcacgacggaaaccgttgaacattttcgcacgcccgcgtgtttggagcgcgcgtcttggcgcgcccatacgggcgcagcgctttccccccgagtcggccccccatttttggcgcgagccgaggacgaccctcaggttgggacgcgcggggggggcgagcgggactaccgatgtctcctaccaaccgccggcgtctgctgccccgccacacagcacaacgcggacgcaggtggcagttcttagcctcccatggtggctaccggtgggttactaacccacacgagaaatctggtgtctctccgcaaaaaagatgaccttccctagagagggcctaacaaagagtaggagacaaattaaatttttggctgctactatataaggtggtgcgnagacccccacaccactcgaggaaaagaaccagcgggggtgggagccaacgacgcgctcctctggctaaccaacaaagatcgtgtgtcttgattagattgactgcccaccgctcaactcgaggatggacgcagcagacacatcgacgcacgcgtgctctctaccgctaccacacacactgctgccagcttgatgtagcaagcccacatctgaagtccagccatgagaacaactattagatgtttgccgcaccccgcagacgatccaaatagatcgactaggtgaaagcagcaccaccacaaatcaaatctaatagcaaacacgcggctgcttcttgagcttacgatgccgccagaaagcatcactcactacactatcaatn

SEQ ID NO: 499431 - DNA, 494 bp, Homo sapiens
  misc_feature (112)..(112): n is a, c, g, or t
  misc_feature (148)..(148): n is a, c, g, or t
  misc_feature (423)..(423): n is a, c, g, or t
aaccctggaggggcgttcgggtgccatcgtcgcgctggcaccgaactacgccatctacatgctgggccgcgccctgatcggcgtggtcgtcggcggcttctggtccatgtcngccgccacggcgatccgcatggtgcccaagcgcgangtgccgcgagcgctcgccatcgtcaacggcggcaatgcgctcgccacggtggtggccgcgccgatgggcgcgtacctgagcaccgtgatcggctggcgcggcgccttcctgtgcctggtgccggtatcgctgatcgcgctggcctggcagtggaagacgctgccgtccatgcccgccgccgcgcgtgcgccgggcatcggccaggtgttcaaggtgttcaccctgttcaagcacccgggcgtggtcgtcggcatgctcgccagcagcctgctgtncatggggcagttcggcctgttcacctatgtgcgcccgttcctcgaaaccgtcacgaacgtgcatggcgcga

SEQ ID NO: 499432 - DNA, 385 bp, Homo sapiens
  misc_feature (379)..(379): n is a, c, g, or t
taatatgctgtctcacttagtctttccttaaataataagcaactctgtttgtacgtatttgaaaaactggctcatgtgatattggccgaggtatatggatattaatatacagagatgaataaagtggtgtgagtgaaaaatagtgtgttcgactccaagctagctcaaaggcttacacgtccatttcaacattgggaaccattcactatagaatgtgaaagggaaatgacagaccaatatacaaatttttgtaggaataattttggatatataccacaagatcattattcacatattaaaaataaatacactgtttgttaggtaattctgaaattgtcatttctattttggagttacaaataataagccctgagacagnctatca

SEQ ID NO: 499433 - DNA, 983 bp, Homo sapiens
  misc_feature (180)..(180): n is a, c, g, or t
cccgagataatgtgtctacgccgactgtggtacttctcgggtccaatgcggtataatccagagcttcttgtcggggacttcttgccacgccactgggaagccgagtgcgccccgggggcaccgtgtcgtccgcccagatgtattctgtcccctccggccttatgcccccgtgtgcctccnctgtatggggctcccaccgggtcccgaaaacagaagatgcctgttaggttgaacacaatggattcgtcgcctcttttgcgtcctaccaaactgggggaggggccgcccccaatgtgtggagagttctgggagagcaacccacattgggttaatgcgtctctctctgcggaacaacccaaggcgtgctggagggcgttctccggccagcagcccaaccaggggaggggaccagcacaggtcctggcgagagaagaagggccccacgcgaactcagcgggggggactaaaacaacacccgctggtgcccaaaggacagtctctgacgagtcagcacacaaggagcccaacagggtcgtcccacagatacgcatcaaaaggagactactccaagcagatatgattagcccccgtggcatccggcgtgcacgcccccccctctgtaaacgccaagggcggcgaggagaagacgttgtacacgaagcccgcttgtgggaatacaagcaggcggcactcaagtgctccaatgttggttacaaatcgggtgctttatatgtgaggaacacaccgcgcgccagtggtttactacgcctcacgcacagggagcagtggagaaagagttgtatctttggcggcgacactcctagggggtgttccctatgtgcgggcgagtgccggatacttgagtcgtagtaggcggggttcgccagaagcacgcagactatgggtgagtagggagagaccagcgatgagccccacgattctggccccaaaattggggcgcccaattaaagaaccacatgaca

SEQ ID NO: 499434 - DNA, 300 bp, Homo sapiens
agtaccgtgatgtctacacagctacttcggaggctaaggcaggagaatcacttggaccaggaggcagagttgcagagagctgacattgcactgctgcactccagcctgggcgacagagtgagactcttgtctcagggaaaaaaaaaaaaattggattaggtttaattgaccttttttcacccaacaaaatattcagcaatcctttgcactactgacttttccccccatttaattaagtttagttccagttctgccatttagttacctgtgaaggagcattcccggggaactccctctaga

SEQ ID NO: 499435 - DNA, 105 bp, Homo sapiens
  misc_feature (80)..(80): n is a, c, g, or t
cccgctgtaccagttgcggagatcaagaacctcttcactaagaccatccgcagtggtaccccgcccgcaggtcctccgcnctgaccccaagggcaagtccctgaa

SEQ ID NO: 499436 - DNA, 1009 bp, Homo sapiens
gacagattcgcagtggtcgctgcttctccttggtaagtgtgatccttggtaagtgtgatcagatgcttgccaccggcagttgtgggtctaatgctatagatcagtagccgagcttccctaggaggatcatataatattttatttatttacttttttttttttttggcaaacaggagttcggttgcgccccctcaggctggactgcaaggctcgctcgcaaactctccgcctgccgggtttcaagcgatttctcgtgccttcagcctctccagcagtgtgggattacaggcacgtgcccaccacgccgggcaattttggtatccttaggggaaacggggatccgctagttgtggcaggcgtggtttgagaacctcctgattcccggtgatccaccaccctcggccttcaaaagtgctgggatacagggcgtgtagccaccgcgccgggccggaaactcatggtcctctgaacaacatataataggggatagcactaaggcggcatcggctcccacactctaagagtccgcgtaaggcgggccccgtgggccagaaggtgggcccatgcgagaccctcgggacccgccagggctgaccgaccaacccagcgagcctctgaaggtgacaccgcacccccactgataactctaacggcactacatagataggcagcatggtcgctcctcactactaggtgccgccaagtgcatcgggaccccatgggcccttaacgaaattgtcaccaactcggcgttcatatggacggcccatgaacctcgcaggcgggggccaagcaagccccggcccgaacccccggatagcgggacaccgaggctgacacgcggcgggaatggatgtaagagagaggctacccactgggcagggccaaccgacgtatgcgcgcagccacaatcaatgagaccaccacaacgcagcagggccgacccacacaggccgcggcggcccagagacaccacgacacacgagctcgcccacaaacgacgaccggc

SEQ ID NO: 499437 - DNA, 352 bp, Homo sapiens
atactggtgccatgaaccaagtgggaacggtaggtctttaattcttagatattcaaatttgtgttgtcttatcattagtattgtcagaaccacatagtataaagtcttgttcttttcaaaatgagtggctcttctttttctttttgttcctatttaaattgtttttaaaacttttatgggtagatagtaggtatatgtatggggtacatgagttgtttagatacaggcctacaatgtgtaataataatcacagggtaaatggggtctccatcatctacaagcatgtatcctttctttgtgttatgagcactccagttatactccctcagttgttaaagtatacaaaaaatta

SEQ ID NO: 499438 - DNA, 143 bp, Homo sapiens
  misc_feature (23)..(23): n is a, c, g, or t
  misc_feature (33)..(33): n is a, c, g, or t
  misc_feature (35)..(36): n is a, c, g, or t
  misc_feature (38)..(39): n is a, c, g, or t
  misc_feature (44)..(45): n is a, c, g, or t
  misc_feature (53)..(53): n is a, c, g, or t
tgctggtccgtgttacagttgcngcgcggcgtngnncnncatcnngccctgcngctgagccagtcgccgccgagctgcgcgcgcgcttcgccattgctggcgtcatcgtcgctctcccggttggcgatgctggtcaggagatg

SEQ ID NO: 499439 - DNA, 116 bp, Homo sapiens
aggaagagaggggaagggacattttagagattatgctgaaataatacaatttgcttccttccctctcttcttttcatgtaaaagaggaaggaccaaggagacacatggccactcaa

SEQ ID NO: 499440 - DNA, 248 bp, Homo sapiens
aggaaacggcgtggaggctttgcagttcaggcgaggaagccaaaaagaaacgaaatagatgcggcgcgcccagctatgcgcgacggacagcagaggaggtggaggaagaagagaggggccggatcccaggccccgttttcaagggaaagtggaaaaataaggacggattctcatcttttcttccagaggagtaaattttagatcaagacatttattgcaggacttgagattgttgatgcctcattcta

SEQ ID NO: 499441 - DNA, 111 bp, Homo sapiens
catgacatggtgtgaggatcaaaagagataataggttggagctttttttcttttaaggagagagagagtctcgcactgtcgcccaggctggagtgcagtggcgcaatctca

SEQ ID NO: 499442 - DNA, 448 bp, Homo sapiens
ggaaaaaaatgtgcgaccggtggtccgtttgtgtcctggagtgggccagaggaaccttattttgcaacctgtggcagagctgaagaagcaaacgggttttgagcacaggatggccaaagaacagtggtggctcaaggtgcgcccgctcgtgagaatcctggccaagtagaaggcgagctatgaggtgtcggactcaggccagctggaacatgtgcagccctggagtgtgtgaccgagtcgcgccggcatgtggctgcaggcaccgtggactgtgtgtttttgtaacacttaagttattttatcagcactttatgcgcgggttattgacattaatacctaattgcgagtgcccatctggcccacgggctccagtgtgtgctgtctgtggagtgtgtgtcatggtttcaggtggtgcgtgtgggcagaattaggtaaagatttggctatg

SEQ ID NO: 499443 - DNA, 453 bp, Homo sapiens
cctattaacgctcggtcctctgaaatcaaccatgccgacaatgaataaatgtgaataacgggcctcgtagttgtcagcccccataaaattctacttaaacttgacgatatgcttgacaacgggcatattccggataatattgccgacatcattgctgtccttaatgtttcggcttactgctacttgtcatacgccgttactacgttgcttactcccttgagttttgcacaaatacgagtttggctttcgcctacccctgcgcacagtcatgttgctggcaattttacagtacttcttgcatttacacgtttttattatgcaatagcgattatttttaattatatctaacccgctgcaaatgggcgattacttaatattatctcccgtgtatttcacttactttttcgcattcatataaaacctactgaaattgccgtgcactccggtgctaat

SEQ ID NO: 499444 - DNA, 547 bp, Homo sapiens
  misc_feature (34)..(34): n is a, c, g, or t
  misc_feature (71)..(71): n is a, c, g, or t
  misc_feature (75)..(75): n is a, c, g, or t
  misc_feature (109)..(109): n is a, c, g, or t
  misc_feature (136)..(140): n is a, c, g, or t
  misc_feature (155)..(156): n is a, c, g, or t
  misc_feature (159)..(159): n is a, c, g, or t
  misc_feature (170)..(171): n is a, c, g, or t
  misc_feature (179)..(179): n is a, c, g, or t
  misc_feature (186)..(186): n is a, c, g, or t
  misc_feature (190)..(190): n is a, c, g, or t
  misc_feature (232)..(232): n is a, c, g, or t
  misc_feature (312)..(312): n is a, c, g, or t
  misc_feature (337)..(337): n is a, c, g, or t
  misc_feature (394)..(394): n is a, c, g, or t
  misc_feature (456)..(456): n is a, c, g, or t
  misc_feature (538)..(538): n is a, c, g, or t
taatgtaaaaacatactttacataagaatactcncatactttacaatgttacaaatatatatatgtatganagantcatgaaggcatttgatataaaacatacacagtntgccattttaatatacaaatgcttaannnnnaatttagtcataagnnttncgaaatcatcnntaatttgngggggtnttcntttttcttaaaggtcacattctcatcctttgggatgtgcaanaattatgtggtttacacagttttatccacattcaaaacatcacgttttggatgtcttcagcatagcatgtacagtataanatgtttccataggaacacaaaaganactgtcactagtggcctgctgtcagatggcttctaattcatcagttagccatttttngggcactagtccagcttattgctacaatcttcaagttgttctagtcacccaaattataatgnattcaatgtataccagaatttaccaataaaggctcaaagagttatataatatacaccaatatacacaaaacagctattctgngtgaaatga

SEQ ID NO: 499445 - DNA, 860 bp, Homo sapiens
ggaatattaagacatcttaacaacaaaccacaacatgcctgcatgtctaaaagaaaatatgggcctggtgtggtggctcacacctgtaatcccaacactttgggagcccgaggcgggtggatcagctgaggtcaggagttcaagaccagcctggccaacctggtgaaatgcagtgtcaactaaaaataggaaaatcagccaggcgtggtggcagacccctgtaatcccagctactcaagaggctgaggtaggagaatcacttgaacttgggaggggtaggttgaagtgagctgagatcacaccgaaatggggtggggcgcagtggctcacgcctgtaatcccagcactttgggaggccgaggtgggcggatcacgaggtagggagatcaagaccatcctggctaacacggtgataccccgtctctactaaaaatacaaaaaaaaaaaacaaaaaaaaactagccaggcatggtggcaggcaccggtagtcccagctactcgggaggcagaggcaggagaatggcgtgaacctgggaggtggagcttgcagtgagccaagatcgtgccactgcagtccagcctgggtgccagagtgagactcccgtctcaaaaaaaacggaaaatgggcacaacaagtactaacattttgcaaagaaaagacatcccttggggagtgtaactgaacaattctcagcactcataactacataattgcgactactagagagaaaaacataagaaaaaaaaggggggcgaaaaaatcccagggagcaagcacgcgccaagtgtgcaaggcccgtagggggtaaggcggcggcggcgtacaacacgcgggaggcagggccgagacacaccgggag

SEQ ID NO: 499446 - DNA, 782 bp, Homo sapiens
ctctgtgaaccctctttctgtagtggatctttcccatcagcgtaaaacatcctgttatttcccctttttaaataaaacctcagttttttttaatgcctctcttttactgctctgtatgtttgcttcccttcacccaaacacttctggaaagagttgtctgcagtgactctttccagttcctcaccccgccccaccgtagttctcttcctaaccctctccaacaccacttccatccccagactgctttcttgctcttgagttcaccagtgacctaatcagtgtctgagcatcattcagcacagttggactctctcttggcttctgtgacctggaacttctggtttcctctctacctcatcctccactccatctcatggcttttcctcttctaacctctaagtcagagggccccctagagctctgtcatgggttttctccctcagcattctcttccctagaagtttccattccattctcaagctcttaataccacctataggccagtgacccttacatttattactaatcttgacctctccccagagctgctgtcttagatacctagctgcttatgcgatgtcttcacttggatatctgacaaacatcttgtttccaagagagaactctttattctccctcttgctaagattccatatcaggacatagcattatgtttgccagttcctaggagttaacttataattctttcttacccacattcgcatattcaagtcattgggaggtcctgtaattttttccccagaaatttattttagaaccag

SEQ ID NO: 499447 - DNA, 384 bp, Homo sapiens
ccaatcaggaatttcaagaccaagaacgacccaacttggcagctattttcttgtaggaggacatgactggcctggccggacctcgtgagcacatagtgtcctgcccaccctaccagctcctccagccctgccgggcacatgccctggggacgcctgcgctgcccaggttgcctcctggcctgccctcacctctgatagactttgtgactctgaactgctctactttgagaagatgaccggtttggagtaatcagaatgaaccctcctccttttaacgggttaacctttgtccctttttctaaaaggctatgtatcgctcctatggaaagaccagatccttaaagacgttgggggtataaaaggaacgtggggccggaatattta

SEQ ID NO: 499448 - DNA, 113 bp, Homo sapiens
  misc_feature (48)..(48): n is a, c, g, or t
gtctgctgccggtcgcctctcgacggctcccccacgtcctccacctcncaccctgccaccttcggccgggtacttgacgttacggacgcggacgggaccggggtgacggaccg

SEQ ID NO: 499449 - DNA, 875 bp, Homo sapiens
gaggtccaacagccgagcttagcccaccgggctctgggaaagacccgactgaggctaaagccgccccggaaggccaagtccgagttccatttcttgaagaggccggcgcgcgtaaggctgtgacattggccctggcgactggcttcccaggagctgttctttctcaggagctccacagcgcgggccatctccagaaaactgtcttctagacagacctgcggttttatagcagttttggcagtcaacttcagcttgtgcctgagcagacggggttgtggtggcccgccagcgggggatgccaggccacctcccccagcggcacgcagcccctctcttaattagatcggttttcccctggtgtccgggagagcggtcccggcagaaagtcagagtgtatttccttttatcgtcaacccagagccccaccgcggctaatgcaagaggccaaaaaatgtttggaggaagaaaaacaaaggcaggaagtggcggcggcctgacggtgcgtgtgtgtctgcagagaagggagggagccggctcagtctcttcttgtttttccaaacttcaaggtccaggcagccctctgcagggccgggccccattgctccccgcgcggcattggaggtggccgcccggagaggagaaggccaacgcctgcgccaggcttgtcaggcggaaacggctaacaaggagatttggtcagcaaaacagacccagcctttccgaggcttcgtctgacttggcccgaaaggttggggagggggggcttgcgcagagcctcagggaccctcctctctggggactaccatccctgagccttacgcttctttccacagcctttgcaggcggaatatcggaataaagtgggtccaggcgcc

SEQ ID NO: 499450 - DNA, 128 bp, Homo sapiens
  misc_feature (9)..(9): n is a, c, g, or t
actcattanatcttcttcctgtaattcttcatctgaactctggtagtggacccttccaaagttcagattctgcagcactttcttacctcatcagagtactctcaagtacgagaatctccagatttcta

SEQ ID NO: 499451 - DNA, 833 bp, Homo sapiens
gaggtccaacagccgagcttagcccaccgggctctgggaaagacccgactgaggctaaagccgccccggaaggccaagtccgagttccatttcttgaagaggccggcgcgcgtaaggctgtgacattggccctggcgactggcttcccaggagctgttctttctcaggagctccacagcgcgggccatctccagaaaactgtctttcagcttgtgcctgagcagacggggttgtggtggcccgccagcgggggatgccaggccacctcccccagcggcacgcagcccctctcttaattagatcggttttcccctggtgtccgggagagcggtcccggcagaaagtcagagtgtatttccttttatcgtcaacccagagccccaccgcggctaatgcaagaggccaaaaaatgtttggaggaagaaaaacaaaggcaggaagtggcggcggcctgacggtgcgtgtgtgtctgcagagaagggagggagccggctcagtctcttcttgtttttccaaacttcaaggtccaggcagccctctgcagggccgggccccattgctccccgcgcggcattggaggtggccgcccggagaggagaaggccaacgcctgcgccaggcttgtcaggcggaaacggctaacaaggagatttggtcagcaaaacagacccagcctttccgaggcttcgtctgacttggcccgaaaggttggggagggggggcttgcgcagagcctcagggaccctcctctctggggactaccatccctgagccttacgcttctttccacagcctttgcaggcggaatatcggaataaagtgggtccaggcgcc

SEQ ID NO: 499452 - DNA, 174 bp, Homo sapiens
tctcgcttgacttgagtatcccgtgtgtcgatgatagctatgcgcagtggaccatgcacgaaaagctcaattcacacctctcactatacttcatgagctaactccgaaaaatattacttttcttctgctctactgtatcttatcctggaaattattatgcgtattgtagactca

SEQ ID NO: 499453 - DNA, 292 bp, Homo sapiens
  misc_feature (36)..(36): n is a, c, g, or t
tctgcttcctgggttcaagcgattttaatgcctcancctcccaggtagctgggattacaggtgagcgccaccaagcccagctaatttttgtagttttattagagatggggttttgctgtgttggccgggctgatctcaaactcctgaccttgggtgatccacccgcctcagcctcccaaagtgctgtgattacagatgtgaaccacgtacctgacctcattttctcttctcattctttcttgttggaattcctactaagtagtcaatgttggatatcttgtatggactttgc

SEQ ID NO: 499454 - DNA, 820 bp, Homo sapiens
  misc_feature (86)..(86): n is a, c, g, or t
caaggtaatataacggaactttacacaactttttaaaaaaaaggggaaagcttaggggaggactatgcgaaaacctttgaagattntgaacccattgtgaactagcaacattgattatgttttatattctcattttaagccgagcagttaattgcacttaagcggaagatatttccctgaaggaggatacacaaagaagctagtcccaatcgaatcagagtatagaagatcttcatttgaaaaccatctacctcagcatttactgagcattttaaaacttattttcacagagatgtctttgtgatgtgatgcttatcagtttggcccgaagaaggaaaatatcagtaccatgctgttttgtggcatgaatatagcccactgaccaggaattatttaaccaacccactgaaaacttgtgtgttgagcagctctgaactgcatttacttttaaagaatttgctcatggaccctgacatccttattataaaaaggctcactgacaagagacagctggaaatttcccacaacaatcattggcgactaacctttattaggagaagcctatgccagctgagagtgatcgctaggaggctccagtctttgcatctcaaagccttttgcctaaagttgagcccttcttttccattccccaattttaagtagtcactaatgatactagcttttccttggttctgagtaaacccaatcagagaagtttaaccctacttttctccaagtctttatactatgcaccattatcaccttctattgcaataccacaaatattagtattattacaataaatacgacaaagtcacca

SEQ ID NO: 499455 - DNA, 1090 bp, Homo sapiens
  misc_feature (96)..(96): n is a, c, g, or t
  misc_feature (487)..(487): n is a, c, g, or t
  misc_feature (898)..(898): n is a, c, g, or t
gtgaccctcatgaatcataatatattatgctagcattttaccactctcgactttctagtgaactacatagtaataatcgcgtcacaacctcaatantccctcacactacataatggcactagaacaggaattaattactatcgtcgtgattcattaataggcatatcatcttcgaataaccgcgtcaaacacaccggactctcctcttaagccacattatttcgtggcacatattgtgcacactatcgttagtcttttaggctcgcctggcagaatgcaatgcggctgaggctctaggcccctacatatgtcttgcaattcctcctatatcacctaatatttggctcttacgagctactgtatcgttaaccataaagctcgtactaccaaatttgcctcatatcatctgaattgcacccgaacattaaattactacacgtcattggctccaccataaattaacaccctcaatacatgccttgtactngttgattccttcaatctacgccgaactaagagcatgattaaacagtactaaactttaccaaactttacgcgtctctctcccattgtcaaaactgtccccaaatatgatatacatatatagtatatacattataattgaaagaagacataataaatatatagtgggggtggaaggggggggggaatatggggggtgggagcaaccatgagagaggatggtgtatttttatgagacaatacaaaatgctgtgtagaagaggtgtgtcgtgtcgtgtgtgtgggacacaaatgtttgggtgttatctttgacagaaagcctggtggtcgtcgctacacaaaaagaggagtggtgtcaatccacaacaagagagagacataccccgcagcgaggagacaccaagaagctctagtnagaggcgggcgacgagagaagatttgtcctcgccaccccgcaaagaaaaaaaacacaacttgggcggccaaggagagcggagcaacaacccagggaggggcggtgcctttatgagagcaccaaaaaactacgccaagcaaagggagggagcaccacagggaggggggacaacaaacggggggaacccgaaag

SEQ ID NO: 499456 - DNA, 318 bp, Homo sapiens
atgtgcaccaggcaggcccttcccgcagtgggcagcgtgcggggtcttcagcaccgctgaaggagtacagagcatacacaccacacagtgcaccgagccttctagtggatgggctgaccctgggggcccagacctggaggcaggcgtgtccctcacccggcatgtgacccaagacgttgtgagccggacactgaccaccagcggaacccttagcacccacatgttccaacagttcttccaaacttgaccgaacactgacccacccccgccacgtcccattaggcgtactcccatgtactgcgtgggtcccatgggtac

SEQ ID NO: 499457 - DNA, 608 bp, Homo sapiens
  misc_feature (26)..(26): n is a, c, g, or t
  misc_feature (29)..(29): n is a, c, g, or t
  misc_feature (79)..(79): n is a, c, g, or t
  misc_feature (291)..(291): n is a, c, g, or t
  misc_feature (296)..(296): n is a, c, g, or t
  misc_feature (300)..(300): n is a, c, g, or t
  misc_feature (310)..(310): n is a, c, g, or t
  misc_feature (314)..(314): n is a, c, g, or t
  misc_feature (316)..(316): n is a, c, g, or t
  misc_feature (319)..(319): n is a, c, g, or t
  misc_feature (324)..(324): n is a, c, g, or t
  misc_feature (329)..(329): n is a, c, g, or t
  misc_feature (332)..(332): n is a, c, g, or t
  misc_feature (342)..(342): n is a, c, g, or t
  misc_feature (348)..(348): n is a, c, g, or t
  misc_feature (382)..(382): n is a, c, g, or t
  misc_feature (390)..(390): n is a, c, g, or t
  misc_feature (395)..(395): n is a, c, g, or t
  misc_feature (432)..(433): n is a, c, g, or t
  misc_feature (447)..(447): n is a, c, g, or t
  misc_feature (471)..(471): n is a, c, g, or t
  misc_feature (477)..(477): n is a, c, g, or t
  misc_feature (482)..(482): n is a, c, g, or t
  misc_feature (514)..(514): n is a, c, g, or t
  misc_feature (519)..(519): n is a, c, g, or t
  misc_feature (527)..(527): n is a, c, g, or t
  misc_feature (533)..(536): n is a, c, g, or t
  misc_feature (540)..(540): n is a, c, g, or t
gacacagggtgagtccatcttttggntancactcattgcacttcaataattacacaaaacacacaagtacatgcatctncaattacgcaccgcatgagaaccgttagttataaaatctatcatcaaccagtaaatcaatgtgaaaaaatacagtgtcaaaccaaaaagtataactatagttgcatagaatattaccatgctataacatttcaaggtcattggaaacaaaagacaaattataaaagtttgccttgattgaatgaatgtacaagaataaggttcaacacatcngtgcnaaanggtttatgantttncntgncttancaganganaagataatcncttagngggcgatcatacgtatatgctgcgattcattatncccattcngtggnctgttccagcttattaaagtcacaggttaagcccttnngattatagatttcngtttatattactcatctttatgtnccaganctgcncaatttcctcatctgacaacatacaataaggnatgantatcagcngcttannnntganacaagcatttactttattttggatttctcccacccccaaacatataaatctctctctctctctcttta

SEQ ID NO: 499458 - DNA, 231 bp, Homo sapiens
gatccccggctatcacattatctaaacctatgtgtacaagtgtgtcttattaaaccagagccacggagatcaagtgactgctagtaacgtgttgtctgtaaactaatccagatgcccacgcttctccacgagggtgggcatggtcagtaaacccaagaagggtcttgagcggcctaatcccagtatcacctatctaatgaatccacttccctgtgattactgttgatagct

SEQ ID NO: 499459 - DNA, 782 bp, Homo sapiens
ggggcttccaggtttccccttgtggatgcgcggccccgcggctctgctcctcccggcgcatgaggtggccgggagaggccacatggagcgtgacctggcacgggatttctcgaggaacgggagaagactggcgcccgatcccgcgtctggagggtcggtgaacgatgaagggccggcggcggcgaccggccgatggtgctgttaagttcgcgcgtgctgttggtgctgtgcacgctggtgctgttgctcgtcccctccgtcttggacggcggcctggacggggacaagggcgccgagcactgccccggcctgcagcgcagcctgggagtgtggcagcctgtgaggcggcgcgtggccggcgacacgcgagcagtggggctgcggaggcgcgggtcccgcgcgaggaacgggggcgcgacaaccaggttctcctctggttcccaatgcaacctcacgcggcgctgtccggggacggcatgtgtctcgcggagaatgcagcacatctacgtgcatgacgccttgggcgcaccggctcgtccttcctgggcgaactctttaatccagccacccggacgtatgctaccttgtatgagcccatgtggcactctatggccaggcgctgtatccgggcgacgccgagagcttgcatgggcgcgctggctacatgctgcgtcgctcttccgtgcggacttctccgtgctgcggtgtacgcgcgccggggacccgtgggcgcgcccggacacgcaacttacagggcgcctcttcggtggggctccacggcc

SEQ ID NO: 499460 - DNA, 1184 bp, Homo sapiens
gcacgtcggagactacgtctactttgagaagctcctccagcaatcgcatacctgatccggagaatcgaggagctcatagcaagacggccattgggaacgtggagtgccaacgtggtgtgcttctaccggaggcgggacatctccagcatcctcatacgccctggcctgacaagcactgcaccagggaactagaacgtagcgaaattggagcaatcctggaacatggtgggacctgacccgagtaaaacttagaagcaccagattgcggcatctgaagagctgttcctcttcccggtagactggcatgtctcatgccctgacaagcaacatcagggtgcatagtgcaggcgtaaccctgcttcaacgctagaccgagttcgctcaatgtcctatctggagcgggaggattacttcttctatgactctaggtctacacgaaacccagagcagtaagaacctgctgggcatactacccagggaagagattcgacgtaaggacacacgggtagccaggcacgagatcacccgaccttgtttaaacagcatggcgaggaggacttggccgagagacagatccagggttggaagaacccaggtgtgggaggcgcgacaaacccatattccacagaccaaacagaatcgcaccaaggtagcatagtggtggacctgcatcatgtggagcgcaccttccgacacagagtgcctggaacttgacagcagatcccgttccggacaagaccaagccttgcaccattagaagacgccgcagattggactccccgagaaacatacacccctttgttcccacgcaccatggcataacttcttcacacacacgaaacgatctaaccgcacagtctccaaaggcaatctcagggcacatgggatgcccaggcaggggcgggagcccggtgcttcttccatgggggcactcaacaattggtaggaaagatgagatcctagacatcaagaaaggaccaaccctactacaggaggcaccacacccatggaaaagagactaatgcggacaagggatgttaccatgagacacagtttacagacaggcagttgcctcaccgtatggaaaatatagctatacaccagcgacatacatcatagacgtacacaaattaccgatgtatagacagaacacccggcgacgcataaggtggaaccaaaaacca

SEQ ID NO: 499461 - DNA, 513 bp, Homo sapiens
gcagaaggaactacctcaagatataataaggaccatctatgaatagcttgtgatcggccaggcaagggggctcacgcctgtaatcctaagactggggggaggccgaggtgggtggatcacctgaggtcaggagtttgagaccagcctggacaacatggcgaaacctcatctctactaaaaatacaaaaactagctgggcgtggtggtgtacacctgtaatctcagctacttgggaggctggggcaggagaatggcttgaacctgggaggcagaggttacagtgagccaagatcacgccatggtactccagcctgagcaacagagtggactctgtctcaaaaaacaaacaaacaaacaaacaaaaaccagtatgattatatataattatggcagaactagtagactagtagacagaatttctacagactttaaatgctaagatcccaccaaaaaacacaaaaccccaaaataacacacgccatttggtctcgcttacaggacaggggtgctcga

SEQ ID NO: 499462 - DNA, 924 bp, Homo sapiens
cgcagtggctcacgcctgtaatcgcagcactttgggaggccgaggcaggcggatcacgaggtcagtagttcgagaccagcctggccaacatggtgaaaccttgtctctactaaataatacaaaaaaaaaattagctgggcacagtggcgcacgcctgtagtcccagctactcgggaggctgaggcaggagaatggcttgaacctgcgaaggcggaggttgcagtgagctaagatcatgccactggcactccagccttgagtgacagagcgaggctctggtatcaaaaaaaaaaagttgcgggggggtgctcaatcttaactggcagaggatctacagcatgaacaaacaaagtgtggggaaagtgcttaaaaaaaattagaaaatgtggtgcaattttttacaaaattggtaagcgttaggaaatactaatatatggaatagtgaccataagtgtccgagttgatgtattggtacatttcagtcacatgtgtaatgggtcccgagatatgacccgtgtagagcagaatacgggaagtgtaatgttaagcctatttggacagaaaaaattcattcggagaaaaagttgaaggatttcagagacaacacagttgaagaaattacagggtgaatggtcgagaaaaaacggttcgggttccacaagcaacggggaagaccacgcgggggacgacgtgaagggggaacacagagcctcacataagctcgtgggggagcgtatattcaccatctagaggacgcacattggggaacaaatcgcctggcagagcacacgcacgagggctaatgggcggcccacgtggctaaggtggtacacagctcccctttcagacctgtgcacgcccttaggacagtagtacccccaaaacacaagcaagttggacctcggagctgcaaagcgatgaccg

SEQ ID NO: 499463 - DNA, 118 bp, Homo sapiens
gccatttaagagcttacacaatcaaggggcacgtgagtaaaccagtaattgtggcataatacccttagagccatgatgaagtagacataggacaggtccactgagctcttgtaccttt

SEQ ID NO: 499464 - DNA, 265 bp, Homo sapiens
tgatcgagctcgaccactcctagcctgggcagtagagcttggctctgtttcataaaaacaaaaaacaataaaaaaaacacacaaaatataattgtcaattgtagctagttggttctcctgttgcaatatccgctgccccccgccccccggcactttttttttcccgtgttttcctgctccatattttcgggtaaatgacctccgaaaagaattagaaggtcgagctcttatgggccaggcggctcttattgcccaggtgtgaagt

SEQ ID NO: 499465 - DNA, 874 bp, Homo sapiens
agctatggcgactcagtgtgcttgcgtatacctcgatcctggagtgaggttggagatgcccgtttcacagatgctgttgcgtagaccactgccacgtcccctccccaagctatagttaggtcagtcgaggacgagctaaggtcagtatactttgagagacaatagctaggcatacgtttgttgcttacatggtcactcaggatggaccactgctggtaggtaagggaggcagtgcgtttaagtatcacaactgattctgagttgtatacaccacacaaaagatcaatctctgcggtttatctaccgttgcataatagcatagtatcgtgccgatagctataggtgcttttttccaaaacgttcttattactgggcggactgataacatttaaacaaataattgtgtttgaccccaaatgactttatacccaattctacatcaacaatatagaagatctatcttttttgttaccttcagatgttcactaaataactcagttttttaagcagaagtctcagggcattaccctatatgtgtgtatgaagtatctcaaactggaacataaattgagtgatcaaaactggccattcacagtgtaaggcagcacttaacatttcgaacctaaagttccggatctggggtggtataaagaacctaaaagcagtatctggtattagctggtaaccaagtgggaagctattcggatatttcttaaatatggtgacttgggagtactgttcttccttcaacttgaatgtattaattcttgaataatggcctttttgttaacacacccttgtattacttggggagaagggggggtatggaaacaattcacgctgttttttggcattaaaattcctcaatgggata

SEQ ID NO: 499466 - DNA, 113 bp, Homo sapiens
tcgagctcgtaccgatttataatctgttatgtaagaactgtggctcttaggtaaggattacttaaactggatcggagttgttttctgttttaggtagctgaggaccatcgttg

SEQ ID NO: 499467 - DNA, 943 bp, Homo sapiens
attgtcggcctcaggcgaggaggctgcactacaatgttgtcgcgaaccggttcgtggagttcaggtgtggtagtcgactgcttgcgtacactgagttccgaaaacggggcggggcctacgtgacggaaaaacgcaagaggtctgattacaaatgggaccataatgttcgcttctgaaggagtggagagcacgctgtatagagcacggccgactgatcagagcgcaggtcacacgggagtcattctgatagaggcactgtcccgatggtggttgctgagatccaagaggttacccatgaatcatgggacaacgtagatgcacagaggatcgaggtgcgtctctggattccttggggcagcacatggtggagcattttgctggcaagaggatatgcatgtcaatgtattacgaatatccagggaaggggttgtgactaatccccagggtgcggttctttctgggtgaactctgaagaacgacaggatcatgtacccagctctgaaaggtgtaaacaaagaaattcccagtgtgcgtaacccaccacatacagataacaagaaaggagctcttagaataggagtgaggttacattggcaccagaatgttcatagaaagttagaagaggctggggtacagaagattcaaatgagccaagagggcagggacatctagagggctgcgataaacagaaatgacagtgaagaccttacctaagccatgaacccctgatagtaaaagggcacgatctcaggaagggcgtacggacgagagaccgagaaattagaccgcacgcccatggtttcgcccggaccgagggacacaaacggaacagcgaaggatggagaaagaaacggggcaaggaaggagcacagggagaagaacaagagagaaaaagacgggacgaggaacaaaagagaaaaagaaaacaagaaagagacaaata

SEQ ID NO: 499468 - DNA, 111 bp, Homo sapiens
agagatcgtatcatggtcaggttatcagtttgagaggcagagagatgttgtgacagagttagacagtttggagaagcagatgtatatctactacaggcatgcactgtagtc

SEQ ID NO: 499469 - DNA, 201 bp, Homo sapiens
tctttctgttcacatggaacaaattgaggagatcgcttgagacgaacggcgagataaatctatccaaagactactagcagcactgacttggatctggacactgagtttgagatcctcttgccacgccaacggggcctgggccctctgtgctaccgctctcgtcagctactagattcgcctacacaaaggcacgtggatcgt

SEQ ID NO: 499470 - DNA, 671 bp, Homo sapiens
tgagtccttcagttgtttggggaaacgcatacccgacactaaaaaaaaaaaaaaaaaaaaaaggatttcccttccgccattccaggaaaacggaaacccccttcgtttacccggcaacattgtcgtatatctccccttcgcagggcccaggaacttggggttcttaggttgggaagcaagacagaaccggtctccagaaacttcccgcttgcagaaccacattgtgggcgggttcttgacttccggttttcccgcttccccaagccgtggaggccgactttccccagaacacagaagatattgtattgtttatacccaaaccagaaagggaaagttgtcccggaacccaaggcccctctcttccaccgccggccccccttaccctctccgggccgcccagggttcttgggttgtcgctctcccagcgcccccagggccgcacttcttgtgccgttctcccgaatgtggggcccctctctttgtgtatctcggcggcccccaaaacccttcgccttttcctttaccggtctcagggttgagttgtctcaagttttgcgcccctttcgaagggttcctccgccgaattcttcttgattcgaaacgaaagggggagggaaaagcttggggtttaaaggggttggccggaaaagggccaccagacttggaaaagc

SEQ ID NO: 499471 - DNA, 222 bp, Homo sapiens
ctttttgaaggggttttggttcccgaataaagatttttatggcgggtgatactggctttcccgaaatttccgagaccttatttttgagatctttggcctttaaaccctttttgggttgggtttccgccctattttgccaaagggcagccaccccctgctggggggccttcttggggggggctgggaaggggctttttaagaaattaaaaaggggtcctttta

SEQ ID NO: 499472 - DNA, 137 bp, Homo sapiens
cagggattgacagaatagtgacaacgcattattccacgattcagtagtagacatgaacaaagggccatgtgtactgatgcagggacactgaaactgtgtggtcctcttgtgagaagcttcaaggggaagtggcatct

SEQ ID NO: 499473 - DNA, 1005 bp, Homo sapiens
  misc_feature (3)..(3): n is a, c, g, or t
  misc_feature (132)..(132): n is a, c, g, or t
  misc_feature (373)..(373): n is a, c, g, or t
  misc_feature (443)..(443): n is a, c, g, or t
  misc_feature (612)..(612): n is a, c, g, or t
  misc_feature (877)..(877): n is a, c, g, or t
  misc_feature (886)..(886): n is a, c, g, or t
  misc_feature (925)..(925): n is a, c, g, or t
  misc_feature (935)..(935): n is a, c, g, or t
  misc_feature (995)..(995): n is a, c, g, or t
ctntttttcaggcaccgtgttaaattgttgtgcatttctgggagaggggggtggggccctggccacagcaaaagtgccggcctctttcttgggtggggtaagacaatgtccccccccccctttttggtctgnctcctttttaagtggcttcccctcattaaatgataagcatcaaccctttcccacccagggtgccgggggtgggggggggggccggtgggtggggtgctctggaaggggtagtgcggcggctctagcccccgtgcgtcctctgccctggctctggggggcctggccctgggctgcccccccttgctgggggtggggggccattcagttctccgccctacccccgggcatcttcccagggagntaggggggcagggtgtgggaggggctgtgtcaccctgtcgggtcccggacggggggtggccatgggtgcngtggcccccccgtgggggctgctggctgccccttgccgccccctcccccaactggctaccccggcgtcccggccttctggccctggggctccggggggccgccctgggggtcggggccggggcccacgggcctagctggccctgccggggggtcccccccaccgcctgncatggcgctccattcccacacgccagctcaaggctcctgtccatgcagctcaatgttacttgtgtgtgcatgtcctgtgtagaggggaaggctgcaggggggcactgctgtgccacccacccaggggttcagggcatgcagggggccctaagcctagtatacgagccaagaccaaaaagggttaaaggctctgtctcccctccctccccctctcccaacatgccccgccctccttgggcactagaaagttttgcgatgaatagcncgggagccntcctcttcatactcctttttgggcacccacatcttcttnaaagtgtccngcggggccaggatggggcgccaatccatgtggggtcagccgttcctgcggggctgagatntgattttgat

SEQ ID NO: 499474 - DNA, 131 bp, Homo sapiens
cactctccagcctctcaccgaggatcattccaaggctacactgtcgctttgccgaagatgacaaacagtaaattgcacagcaaataaatggcaccggtgataaagaaaaccaaacgccattgtgtgggatc

SEQ ID NO: 499475 - DNA, 389 bp, Homo sapiens
aggtagtggagggagaggagaagggaggctgcttttccccagggctgcacgctggagggctggacgcaagtaagcacgtgaaggggaagcagggagggagagagggggaaggatgaaccaatctacctggagcagcttaggagctaatgagccgggggcaagaggggaggcgaggcctggtgatgtggtgggttgatcgcctgcatccagttgtaaagcttggggctgctggggagggagtgggccgagtaagggactttcccatctgagtgggctcaggagacccacccctctcctctcagagcagcaggggaccagagaaaagccatcacttctttgggtctttgtggcggctcagcatgtgggataggggtaaaggggcctcccgg

SEQ ID NO: 499476 - DNA, 310 bp, Homo sapiens
aggtatagacgatagcacatgaaagccgggcgcaagtagatatagtaccgcaagggaaatgatgaagaaattataaccaagcataatatagcaaggacataagcccctcataccgttctgcattaatgaaataagctatgaaataagctttgcaagtgatagccaaagctatagacccccgtaaaccatgacgagctagcctaagaacagctaattagagcgcacccgttctaatgttgcacagatagtgggaagcatttatagggtagaaggcgacaaaccttaccggagcctggtgattagcgtggtt

SEQ ID NO: 499477 - DNA, 714 bp, Homo sapiens
  misc_feature (361)..(362): n is a, c, g, or t
  misc_feature (365)..(365): n is a, c, g, or t
  misc_feature (367)..(368): n is a, c, g, or t
  misc_feature (373)..(375): n is a, c, g, or t
  misc_feature (379)..(379): n is a, c, g, or t
  misc_feature (381)..(382): n is a, c, g, or t
  misc_feature (389)..(391): n is a, c, g, or t
  misc_feature (400)..(400): n is a, c, g, or t
  misc_feature (413)..(413): n is a, c, g, or t
  misc_feature (428)..(428): n is a, c, g, or t
  misc_feature (572)..(572): n is a, c, g, or t
  misc_feature (597)..(597): n is a, c, g, or t
  misc_feature (623)..(623): n is a, c, g, or t
  misc_feature (630)..(630): n is a, c, g, or t
gcgccgattgggaagccccaatccaaacccccttgttgggggccaccttgttcccttcggcggggaaaccgtttcctttccgcccattttgctgcttgtttcgcgcgtggcccctcaacccttgctgtgcatcgcgtccctgctcgtctcacgtacgcctactggttctgcgttaagagctttctcctgctcaagcttggcatggagacagagtccagctccgatggctggagacgcattggtccccacagcctgtagcgttgagtcccttgtgtgatactttgggctactactccctctcccttggggtgaagggacagagccccacgctgttgacatcagcctgcttcttcccctcacnncantnnagagnnngagntnnctgttcnnnccctgggangcgctgtgccagnacctttgagccttgncccacactgaggcttaggcctctctgcctgggatgggctcccaccctcccctgaggatggctggattcacgccctcttgtttccttttgggctcaaagcccttcctacctctggtgatggtttccacaggaacaacagcatctntcaccaagatgggtggcaccaaccntgctgggacttggatcccaggggctnatctctncaagtgtggagagggcagggtccacgccgtctgctgtagcttatgaaattaactaattgaaaagttcaagagaaaaaaaaaaca

SEQ ID NO: 499478 - DNA, 355 bp, Homo sapiens
cagctctgtctggctttgcagtctgtacttagggggaaggagtgtaattgtaaatgttaactgttttgattttctagtacatcagtgtgaatcttttgctccacccttactaggaagaaacctgttgcgtgtggagagctaagggtgacggttgtgagttgtgagcagagtccatggctgctgcctcattcctgttatttttgtgccatagagtaattgtttccaggctaggctggttggccttcaagccctgctgcctgccactaggcagggggattttcctgggcctccccaacagctagatttttaccctgagttgtttcataaaagacccttactgaagtagctgctttcc

SEQ ID NO: 499479 - DNA, 982 bp, Homo sapiens
  misc_feature (965)..(965): n is a, c, g, or t
ccccacttgtgtggtgtgtgctgttttttgttggcttgctcttctcttcgtcttctcgtcgtttgctgggcccttttttttcgcggtgtggcttcgtgtgtgccacacacacagcgagacgtcatggatggcgggatagaggagggggagggggcagaagaagagtagggcccggaggtacggggtgccatggcgttgatctccggggattttttggtgagacacgtttttttgcgccggccagtgtgtttagccgctgcttccctccgcccgtgtggctccctgcgccagggctgtgcaatgtgtctttctccgtattctcgcgtagtcgtattttcgggcgctgctcccgcctgtggggcttctcatggtgccctctacgtagtgtttgagccgctatggggcgccacactgcggtcctccagctttgtttggcccgcgaatgtgccccccctcgaagtcagctgtgggagagtttggatgcaagctgttctgccgctcttgggtttcgaatctccgggttctaaacagtggcacccgcctctataggggacactataagttcaagatagggcatgacgcaggcccgaaaattgcacacaggttcttcccccccccccaaattgagacaagataggttgtggaaacatttgtctcgatgtgccgagaaccatcttagctacttaacgaaataacccggcctactcgctcctctttcctgcgccacagaggggcaaccatataagtcttggccccctacattcacgatccccctgcgcacgtcagaagttttaggcagttagtggttgccctgctggcgcgctctatttgtcatgagggagaaaggagctttcctttatggtatttgtagcgagagtaagacgcacgttttcagaagcatgaaatatatgtgtctatgaatgggggggtgcgatgattatagcccatgttgttcaatttcgccngcccacaatagacgaga

SEQ ID NO: 499480 - DNA, 616 bp, Homo sapiens
  misc_feature (31)..(31): n is a, c, g, or t
cacagaaagattaccagggcgagcaccgggntgttaatttcagtacgagggatccgagttaagatgtgatgagcggttctggccggacagacccatcagtctgagatgtggggagcgcctctgccccgccaccccgtctgggatgtgaggagcgcctgggcccggcgcgacccgtctgggaggtgaggagcgtctctgcccggccgcccgtctgagaagtgaggagaccctctgcctggcaactgccccgtctgagaagtgaggagcccctaccgacccgcatgccaccaccgactgggaagtgaggagggtctccaccgcagcagacaccaccttccgggagggaggtgggggaggacaaggcccaccacgacacaggaacaggcagccccgatctgggatgcagcacggacgccagagaggagacacatatcaccgcaatgaccccagggccaaggacacaaccacacagagacccgggcgaacagatgaacagccagcggcagatccaagtcacacgggccaggacccccatccgtagagggaacggagaagggacgccaccaacacataggccgcccagggccgaccctgacccgggaaactccacgacaac

SEQ ID NO: 499481 - DNA, 184 bp, Homo sapiens
ggggaaaaaaaataatgctatgaaattgggggggggggtatttgaaaaaataacccttgcttatgtcaaatggagctgaatttgataaaaaccccaaatccagctatgaagggctgggcaagtttcctttttttttgatgtttcccccacctaaaaataaattaataaatttatataaattcta

SEQ ID NO: 499482 - DNA, 190 bp, Homo sapiens
tctgtctattgtgcatttgccttgatagccgtctgtgccatggctcttgttagtacaatgtcacacatgcacaacctcgtgctcagtgccatcagtttccccgtcaatatccgggcatatcttcaattctgtccaagacgaagcagaacatagactacgtatgtcacttttcatgtgcacgttctttggg

SEQ ID NO: 499483 - DNA, 535 bp, Homo sapiens
  misc_feature (4)..(4): n is a, c, g, or t
cggntcgtgggagaccaggcctgcaggggatggaaccttccagaagtgggtggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccaccccatgttccaccatgaccttttccaggactggtgtcctccc

SEQ ID NO: 499484 - DNA, 404 bp, Homo sapiens
cacagacattcaacctatagttgcacaccatgctgtgttacgtctaggtcgacctagacgtaacacagggagctgtgatcactggagctgtggtcgctgctgtgatgtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccaccccatgttccaccatgaccttttccaggactggtgtcctccc

SEQ ID NO: 499485 - DNA, 653 bp, Homo sapiens
  misc_feature (52)..(52): n is a, c, g, or t
  misc_feature (65)..(65): n is a, c, g, or t
  misc_feature (83)..(83): n is a, c, g, or t
  misc_feature (85)..(85): n is a, c, g, or t
  misc_feature (87)..(87): n is a, c, g, or t
  misc_feature (96)..(96): n is a, c, g, or t
  misc_feature (163)..(163): n is a, c, g, or t
  misc_feature (186)..(186): n is a, c, g, or t
  misc_feature (225)..(226): n is a, c, g, or t
  misc_feature (229)..(229): n is a, c, g, or t
  misc_feature (235)..(236): n is a, c, g, or t
  misc_feature (247)..(248): n is a, c, g, or t
  misc_feature (266)..(266): n is a, c, g, or t
  misc_feature (271)..(272): n is a, c, g, or t
  misc_feature (302)..(302): n is a, c, g, or t
  misc_feature (310)..(310): n is a, c, g, or t
  misc_feature (361)..(361): n is a, c, g, or t
  misc_feature (587)..(587): n is a, c, g, or t
  misc_feature (633)..(633): n is a, c, g, or t
  misc_feature (636)..(636): n is a, c, g, or t
ggccttgcttgaacaaccccttggctttcattgagcattggctttcgaaccntaattgaacaacncccccagatttcatgcangntnattgtccgngcattgattttcggggtggcaaacaaaccccctttgggaacctccccggcacccagcccccctcgcnagaaccgaccctggcccagcctncattccaggggggccagcagtttgcccagcagatgcagnnagncagaanncccagagttgnntagagtcagctcaggagnccagnntccggagttcggacgccccagcgcccacanacgacganccagcaggagtgacgctgcctgctcccggtgtgaccgcgtccttccctggnccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccngaaagctcggtcacttgagtgttttctaggggctggaagggaggtngcngctggtctgtgctcagc

SEQ ID NO: 499486 - DNA, 250 bp, Homo sapiens
gaacaggccggtctccatgacctctagtttctcttgggggctccgcccagtcgccaggctcttctggtcgtgatcctccctcctatggccctgtctctgaaggcgccaggagaaatccaaggagtgggagggtggagtcaggatgaggagtggacactggtcagctgccccttctgctggaagtagaactggaaccgagactgggcatagtccaagtaaccaaagtgctctggcatcccatttcttctgg

SEQ ID NO: 499487 - DNA, 135 bp, Homo sapiens
tcccaagtatgaggaattgaactgtggagctagatcactggctggaggttacggctatgaattgtagattctggacaccatttacatcactgataattcagtccataagaatgaataagccaaagggagcaattt

SEQ ID NO: 499488 - DNA, 365 bp, Homo sapiens
agcactactacgacacgggcgacatctagatcattcaaaggcacatggacgcaggcgttgaacctgtcaagcaccagggatgagatctagtatagggacgagacatctgagatgatggtgcacatgatgatgcaggcgatcaccgtcaggtagcttgatgacgcgaagctatggtgacagctggagcagatgaactatcgataccaatgtcactgtgaacatgatactttcagtcaaggagatgcatgacacaggcatcgatgaactgcacctgaacaggattaacatgtgagaccgtatgcctgaccagcagcccagagtgcctgctgcatgccgtcaccatctatggagactatgaccacccg

SEQ ID NO: 499489 - DNA, 878 bp, Homo sapiens
  misc_feature (26)..(26): n is a, c, g, or t
  misc_feature (44)..(44): n is a, c, g, or t
  misc_feature (57)..(57): n is a, c, g, or t
  misc_feature (62)..(62): n is a, c, g, or t
  misc_feature (80)..(80): n is a, c, g, or t
  misc_feature (105)..(105): n is a, c, g, or t
  misc_feature (108)..(108): n is a, c, g, or t
  misc_feature (130)..(130): n is a, c, g, or t
  misc_feature (133)..(133): n is a, c, g, or t
  misc_feature (137)..(137): n is a, c, g, or t
  misc_feature (140)..(140): n is a, c, g, or t
  misc_feature (148)..(148): n is a, c, g, or t
  misc_feature (179)..(179): n is a, c, g, or t
  misc_feature (188)..(188): n is a, c, g, or t
  misc_feature (191)..(191): n is a, c, g, or t
  misc_feature (213)..(213): n is a, c, g, or t
  misc_feature (244)..(244): n is a, c, g, or t
  misc_feature (247)..(247): n is a, c, g, or t
  misc_feature (275)..(275): n is a, c, g, or t
  misc_feature (281)..(281): n is a, c, g, or t
  misc_feature (283)..(283): n is a, c, g, or t
  misc_feature (310)..(310): n is a, c, g, or t
  misc_feature (327)..(327): n is a, c, g, or t
  misc_feature (345)..(345): n is a, c, g, or t
  misc_feature (350)..(350): n is a, c, g, or t
  misc_feature (362)..(362): n is a, c, g, or t
  misc_feature (382)..(382): n is a, c, g, or t
  misc_feature (385)..(385): n is a, c, g, or t
  misc_feature (415)..(415): n is a, c, g, or t
  misc_feature (429)..(429): n is a, c, g, or t
  misc_feature (441)..(441): n is a, c, g, or t
  misc_feature (486)..(486): n is a, c, g, or t
  misc_feature (501)..(501): n is a, c, g, or t
  misc_feature (513)..(513): n is a, c, g, or t
  misc_feature (533)..(533): n is a, c, g, or t
  misc_feature (553)..(553): n is a, c, g, or t
  misc_feature (568)..(568): n is a, c, g, or t
  misc_feature (571)..(571): n is a, c, g, or t
  misc_feature (584)..(584): n is a, c, g, or t
  misc_feature (636)..(636): n is a, c, g, or t
  misc_feature (642)..(642): n is a, c, g, or t
  misc_feature (665)..(665): n is a, c, g, or t
  misc_feature (678)..(678): n is a, c, g, or t
  misc_feature (685)..(685): n is a, c, g, or t
  misc_feature (722)..(722): n is a, c, g, or t
  misc_feature (740)..(740): n is a, c, g, or t
  misc_feature (763)..(763): n is a, c, g, or t
  misc_feature (774)..(774): n is a, c, g, or t
  misc_feature (798)..(798): n is a, c, g, or t
  misc_feature (810)..(810): n is a, c, g, or t
  misc_feature (850)..(850): n is a, c, g, or t
tgtcttgaaacaacaaaatttattcncttgcagttttgggggcnagaagtctgaaancaggnttttggcagggccaaccntcttcggaaggcactttggaataanccntctttgccttttcttagcttcngcnggcnccnggcattcngcggcgtttcttggcttccagttgcatcacnccaatcccngcntctatctccaaatggccttctnccccctgtgcacatttatctatgtgtccccntcnaagggcgccaaccattcgatttagggcncattcnanaccagtatgaccccatcttaaccaatnacatctgcaaaaacccnatttccaagtaagtaaanatcgngagggtctaggnggacgtgaattttggggganccngtccaaccccccccaatcccacaccttaanagtctttgtatatncttttgtacacnctgaattttttagtatgtgcatttattactttttcaagtaaaaanaaaggagaaaacaanacccccggagtnctgtggcactaaaaaaaaanattctttctgtccagtttcncccttggagggcacnacnatttagtctcccnaagccgggcttccaagtcctgcccttctccaaacttttaccaaactgaaganaaagtnatttttcaaaatgatctcaaganctgtcaatgaggnttaagcntaagcgccacagttagcctaaaatggcttttcatganctggtctccactaccccnctttcagtttcatctttcaatanaatcccctgcnccctacctgttccgccctggactnctcgcgggtttntgaactgcccaggccatttcatcccgccctattccggggntgcactttgctttagcgctgcttcttgc

SEQ ID NO: 499490 - DNA, 105 bp, Homo sapiens
ctctagccgatgcttattacacatgcacacacagcacacaagacggttgtacacacacgcacacacatgcatccccgcagctacacacacacaacacacagcaca

SEQ ID NO: 499491 - DNA, 443 bp, Homo sapiens
tattacgcgggcagtaagtataaacctcggaaacgaatcatatgtgtccagcgtttgtctccatgggggccgaaaaccgccggggatgcagttatctactcgcacaggagaattgaataagcgaactgtgttgcatccatacaagggacctgctgacacatgcagcaactgtggatcaaggtcaataacattaagttgagcaaagtaggccagacataaaacaggtcatgccgcacgattccacttcaatgaagttcaagaacaggcaaaactaccatgacagaagtcaagagagtggtgtcctctgggtgctgaagggcggggaaaagggactgggaaccttagtgggtgaggacagtgttctatatcttgatatgagtgttggtcaccaagccatacacttcatatttgtgtatcgtaaactatctcagtaaaggactgtc

SEQ ID NO: 499492 - DNA, 100 bp, Homo sapiens
ctagaggatcccgttcactttcaaccctgacccctctccttcataaagttattcagcttcctacactattaaagtttaccacaaccaccacccccaccac

SEQ ID NO: 499493 - DNA, 160 bp, Homo sapiens
ttccaagcatacatgcgcatatggccagcaggccacaggtttctatccctcagcaacccatgctctgtagtgcaatcggtggcacagggcacagtgccaccattcattcacagcaccttgtatccaatccagcatgcactgtttctgcatgcccaatgca

SEQ ID NO: 499494 - DNA, 300 bp, Homo sapiens
tacgagggggcacactgagctggatgacgcattctacaccattcccatcatgtacaaaatcatcagagctcgaaggagcattccacccacatatgaagagcacctcaatgctggcggtctcatgactcaggaggaggtgtctgacactgaatcctcctactaagccaagttgattgatcacgtatgtaacatggtccactacaggccccctgccctgaacctgcaggcccactggtagggcctggttcatccagaagcgcaaatcaccacctggagtacaggtgtgcccctcgacctcct

SEQ ID NO: 499495 - DNA, 967 bp, Homo sapiens
  misc_feature (967)..(967): n is a, c, g, or t
tgagtccggtcgctgcggggatccctggacgtgactgtggtaaactcggaaatgagctcacatcttcctgtgtgacacctgttagtcaactggatgggtctgcattgcgcgctgccgcttggcgaccgttccctcttgatgccggaggtctttgttgtgtagcttcgtcttgctttccctgtcatttctcctcaaatcgtatggccgcatggatttgcgaggtcccgggcttgaggaagtagtccagtgtcctatgtgatcacgcttcgttcgtcgttcctccatgggtctctcctttggtgcttgttggtcattcgatgcccgtgctgctcacattctgggaagctccatggatgatgctgacggccaatggtgaaccgtccagaacatagtccccgtgggccatggaagcgacttccaccatgaagtcttatatcccgtgcccgggaggaatctctagtcctggctggttttccattggttgcttgtctggttcctgcttagacggcctgttggatgctcatttcgcaggcaggccacgcatgctgggcgtctatggaatgctttaataaagctgggcggccagagtgttagtgtaggcggcaagaagtacatgggaggacaatggcctgctcaagaagggcgctgtgtagacgcggcaaggtgcggtgtcgggaatgcgtagtgatgttggacgcataaaactggacctgaggtgacctgcgacctatgggcgagcggccggacttagcgaggcaggtaactgcaacctgtctggcatgctaacgtggggtcaccagggaaaacgggcggagagacagcggcacagtggcaattcctgggggcagaagaaaagggcccccctcacagttccgaggcggtaaaacgcgccccgagtgggcttccacacaaggcgtccccaaagagacaactgccggctcgtgctgttttttcggctgactaggcn

SEQ ID NO: 499496 - DNA, 934 bp, Homo sapiens
  misc_feature (924)..(924): n is a, c, g, or t
ggcgcgtgctgcgcgcgcgctgttgagccggcgtccgtgacctgtagctgagcagcgcttcccggccggtgtgccctcggatttggacctgtgtgaatgaaaaggcgcgcaactgcggaggccgatttgcgcgcgtcccgccaccttgacccggtgggggttgctcgggccgctgagggcagttgcggccgccccgggtggtgggggcttcggtgcgccgcgcaaccggccggttcggttgcgcctggtggacccctttcgaggtgcgcacccggcttgtggctggaacaaccggcgtctaactggaggcccgtgggtcagcctggggaacggcctccgggtggcggcgcgtggacactcccgaaacaccttggtgggaccttaaccaagaaccgtggggaagcaatctgtgcaagcgaggtgtggagcccctttgaagttgcccgttggatcggcagccgggattctcataaaaggagagccaaaagccagtggctccgaagggaagagtggctcagggatcgtcacaaggcaccaaggtgaacggcacaacttaaaccgtgtggcctgacaacacatcgtgggctggggcgctgcccaagagtggcaggtctacggcaaaatttgtaccggtggagaatagctcatgaacaggttggcaaactgttccaccatggtgccgcaaattataggaataccttggggtgggccacgcaagcaaagagggatgagttggcactgacacacttcgccatgggggagggcagaaggttctggaataaacacatggctagagacgagtcgataaaggacaacagtccgaaaatggtagctagacagcgcagaaccatgtatggtcacagcgttgacgtataatgctctctgcctgccgtctctctcgtcgttcttccctctgatcgacgncaaacaaaag

SEQ ID NO: 499497 - DNA, 426 bp, Homo sapiens
  misc_feature (330)..(330): n is a, c, g, or t
tacttttattcttttatttttgagatggagtttcactgtcacccaggctggagtgcaatggagcgatcttggctcactgcaacctccacctcccaggctcaagcaattctcctgcctcagcctcctgagtagctgggatcacaagcgcctggcaccacgcccagctaatttttgtagctttagtaaagacggggtttcaccatgttggccaggctggtctcaaactcctcacctcaggtgatccacctgcctcggcttcccaaagtactgggattacaggcgtgacaacttgcgcccggccttaacatagggattttcatcctaggaatngacttttccccaaaaagattcaatcttagggcctcttgctgtagggcaagttccatggggatttcacaaaagagggcaggggaaacagttcccctg

SEQ ID NO: 499498 - DNA, 383 bp, Homo sapiens
tactaaattcgcggccgcgtcgacagacagatagacagacagacagacagacagacagaagcattcactgtgctacagagctggatcctcagccaagaatcctagaatttttacagtaattctcctccatggctgcattgttttacagctaagaaaacctgcgcttagtaatattaagtgattgtttttcaaagctgtcaagtagatgtttaaagttcagaagctgagtgagttctttcttgctctcattttttgttgttgttgttgtcttccccacccaccctgctctataagatcttaaggagccactgcaatgttccctgggagccacatagatctggctgcatagcaagcacatcaagtgaaaaaggtcgacgcggccg

SEQ ID NO: 499499 - DNA, 162 bp, Homo sapiens
agccctttttcatgggcacaccctgttctataattagggaggtcccttcttgaggtaagtcatgcgacttgaagactcttagtgaacttcgtgagaggaaacccaattccgactagtttaagcaggaattttttaaaaaatgagaattctttagttcactta

SEQ ID NO: 499500 - DNA, 326 bp, Homo sapiens
  misc_feature (243)..(243): n is a, c, g, or t
atgattctacttatataatgttctggaaaatgcaaaactatggggatagaaaacagacaaatagttgccagaaattggtagtggtaggtagatcgacttgacaggggaacaagggaattttcttgggggcgataggactattttctgtgtcttcattgtgacagtagttataaaactgtatgcatttgtcaaaaccaccctgacactaaatggacatttttttatgtaattaactcaaaaagnctggttttaaaaaatcaaaataaaattctttctaaattaaaaagtaatcccatttttaataaaagcagagctttcctattgaa

SEQ ID NO: 499501 - DNA, 502 bp, Homo sapiens
ttagccaaaggtcatgatatcaccgtcacttactgtgggacgaggcctgctgcttcccactcatgaggttaccttctgcatggggggagtgccagtccggtataacatatactgccttctctccgcaagtccccctggggagaaggtgaggcttctctaagtggggaggacggagcgaggaatggtatgcctcagtcatctcttttccctttcttcccatctttacgaatgaggctctacgtcctcaatcccgtggagttgtatagtccaagaccctcacataaggacggctaacaggaggtcaaaagctacctgtaacctgggtgggaacgtctgactcattctagacgttacgtcttgaaacaattgtgccaaatttaaatctaaaccacatttgccaaaagcagttggatcagaattaacactgatgtatttgcatcatctgccacttctttgctcacgtttcctcaaactcccaaatccagaagcatgacagtaccag

SEQ ID NO: 499502 - DNA, 573 bp, Homo sapiens
  misc_feature (177)..(177): n is a, c, g, or t
  misc_feature (319)..(319): n is a, c, g, or t
ggtgcgagcgtggacctgggacgggtctgggcggctctcggtggtggcacgggttcgcacacccattcaagcggaggacgcacttgtcttagcagttctcgctgaccgcgctagctgcggcttctacgctcggcactctgagttcatcagcaaacgccctggcgtctgtcctcaccnatgcctaggccctttgggaccgcttctcgtcgtcgtccacctcctcttcgccctcgtccttgccccgaaaacattcccccaagccccagatcggcgccgcgctcagcctgggggtcggcgaccgggaggaggggtttgaccngtccacgaagcctttgggggaaagaaaggcttcgggacatgcgagtccctggacagcagacaacagtggcttcgggccggaggaagacacggtattacctggggcaacttggggggggttgattccgttgccgaacttcgagctgctcagtgaccctgagggatgaacccactttgtgtgcccaactgattgccaggttgggccttgggccacacgggaagaaaggccttgggcaccaagggcagaccgggttg

SEQ ID NO: 499503 - DNA, 258 bp, Homo sapiens
taacgcaatacagattgttaccccactgagtcaagggcagggaccgaacccacaacctcatggttctagtcggattcgttaaccactgcgccacgacgggaactccaggcttaggtctttctgatctgatccctgggccaggagcaccatatgctgcagggcagccagaaatgactccccccccccaaaaaaaagtatgtcgcaggacacccatcctcggctaacacacgagaagcacactttgttccaactttaacg

SEQ ID NO: 499504 - DNA, 177 bp, Homo sapiens
  misc_feature (75)..(75): n is a, c, g, or t
  misc_feature (165)..(166): n is a, c, g, or t
  misc_feature (170)..(170): n is a, c, g, or t
gcctcgattgccccaccccaatcctaggccaagacattttaaccaaattcaaagcttctatcatgttttcctgtncccctcaaccagagtccctcctgctcctctctgctagtctggcccctgaaccccactccccagcacccgctacccgcctccctcattaanncagnagtagtg

SEQ ID NO: 499505 - DNA, 404 bp, Homo sapiens
  misc_feature (10)..(10): n is a, c, g, or t
  misc_feature (68)..(68): n is a, c, g, or t
  misc_feature (205)..(205): n is a, c, g, or t
  misc_feature (321)..(321): n is a, c, g, or t
  misc_feature (328)..(328): n is a, c, g, or t
  misc_feature (357)..(357): n is a, c, g, or t
  misc_feature (384)..(384): n is a, c, g, or t
  misc_feature (393)..(393): n is a, c, g, or t
attcactatnacatcttgattttgcccgtaggaatgtgaatctccctcaagtaaagaatccctggggncctggaagatggatgtcttacttcgttttctgacttcctcagtctctgtcagataatcagtgctatgtaaatgttaagtaaatgactttatttatttatttatgacacaaccttattctcacccagggctgggagtncagtggtgcagtctcggctcactgcagcctcagcctcccaggtcaagtgatcttcccacttcagcctgctgaatagctggggactacgggcatgttccatcacattcggctaactntttttcntctttttgtagagatgagggcttcctacngtgcccgggctgtttaaaactctgggntaagcaatngtccactcgtc

SEQ ID NO: 499506 - DNA, 522 bp, Homo sapiens
  misc_feature (197)..(197): n is a, c, g, or t
ggtctctgttgcttacgccgggggccggcgcggcgttggccgcccccggcctcgccgagtgcagcgcgcccgaaggccagtgcctgcgctccgtccgcggcccggcgcccagggtgggcggggaggccgccgcgcaagtcgccgcacgctacaccgccggcgccgtcgtttcgcgtcccgcttccggccaccgcggncgtcattttgttcgcgcggaagcgccgcggtagggtgggaacccaagcgggagagccgcgggatttgcgggcgccgccatgccgtcgtccccgctgtgggtggcggtggtgtgcttcagcaaccataaccggagcatggaggcgcacaacattctgagcaaacggtgattcagcgtccgatccttggaacagggactcacgtgtagtttccaagacacgttctcgacaggccaatgtttatgatttcccacatattgacagaattacaatgatcttctttaggaaggcgaaccctttacacagtggtatttttactattgttgtc

SEQ ID NO: 499507 - DNA, 158 bp, Homo sapiens
atactgtggtgtaccgtcaccaccacttccaaaatcatagacacacatgcacacataagacacttcccacaaaagcagtcctcaacacataaaccacacacctatggacaaacacctcagctacaaatccctgtaaacatgcacagacacattcccac

SEQ ID NO: 499508 - DNA, 267 bp, Homo sapiens
cctgagtgcagccactgcctttgtgtggtagttctcaatttgaattggacctgacattcctgggtacctaggcaatgacacacagcagtaggtagggatcaacactagaatagagctgttgttacgtttaccccaatattactaattgcccaaagtgtcagtccgatgtagttctcttcatgcaagtatagattcaattgctagttatctttgagtgagcctcctcgctatagtaacatcaaattgaagcaggctttctgcacctca

SEQ ID NO: 499509 - DNA, 297 bp, Homo sapiens
  misc_feature (13)..(13): n is a, c, g, or t
ccccccccccgtnttttttttgggggcgcggggggttatcttttccccaccggggggcctggctttttttggccccttggttaacctcttttggggggcccctttggggttggccccccgtttccccgcccggtttttcggggtggcccccgccttgcccgggtttttgggtttttttgcagtgcccgcctctttttggcccaaagggccctttttccctttttcctcccctccacattcactttctaactctttcttcttcttacccattttccccccttccccccctcttcaata

SEQ ID NO: 499510 - DNA, 112 bp, Homo sapiens
ggtagtaatataactgtagggacgatgagtttagcgatgggagtaggtataggttatgtacgtagtctaggccatatgtgtggagatcgagactagtagggctaggctacgt

SEQ ID NO: 499511 - DNA, 278 bp, Homo sapiens
cggatcttcgctatgatctagtgtgtgctatccgcaggaaccgcgagatggtctagagtcagcttacatccctgagcaggaaagtttacccatgaagatgggtgggatattatgtttgtttgtttggtttggatagttgtaagttgtgtgtgtttatgccactaatattagtattcattctggatggctagataaaagctgacagttactttattgtttgtcttttaatgcttcattcaagtattgaccctttgtagttgagcgtggggtaggacggt

SEQ ID NO: 499512 - DNA, 776 bp, Homo sapiens
ggcatacgaggtcattgaatcatgtgacggtggctggatcgaggaacctgtctttaatagctgtcccctgaaagtgactacgcggagtatacccagggtgcccattaatccccagtgcgtgaagattgatcctgcgaaataccgcggggtcgcatcatggcggggttgaccctaaaggcgagttctcgtatcagagacagttacctactgttgtggaaagggctccaagtgccattgtcgtgtcggatagagatggggctgacctgtgtgattaaagtgggaatatgacaatgctccatgagcatgctttgagactggtttacttattgcatctttttctccctttggaaaaagaaggcattgggtagagctataaagtaagtgagcttttgctcagtaaaataaatacgtattcagtgctgttttaactaattaatgaatctgacccagggtggattacaaattttgatatccgtttagcctttatggttggtgaagtatgtccataagactaagaagataaggtggtcgaaatgatcccggagacctaataagtggttccagcccttgacgaaaatcagctgcaccttgtggcccctattggtttccgcctagaaccttgagaacacagtttgtgtactgattctctctaacttcgtggaacgaggtgcgtgttctagttgtgataccctgaaatctttcatttataaacagataccacctttcttacatccacgcaatacctaaaagagctacaagtactaactttaatccgg

SEQ ID NO: 499513 - DNA, 372 bp, Homo sapiens
ctttttggcccttcagacacgattaccacacggggcccttttatgacagccaagataacaacattgtgcgaatttgctgtgtgggcttcccaagtggtgagacacaatctcctccgccaggggtctaccccccacccatatgatactctccccgaaggacaccgagggaggccaaaacagatgtgttgcacgaccacagattttgccatgggtcccccgcattaagaaaaaacccttctgggaataaatttttaacaaggaattttttaattgttaaaaaaattttaaaaattttggggcccaacaacctttttaaaataaaattggggaaaaaatcagcattttttccaaaaaactttttgttaaaaccca

SEQ ID NO: 499514 - DNA, 530 bp, Homo sapiens
gatctagaggctccccccgtgtctagccagtgctgtcggcaggtggcttaggcgtgggtggagagaagcagctactcctatggcagtggtcttggcagtaggaggtggcttcagtcccatgcagtggcagagccatggggggtggcctcagctctgtgggaggcggcagtaccaccatcaagtacaccaccacctcctcctccagcaggaagagctataagcactaaagtgcgtactgaaagctctcggtcccacagtcctcaggcccctctctggctgcagagccctctcctcaggctgcctttcctctcctggcctccagtctcccgtgctgtcccaggtagagctgggtatggatgctaagtgccctcatttcttctctctctctctataccatctgagcacccatggctcaccatcagatcaccctctgatatcacatcaggatgtactcaccaggggagctacactgtaactaaattataaattgcttgcctccagtgttctatctctgaggctgagcattataa

SEQ ID NO: 499515 - DNA, 202 bp, Homo sapiens
tgatgcgcccaatgagtgcatcagtttatcaagctcgacagtgagtataggcccactcatcctattggttgtttcatcgtcgataataagtcaggcaaacagttgacattgtatcatatactagagcagttgtcctcattagccctaactgaaacagatttcgaaacaccgctagattctgttcagctgctaagtatctgta

SEQ ID NO: 499516 - DNA, 139 bp, Homo sapiens
aatcctcacaaacactatcataaaacttaccaactataaagcatcatgtgaaccagcacaacaggaagtacacagcgagaggcagggctgctccaaaccccattcccatcaggttcacttgtgcggcggatggtgctct

SEQ ID NO: 499517 - DNA, 941 bp, Homo sapiens
gaggctgaggcggcggcggcggcgctgcggcgggttcggtgggaccaatcccggggcggtgcggctgtatcgggcgcgggcgccccgcttttcctgcaccctgctccggtgcctccgattacgtgcgatgccttgatgcgctgtgctgtgttgtggcccacgctgccagctggccacgggatgacggttgaagctgcgcctcatgcacgtgccttgcctgccgtcggtccctccgcgtggcccggcttctgtccccccctgcctggagccgtggccaacaagtggccggcccagtgttgctttgttggtggacccttgcgccgacgctttcttcctgttcgcgccagcccgcccgggggcgcccccggatcaccgaagcacatgacttgcgcgagaatccctgacgatgatgcacgcatccaggcagaacacgacagggctccgaaccacgggacaaccccaagacggcgtgcaagacagggacataaccttttccgtcaatttaaagacataggaccccgggctgccattatacacttatgttgcatgagccaccctccctttcgaaattacttcaatccgaacgtgggcgactaactgtccgtcccggaggccccagcaggacttgacccccttactgacaggtgtgttcataatctacgcgacgcactttaattctgtcaccccgaagacatccccgtttcacagacgtcccagttactcgtattgtgactcaaccccaaccgggccaggcatcaagtgccacaccagggagggttgattatcgctatcacggattaccaaccgggaactcagtggaacccctggccgtggtctggtctccacccatactctgatctgggtccgtagcctaccgtgtgtaaacggcccccacgtggcggtaatgcgagcggccttacgcacgccagtggggaaactaa

SEQ ID NO: 499518 - DNA, 444 bp, Homo sapiens
  misc_feature (46)..(46): n is a, c, g, or t
  misc_feature (75)..(75): n is a, c, g, or t
  misc_feature (97)..(97): n is a, c, g, or t
  misc_feature (135)..(136): n is a, c, g, or t
  misc_feature (143)..(145): n is a, c, g, or t
  misc_feature (148)..(148): n is a, c, g, or t
  misc_feature (339)..(339): n is a, c, g, or t
  misc_feature (364)..(364): n is a, c, g, or t
  misc_feature (399)..(399): n is a, c, g, or t
  misc_feature (430)..(430): n is a, c, g, or t
  misc_feature (435)..(435): n is a, c, g, or t
ttcgcactgctgcaggcccagctgcggggcacggacgcggcccgcncatgcaggacctcgcggctgggccgtggntccctgtgccgccgcgctgagnactttagagacgccttcacccaggagctacgcgcggcnnccgagcnnncgnggccaccaccaggtagccagaggggccctggcgcaaacatttaatcctggccgaggcgcttgcttttccttccgggctctacagtggcatcaatgtggaggggtcattccgggcactgcgcgcggcttcgaatcccgactgggattgttggcctgcagacatcccacgcataagagcctaggccagaccgnccgctccgttgaagtcttgtgattngacaagacacagtgttggagacagccctaagcctnacagagatgaaggtaggcttggtccagacanggcanctacggaga

SEQ ID NO: 499519 - DNA, 983 bp, Homo sapiens
  misc_feature (807)..(807): n is a, c, g, or t
ctagattgccagatctgtgagagttaacaatgtgtagactacttgtattcgttaagctcgtgatgcgatatatgtaggcatgctgtgtaaagtgtctgtatagctctttaattcagtcacgtattaagtacagaattatcatgtgcgtttctcgagtacttttgagtacaatgtaaatcgatgaagctggtcgatgtttatagactgttggtgagtcccttgggcttagtgtactgtaaagttgttattcctgtgttgtgttctaggaaatcgagatgagcggtgaagtcataaaggtcattcggggagtatcggacgtagatatattgaagaaagtgtcttatttgctcgagaagcatacgtgacactgcgtaggacggttgaaaattaataatcaggggtactattgcagaataagtagtagagatggatggcaaatgttaagggatccaaagtaaatgtctctcgaagtgcgtataaaggtggcggccgttaatgagatgtataaaaatatcctagaaaagatatctagagagattgtagtaagagaactagcaatatattgacattctgtgtacttgggaaacaactaagaagcgggtggagaagcataatattatgctcggaaggaaattcaagatagtagttaagagccttttgcaagttactgtaatgagccggttcgatagttgagtgaacgtttattaagaataggcggatgtaaaaacccgcagtgcaaaaggcctggagagcatgctaacttccatgagtgctgaggggtcaacgcaaaatgtccggcgaaacaantgaccgattacataatgtaacaatgccctgactaaagtggcaacggttgacagttgaacatatcctcaaggtgcccaaaaaagagacccctgttgccttgccagcgagaaggcaaaacctttccaaggggcatctggcatcaagacggacccatgggggaacacactcctcttgga

SEQ ID NO: 499520 - DNA, 857 bp, Homo sapiens
cggcacctggctgtgcagtacactggtgccccctgaactggctgtcaccgctgtagggtgttttgtggcaatggtgcttcaagaatgctgatccactgtgcgcaaccacctgcggacacacactgtggtgagatgtgcccttccagttgccactcatgtgtgcaatgacctttgctatctttggccaacctcagcctgccaccatgctgacccatacgggtgcactgtccctaccaatgcctggactgtgtgcaatgctgcttcacacatgatgctccaacctgcatgcatgcacctggcgtgtttgcactatgcgggcccatgtcagccatttgccctgatgaccccccagacactcccctatcactgagtctcttacaacgaacgatgtcccatacctacattgctggtgactatgtggcctgcatggatacctgaagccataggcgaggctttgcagaattgcattacagcctggagtccatatgccccgagacattcggacatattgaagcggctcacatgccttcgccgatgagtcacacaatctacctgaccaccacacccaccaatcttcacatgaagacttacaacaggagtactcaatgatgccacagtaagtcatggtatgtgtaagaactatctgcccattcaacatgtgaacacactcccccagtccatctatgtgcgccaatgtagttgaccaccccttgcgatgacttgttgcctatgttcttgccaccttgtgctggcccacagcgtcacagcaaggcgcgggatccatgtcagtactggtacaccgagcgttacgagttgacgcacagcttgaatacactcacttaactaacaactgtgtt

SEQ ID NO: 499521 - DNA, 109 bp, Homo sapiens
gcacgctgtacctcctacatggggcagactccaggaaccccagtggaccccggaaggaaaacagcccataggaggacagaagagatagaggggcacatgacccctggac

SEQ ID NO: 499522 - DNA, 353 bp, Homo sapiens
aaaaggttcatggaacctttttatgttctttcttgtgcagtcaaaaccaattgcaggctggatgcagtagctcacacttgtaatcccagcactttgggaggatgagatgggcagatcacttgagctcaggagtttgagaccatcctgggcaacatagtgaaactctctcactaccaaagtgcaaaaggaattagctgggcatgatggtacacacttgtggtcccagctacttgggggactgagatgggaaaattgcttgagcccgggagtcaaaggttgcagtaagccaagattgcaccactgcactccagcctgggtgacaaagtgagaccctgtctcaaaaaaaaaacaaa

SEQ ID NO: 499523 - DNA, 290 bp, Homo sapiens
ctagcggcattaagtgaacggcttccaacctacaccacagccatagcaactcgggatctgagctgtgacttacaccacaacaccacagctcatggcaacgccagatccttaactcactgggggagggcagggatcccatctgcatcttcatggacattaattgtgttcctgactgtggagctacaacaggcactccttgttttgtactttacataaatgcgatcgcacaatacataaaacagctttttactgaattctcagagagatccgttcacttaatgccgctagcg

SEQ ID NO: 499524 - DNA, 151 bp, Homo sapiens
tttggactctgaggcaggtgtgattgaggatgcaatgagctgtgattgtgccaccacactccagacttatagagaacttgcccaccaacataaccaatttatgaaagtccacttcattcaaaaggtataagaacctcctgttggggggctt

SEQ ID NO: 499525 - DNA, 412 bp, Homo sapiens
  misc_feature (220)..(221): n is a, c, g, or t
  misc_feature (223)..(223): n is a, c, g, or t
  misc_feature (325)..(325): n is a, c, g, or t
  misc_feature (329)..(330): n is a, c, g, or t
  misc_feature (335)..(335): n is a, c, g, or t
  misc_feature (339)..(339): n is a, c, g, or t
ctccatctttctctctctctcccgggctctatttcctccctccccatctctttctctgtgtctgtctctgtatctctctccctttctccctccctctctttatctctctctctctctctgcctctatctcccactgtccaaatctgtgtctctgtctctccctctttcattctccctctctttctctatctctctccttgtctatatctccccctctccnngnctctctgtatctctgtatctctctccctttctccttccctctcttcatctttctttttgaaacggagtttttctcttgttgcccaggtggagtcatggcacnatcnnggccnctcntctttattttctttcaaaccacaggtcagagacagaacctcctttcagctactcaatcgagaggagcggtgga

SEQ ID NO: 499526 - DNA, 363 bp, Homo sapiens
cggcacgaggtggaggcctggatgaaggccacgaggccagtgatgggtgggtgggggcctggcccagaatattgctgtgctgccccatctctaaatagagggaccttggccctaggctgaggggaacaggcagtgaggctcaccgagaggaagacagcatggagcggtggcacgaggcaccacacactttgtctaaagagggcattgctcattttctccagctgatggctgtcatggaagaatgtgggcccagtgtcgccacagcttccattttcaagagagaagccgtacatctgggttttatgtgaaaactcctaacttttaagtgttggctcacatttttaaaaaaaaccggcgcggccg

SEQ ID NO: 499527 - DNA, 387 bp, Homo sapiens
agatcgatctgtggaaatggtcactgagatggtgtgtccatgcacaaaagggcacaaagaggggaatacttgtgtgaacgcaatgacaggtgtactagacatctgtacaggtctggtggcagcagtcaggtttatttcatgaccttaggcaggacttctcttctgagctggtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattcttttttttttttctttttttttattggaag

SEQ ID NO: 499528 - DNA, 107 bp, Homo sapiens
tcgatctctcagcaggatccccctcccctgtcagccgaaagcttaccccctactccttgctaatgctgatatagctcgagggcaatgccatattaactatctcccga

SEQ ID NO: 499529 - DNA, 206 bp, Homo sapiens
gagtaactaattactgctatatactggagaagaattgaaatgccaaaaaaatcatctaccattatcagaaccctgcagcgaacattaacttattgttaaataaaccagtttgcaggtgcacaaactacatgagggtcttgtatccacgtaacacaggtggttacacaaaaacatgttatttgtacctgtggttaaagattcatcgt

SEQ ID NO: 499530 - DNA, 320 bp, Homo sapiens
ggggcccctttttccccttttttgggggggggggggggaaaaggggggcccccccccaggttcccctttttaggccccccttttttttaattggggggccttttggtccccccccccccgggggctttcggggggggggcctttaattttgggggggggggggggggggggggtaaattttttcctttttttttccggggggcggaaaaattttttcccctgggcctttccggggggggggggggggggggggttttttgggggggtggggtcccccttttggggggggggggtttttttttttttttttttttttttta

SEQ ID NO: 499531 - DNA, 1056 bp, Homo sapiens
cgcctggcgccggactcctctttctcccggaagcggagcaccgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcatgcaatgtacacaccgtgagtacggtgcttgacgggagctgcttctcagcctttttggcgagcatccatggacatcatgggtaggtgcgtggacaatgcacaccaatggagtccaatgggcatttgctattcgtcaatgttcgccctgcagctcacatggcctgcatgggcccatggaggagatgcatggccatgtgcactcggcccgcaacgacaccgaagccacatcaaggcttttcatgtgctcagtccctgatcatcgtggaagtcacctgagatgcttgaagcatgcacagaacttacaagcaatcttctgtcactgataccaaatgtcctacacagcaagaagatctgcgcggacaaactttaaggtgtatggagatatcgagtattgcagcattattaagaatacagtgactggagaaagtaaaggtctgggctacgtacgatacttaaaaccatcacaagctgcccaagcaatagacaactgtgatcgaagcttcagagcaatcttggctgaacctacacactacagcatctgactcctctgaacagattattatagtaatatgcggcaggaagcctgggcacatgacctagagcccctatgctaccatttgaaccacacttggacttccaagtattggcaggatgatagccagggcccgggacgcagcccccaaagcctgccacgagtctcacaagagcccctccctgcagaacgcgcctacaggcattggaaaagcccacgaacggacactggcggaccccgcgcaccccaccccaatggcgcgagggacgcccggcaagaggcacacagataacc

SEQ ID NO: 499532 - DNA, 161 bp, Homo sapiens
  misc_feature (4)..(4): n is a, c, g, or t
  misc_feature (28)..(28): n is a, c, g, or t
  misc_feature (99)..(99): n is a, c, g, or t
  misc_feature (116)..(116): n is a, c, g, or t
tcanatcattacactgcggctgtataanaaacctggtttggagggatttaaaggacacatggaatagtgaattcatgtccaaagaggcaccgggctttntaaaggaagtattcgtntgaccttttaatgatgggggcatgaaagttggatatttgtaagtt

SEQ ID NO: 499533 - DNA, 651 bp, Homo sapiens
cgcctggcgccggactcctctttctcccggaagcggagcaccgagccggcaaaggcttgggtgtgagacagcagcggtggcagacaccgcagaagcaaagagcagtgaggctcctgcattcgggtggagcaccatggacgaagctggcagctctgcgagcggcgggggcttccgcccgggcgtggacagcctggacgaaccgcccaacagccgcatcttccttgtgatcacaatacacactgatcgtgctgagaggttcgcttgatcagatctgggtgggaacaacagatcagctgtggtcagtcgcccagctcacaggctgagggccatggaggagatgcatggcagtgctcggcccaacgacacagccatcagtgcgggtgccgggtcggggtgcctcgggggaaggatgggcctgtggactcccttcacctgctgctctgcgggtagggaggagtgaacatccgtccgagtgacagaagactgctggggacagggctgttgaggaagtcctccacaactgccgggttgagaagggagatgggatgttgcccagaacgaccgagcggcacggtacgaaagagtgtggtcccttcctgcctctatccatctgatcctgcatcgtctactattgtattttgatctttaatc

SEQ ID NO: 499534 - DNA, 1749 bp, Homo sapiens
  misc_feature (1261)..(1261): n is a, c, g, or t
taatccggttcagtctaatccttttggtgagtccctcataggccaaatcttagggctaggatgatgattaataaaagggatgacataacttattaggtggcgaggttcagtggttgggtagggcctctaggggtgaggggtcaaagagggagggccaattctcttcagacactccaacatcaatcaagaagagggtaatcagctcactaaagacaagaacattttagtggtagaaagagggcaccgcgggcgggggaaataatgagcggctcaacagcccgccactctcgtatagagtggggtggattatttctctatagtgtatagcccgcgtgtgagttgtggtgtgatagactcacaagagtggtacaataacttatatagatagtatagagcggctagggagggggtgtgtggaacttattataaaaattggaggcgtgtcccaagagcgcagagagagtcaaggccaaagcattttgcaccgtagatgcgcgccggtggatcacacctattcatcgagcgctccttgggtgggggtgccccctagtgttgtgtgagacccccctatttccggcgagaattgggtgtccccccgcgaatatatgccgggcccctacatatcgagacccaccaggggctctctcgtgggtgtcttgtgcgctcttctgtggttttgtgtcccgagagagagagcatgtgtggtgctcccgcactgggggtgtcctacggggcgggagcaaagctacgtttgtgggcccagggggcttacgtgtgttgcgggccccctctttggtgcccccctcgggtggcggccaatttctggaaagaaggccccctcgtggcaatgttgggtgccctcgtgtgggcccccgggccaataaacaaaagcacgaggcaggcgagcatacaacagccgggggcaaaaactctccaaggcaaacgcggagggaggaggatccctcaagaggagagaacctccccgggcagccacacatacttgggtgggggacccccggctatggaggacgcgaagagtgagtcccctactggggagatgtggtcaacacccacactattcgagccccccgaggagagacagaatctctagggaacggtggccacaagcaccccgagtggggaccttggtgcggttgtgtcggttggggagaaaactacaccggggacgaacagcgcaccacaggaaaagtagactgcgtggcacaggaacaaccaccgagtaggcgtaaacgaacccccncccggagggggctcacacgggaggaaaaactaaccacaggctgtggccccccccggtggttgtgtgtgaccccccccacacacaaacgaggatgtactcgactcctccgaggtcccccgtgagaaggtggcacaccggacctggtaggtggagcgcacccacgtgcgcccacgagtgatcgcccaagcgaggccccaagagaaggatataccaatccacagaacacctaagactacgggggccccattgggtggcgcaccaaaagcgtgacaaccccaggataagagcggccccgataatgacgctgcaggagcaggccaccacagtcaccaccagtcaggtgctcccgccccgcgtagagttaagtaaacacaaacgttggtcgagcaagacgacgagcacaagcaacaaaacaaacacgcatcgttgtgtcagtagtatcgcaggtcgcttagcagcaaagtacagatacatcgaaacacacaggc

SEQ ID NO: 499535 - DNA, 141 bp, Homo sapiens
gtttttttaaaaaccccggggggggcccccccccccctttttttttttaaaaggggccccaaagcccccatttccttttccctttaaaaaaaaattaaactttccccgggggggggggccaaaaaaagttttttttcctta

SEQ ID NO: 499536 - DNA, 113 bp, Homo sapiens
atgaaaatggacatcccaccattcggacgtacccagatactgacctcgtcagtccctatccccttcaccgctccccacagctttgcacccctttcctccccatagcgatatag

SEQ ID NO: 499537 - DNA, 233 bp, Homo sapiens
cctagtttagaagtttcactagcagaaggtataggcgatagaaattgaaacctggcgcaatagatattgtaccgcaagggacaagatgaaaaattataaccaagcataatatagcctagttttagaagtttcaatagcacctagttttagaagtttccccaggcagcaatgcacatgctatgaccctacacatttacttagttttccctgctattgaaacttctaaaactagg

SEQ ID NO: 499538 - DNA, 183 bp, Homo sapiens
ttgttcttctttactcgatttcgcactcttgacattttctacaatgaatgtatattaataaacacagcgattattaccaattaaattaaaactttcaggttaaacagatagtacaggatcttgttctgccacccaggctggagtgcagtggcactatcacagctcaatgccaccttgacctcc

SEQ ID NO: 499539 - DNA, 442 bp, Homo sapiens
  misc_feature (46)..(46): n is a, c, g, or t
  misc_feature (77)..(77): n is a, c, g, or t
ccttttattattatgaggggactttcctataacccttggtaatgtncctttggatctgtagccctactttgtctganatagcccactcccaacttcccctttgattaacatcagcaaggtaccctcttttttcctagcctttgtcttttaaaaaaaaaaaaaggcccggtgcggtggctcacacctgtaatcccagcgctttgggaggccaaggcggatggatcacgaggtcaggagttcgagaccagcctgaccaacatggtgaaaccctgtctctactaaaaatacaaaaattagccaggcatggtggcgggtgcctgtaatcccagctacttgggaggctgaggcagagaattgcttgaacttgggaggcagaagttgcagtgagccaagattgcgccactgtactccagtgtgggcgacagagtcgagactctgtctc

SEQ ID NO: 499540 - DNA, 200 bp, Homo sapiens
  misc_feature (190)..(190): n is a, c, g, or t
agtcgcctccaatcagtatgtagtctagaccagatctgcagattggagagagagggtgccctgggtcaaattcgtctgtgatctcctcacctctcccagtgcatgataccaattctttcccttcattcccccaacatcctgttgctctaactggagcacattcacttactaacaccaggaaaccacaggngccttgtcgt

SEQ ID NO: 499541 - DNA, 186 bp, Homo sapiens
ccaacaccatttattaaatagggaatcctttccccatttcttgttttagtcaggtttgtcaaagatcagatggttgtagatgtatggtgttatttctgaggcctctgttctgttccattggtctatatatctattttggtaccataccaataccacaccatcaagtaatgtgattactcctaagcc

SEQ ID NO: 499542 - DNA, 272 bp, Homo sapiens
gggggccccctttggggttaaggggaaattttgggggggggggcacccccggcctttggggtttccccttgggggggtttttggtttttttccgggggggaaaaaaaggacctgggggttttggatcccccccccaacccccgggggtcccccccccccgggttttgcccccccacccagaagggggggggggggggccttggccccggggggcctgttttgtaaaaatccgggggttcccccttttataataaagcgggccttggaaccca

SEQ ID NO: 499543 - DNA, 127 bp, Homo sapiens
ggacgccaaaaagcaaaaataacggtaagggcgcccataaaaacctatactaggaagtaaagggcgggcaacagagaagcaggaggacgggaataatagtagtacaagatagtaggcatagaggagc

SEQ ID NO: 499544 - DNA, 158 bp, Homo sapiens
cgactctgaggatccctcagacagcggaccccccaggacagttggcgacaggacagcatgcgacctataacgggaagccctgaagaaaaagtttacgcgactccatgatgcggagcttcctccgatgaagacggctatgacgggggccggctgtctga

SEQ ID NO: 499545 - DNA, 225 bp, Homo sapiens
caggatccccgatttccactgctgataagacataccttcagactgggcaatttactaaaagaaagatttaattggactcacagttccacactgctgcgggatgtctcacaatcagtgcgtcacggccaggacggagcaagtcacatcttacgctccatcgtggcagtccaagggagctctgggcaggtcactctctatttttataaccatcacgactctcttcag

SEQ ID NO: 499546 - DNA, 146 bp, Homo sapiens
gtgttcacagaatgagattagtaaggaagccagtttatacaaatctgtgttcttgctagccataagaacacatcaaatattccatgaagatttcaagctttctttagacatatgctatttttagcactcgtgctcggtgccgggga

SEQ ID NO: 499547 - DNA, 116 bp, Homo sapiens
tttggggacttcagccttccttccagtctgggatgagtggggggtccagactacctgatgccccttccccaatttggagactttttgataatataaatataaatgtatattttgca

SEQ ID NO: 499548 - DNA, 329 bp, Homo sapiens
tgtatgatctcagcagagtaattagcatactcatcacctcaaacatttattattggtgttaataatattcaaaaatgttcttttttagcttttggaaaatacataataagtatatttaaccatattcatcctacatggctgaagaacaccagaactcattcctcctatctagctataatttcatattcattaaccaacctctccccatgctccccacccctttccatatgatccagcagtccttctactgggtatttatccaaggaaaaagaaatcagtatatcaaagagttgcctgcaccaccatgttcattgcaacacggtctctca

SEQ ID NO: 499549 - DNA, 106 bp, Homo sapiens
tgtacttttatttatttactatttgcagttttttccataatatttaagtttttcgatgtttgaaattgatcagggaccatgaaaagaaacttgtgcttcaccgaag

SEQ ID NO: 499550 - DNA, 101 bp, Homo sapiens
tcccggagcaggttgttgcagtccctcagctaagcagcttcttatgtctgctctcggggctgtggagacgcagtcggcgcctcttgttaactctgtgtgct

SEQ ID NO: 499551 - DNA, 242 bp, Homo sapiens
  misc_feature (124)..(124): n is a, c, g, or t
cctcttcatgagaacgcagtcctggccttggcccagatagagaactcagccgcagtggaaaaggctattgcccactatgaacagcagatgggccagaatggtgcagccgcccacggtaaacccntccaggagctgcttggaccgtgcacagggcacagtgcagagacgaggccattgaacgtcttctatgaacgaacctctttcaagtgatgtgcgaccaacatgttccagtaggcaaatta

SEQ ID NO: 499552 - DNA, 508 bp, Homo sapiens
ggctgaaaaggggggaaaatccttatggattttagggattggactgtggtcagttgggttgtattgcacacctaaatcctgatcataggcttttcatttatccggagagcctttattttgccagttaacccaaatgtgtttttcagaaaggtagacattttctactactttctttcctttctttcctgcctttttcccgtctgaccccaaacgttattgtccaaacatgactggacggaagcttttgtttcttgaccctgcaatatgacagactgataatattgacagaaggtgcagtttttgggctatagtcgagattttcgctaatcaatcatgttagcagaaaaaaagatgacttgattctgtagggctagagtcttaagacaaagtgcccatagtttagagacagtttccaaaggctttagtaccaccttgataataaaatggtggacccactctcccggaagaaacaagctctgaacagactacgtgctcagcttaaaaagca

SEQ ID NO: 499553 - DNA, 154 bp, Homo sapiens
cacaggttggcccttcacaagttctgatggttatacagtgagtgttctaaatgagacaacaatatgtcagttactaagtagtagacagaccttgcatattgaagtaaaagggtgatgtttacaattgacagtccaggtgtaacagtaggaggga

SEQ ID NO: 499554 - DNA, 262 bp, Homo sapiens
gattctgcctgagaagtcaccatttttctgctggaatactgatattacttactatattccccagaatatctaaagaacttcttaaaaatgaatcggctgggcatggtgactcatgcctgtagtcccagcactgtgggaggctgaggcaggaggatcatctgaggccaagagttcaagatcagcctgggcaacatagtgataccctatctcttaaaaaagaagaagtttttaaatttgaaataataataggtactggatttat

SEQ ID NO: 499555 - DNA, 326 bp, Homo sapiens
taataagttaaagctaatacaaatataaaaaggggaaagtcctctagattcaatgacatccacaaattgtacattatttacaccaaaagcacagggactcgtgtgggtgaacagactgcaaccaaagccgatgctgggtgtcctgaacggtagcaacccccgcgccgggggctcaagctcaactgagggttttgtcattttcaagtctgaaagtggctgatctcctgccttggttgtgacttctattcctggcagagggggtatttctccaatggggaggatggtttgaaaacaagactctgcttgatagaattttgggaacctct

SEQ ID NO: 499556 - DNA, 865 bp, Homo sapiens
ttcctggccggggcacaaggccctttgggcccctcgaccccctcggggcttccacccccccaagagtcccctgggggtcgctcaccccagcggtttgagctcttcttctttcaccgctgaacccttgtgctggagtcgcccgcgcccccattgggagcccggccttttcatagcgtttccggggagagatcgtcaaggccaccccgctgtgttttggcccaccacccctgttggtaattctgtcgcgacgcccgcgcgcttctataacgataatttctcttgccaccggcgtccgcccttcttcccccatggggcgcccaaaaaccccccacgtgaccacgtcctgtataaaacaccccgtaacgtctaaaagaagagtcttcccccctctctataaatgggtctgggtgaatcaaatactccaagtacctacagttcctcacagcctgtcaaatattacgctccagagactcctcctcatacaacgcttttattgtggaaacccgactacatcccactactcttcgtataaataattatacaccctgtcgccctgctgtatccacagtgcatgagtccccaatagatgtgagtcttaccacgctccactatcccctacaattttactctcacttgccgcttcttttctccataataaagcttttcaccactccccctttctttgtcaaaaaaggtaacaaattagtataattcttctagtattcttctttgaatcggaaaatatcctaattattagatacgaatgatcttccttcttaggtattttaatactttatcgtcagactccattcagagatcacatccaaataaaaaaataaaaccccgaaaaacgttccaacaaaac

SEQ ID NO: 499557 - DNA, 911 bp, Homo sapiens
cctccgtagccaccgcggaatgtacaagggagtggtgtgtcgttgacacacggccctcagagatgatcccgcccggctgcgctggtgaaaacatccgctccccgggtgaacacaaataccacgtgaactgggtggccccaccagaaccctccaagggacgggtgtagccaaattttccgggggggaacaacaaacaacggacacgcggttgggcccgctcattctccaccccccggggcaagggcggggataacaccacacgtcgcgagagaaaatggagccgccatccaaacaagggtgacaacggcgaaccgtggcgttcattgccgtgatggaggagaaaaccccggcgtgtcacgactcgtgccagcggggcacgcggaccaaacaaggggcccccggcgtgggagaacagttcagggggaaattgtcacgcccgcggccccaaacaagcgtccttccgggactgctgggcagaatacaaaggacccaagtgggagacatttgtgcgcgcccacccaagagtgaacaagaggaggcgccaccccggaacaaagggggacccgcaagttctcttccttccgccagcctagcagggctgccccttcctgtacaacgcactgcgttgtcagaacccttgcggaggtttcaacacacgctacgtggaagaaaagactctcagtgaaacaaatactgtcatgcgtgtaagacctcgaccaccacgcagttgtctgctgtcctccacaccagcacggtgcttacactcctatacttgatagaatagtaattgctaccatacgggtactactcccgtcgaaaacactggtttctccaggaagaattttccgcaatagaaggcagtactcaccctcagaaaaaagatccggaagaaccagaacaaacatagacaa

SEQ ID NO: 499558 - DNA, 817 bp, Homo sapiens
  misc_feature (1)..(1): n is a, c, g, or t
  misc_feature (122)..(122): n is a, c, g, or t
  misc_feature (127)..(127): n is a, c, g, or t
  misc_feature (186)..(186): n is a, c, g, or t
  misc_feature (195)..(195): n is a, c, g, or t
  misc_feature (200)..(202): n is a, c, g, or t
  misc_feature (207)..(207): n is a, c, g, or t
  misc_feature (217)..(217): n is a, c, g, or t
  misc_feature (219)..(219): n is a, c, g, or t
  misc_feature (228)..(228): n is a, c, g, or t
  misc_feature (238)..(238): n is a, c, g, or t
  misc_feature (240)..(240): n is a, c, g, or t
  misc_feature (248)..(249): n is a, c, g, or t
  misc_feature (252)..(252): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (271)..(271): n is a, c, g, or t
  misc_feature (275)..(275): n is a, c, g, or t
  misc_feature (277)..(278): n is a, c, g, or t
  misc_feature (281)..(283): n is a, c, g, or t
  misc_feature (301)..(301): n is a, c, g, or t
  misc_feature (350)..(351): n is a, c, g, or t
  misc_feature (383)..(384): n is a, c, g, or t
  misc_feature (404)..(404): n is a, c, g, or t
  misc_feature (406)..(406): n is a, c, g, or t
  misc_feature (408)..(408): n is a, c, g, or t
  misc_feature (492)..(492): n is a, c, g, or t
  misc_feature (496)..(496): n is a, c, g, or t
  misc_feature (498)..(498): n is a, c, g, or t
  misc_feature (581)..(581): n is a, c, g, or t
  misc_feature (601)..(601): n is a, c, g, or t
  misc_feature (603)..(603): n is a, c, g, or t
  misc_feature (632)..(632): n is a, c, g, or t
  misc_feature (661)..(663): n is a, c, g, or t
  misc_feature (665)..(665): n is a, c, g, or t
  misc_feature (668)..(669): n is a, c, g, or t
  misc_feature (675)..(675): n is a, c, g, or t
  misc_feature (722)..(723): n is a, c, g, or t
  misc_feature (748)..(748): n is a, c, g, or t
  misc_feature (792)..(792): n is a, c, g, or t
nttacctatatataaaaaaccataaggtctttccacttcgggcttctgtctgtaaactctcattaaacactttttaaaagcactgtgtagtacttctgacctagagcttttaaaaatatatnttttntctataaactccattatttccaagcttgaactcttctgtgaagttcgtcaagctttttntcccctgcngggannntaagntttgttaatntnttccttttntagagtaatnanaggatatnnttntttttttattngntganantggntnngtnnnatagatggaatccaagtntgtgctcttggctaaatccctctcgtcttaggaaatcctgtgcggaaannccactcctggccctgaagcgggtctagctttnnggtgaggggtaggtgtaaantntntccctccccggagaacgaatggggaactccccggcccaaaccttttagccgcttccttctccacgcagccggcagaggaaagtncctntntgtccccaatctcttaaaccctggggaaggagtggtgcattccagaagagcaaaatagtcttaatgccacaagacaaacttanatacacagacatacacaaantnaaaagttaacgatcgttctcttccaatgngccttaagctcccaggtctccagataagnnngntgnncccggnggcagtttgcgatgcccagaggcaaccagtctgcccaacgcgctcanncccgcggtctctgggcgtctcgcanccgggaagggctggcctcacttcggggacgccgctgctccactnctcccgcgggggcccaaggctcaaa

SEQ ID NO: 499559 - DNA, 449 bp, Homo sapiens
atttttacaaggaactatatataagctagcacataattatccttctgtgcttagatctgtatcttcataataaaaaaattttgcccaaaaaaaaaaaaaaaaaaaaaaaaaaaaaaaaaaaaaaaaaaaaaaaaaaaaaaataaaaaaaacaaaaaaaaaaaaaaaaaaaaaaaaaaattaacaaaaaaaaaaaaatacatacctcaaattaattatcaatttcactatataatcctcaatgtcttaaacgctactcgtcttgtaactctacagccatacccaattattttctactataatacaatatccatatctcatctctctcaccactcctacatcaatattcctagatcatccttttaaacattttttaatccctcttatttattaagaacttattactctataactgtatactcacatattaatctataatttctatacttaa

SEQ ID NO: 499560 - DNA, 396 bp, Homo sapiens
cactgagacacagtcgagctagttcctttccagagtcagactgtctctatttcttccttatgtaatcgctctagctcacgactttcagatactatgttgaataacagtattgaaagtgcgcgtccttctttgtgtaaacatactactatagaggaaccgcttataactataaatactaacatggggagaaacagctctcgttatgaggtctgtcagtactacttgctcgctactgtgtccaaggtatgttccttctattaccaatctgggagagtttgagtcatgaaaggctatcgagtttcatccaatgctttttcaagatcaattgaaatgatcatatggtttgggtctaccattctgttgataggctgtatcacattgatcgacttgtttatt

SEQ ID NO: 499561 - DNA, 180 bp, Homo sapiens
acattcaatagcggtgaagccatcacacccagccagatttagtgtaattcctaagggcccataggatttctggaatcataaagtcaccagctgcatttagaccctaacaggagagtcagcctgtcctttgaagctttgaagctaggcaatgatttctcctctctagctataaaaatccta

SEQ ID NO: 499562 - DNA, 642 bp, Homo sapiens
  misc_feature (635)..(635): n is a, c, g, or t
caaagtcactccaggagcaagggtgtcatttactgaaatgacagactctccatttcacatttttcccccaagtgcagagtgcagggaagcagatgggctaaatttttagagtcagggttattaatgtatactttacatagtaaactttccccttttaagtgtgcaggcctgaggtttgccaaatatgtgtaggcatttaatcaccaccacgatcaagatgtagaatattcccactatcaaaaagtttgctgtgtcccttgatggtcatgccccattccacagccccagccccagcccctggagattgctgtctgctttatgttccagtggttttatcttttccagactgtatggatgtgaatggaatcagatgtgattccaaggtgtttgatcttttccagatgtgaatggaatcagatgtacgaaatcctatggtagggggtcttctgagtctagctccttttgtttagcgtgatgcatttgaaattaatccatgtctcaggcatcaggagttcatttctttttctgctgagtagtatttcattgtatggatgtactgcaatttgcctatccattcacctgttgatgtacatttgagatttttggcaattatgaataaagctgctataaacaanaaaaaaa

SEQ ID NO: 499563 - DNA, 325 bp, Homo sapiens
cccctccccgggtaacatatgagactgtctctgttagaaaaataaaaagtccgggcgtggtagctcacgcctgtaatcccaacactttgggaggcccaggtgggcagatcatttgaggtcaggagttcgagaccagcctggccaacatggtaaaaccctgtctctactaaaattacaaaaattagcccagggtggtggtgcatgtttgtaatcccagctactcaggagactgaggcaggagaatcgcccttgaacccaggaggcagaggttgcagtaagccaagatcacgctactgcattccaacctcagcgacaggggtaccga

SEQ ID NO: 499564 - DNA, 350 bp, Homo sapiens
atccgaggattaaggcacactgcaacctccactctccctgtttcaagcaattctgtgctccagcctctcaagctcacaccatgcctcgctaatttttgtatttttagtagagacagggtttgccattttggccaggctagtcttgaacttctggcctcaagtgatcctcctgcctccaaaagtgctgagattacaggcatgagccaccatgcccgcctccttttttcttacattgctttgaagaaataaaaatctttttcaaattgattactttgattattcaatttgcttcgatgtgacctctgatcataggttgtataacagtggtgtagtctttgcagtggtgcctg

SEQ ID NO: 499565 - DNA, 346 bp, Homo sapiens
  misc_feature (246)..(246): n is a, c, g, or t
  misc_feature (308)..(308): n is a, c, g, or t
tcgctgcaaatcatcattaacagcgtaattatacaagcatatttaatgctgagtttaatttaatatgtaatacatatggtaattgtagggtaatacccacaacaactgtagtttcttactggcccaagagaatgcttatttaagtgttagacttccattctggcaaaatcttgcccaaatctgtgtttgctttctgcttgctacatttgtctcccttacttttcgtgagctaaagacaggcttttnccaccggcatcatcactgctatcatcattaacagcgtaattatacaagcatattataatgcngattgcagtgagtggtcagcagagggatcgtctagagt

SEQ ID NO: 499566 - DNA, 335 bp, Homo sapiens
tttttttttttgagacagatgtcttgttctgtcacccaggctggagtgctgtggccgaatctccgctcactgcaaccaccacctcccaggttcaagcaattctcctgcttcaacctcccaagtagctgggattacaggtgcgtgccaccacacccagctaatttttgtatttagtagagacgtggtttcaccatgttgaccaggctggtctcaaactcctaacctcaagtgatctgcccacctcagcctcccaaagtgctgggattacaggcatgagcactgcacccggcctcaattagttcttttaattcttctattatcacttttagtcgacg

SEQ ID NO: 499567 - DNA, 1378 bp, Homo sapiens
  misc_feature (256)..(256): n is a, c, g, or t
  misc_feature (259)..(259): n is a, c, g, or t
  misc_feature (269)..(269): n is a, c, g, or t
  misc_feature (288)..(288): n is a, c, g, or t
  misc_feature (425)..(425): n is a, c, g, or t
  misc_feature (878)..(878): n is a, c, g, or t
gcagggctttactggagagtgcgccgggcactccagccgatcgtggggatcagggtaggtgagctagtggccttttagcgaggtgcatgcatgcacagtagctagcagtgcggttctgctacgtagggattgaggcgtcatcctaccctcactcttgctgtgcattcactcgatcttacgagtaagtgagattcgcgcatgttatgaacgcagataactaagaacgaagatcagagaggaataatacacatgaaantangcttactgtncccaaaggaaaacgcaagnctcgttgagaggattggatttactagcctctctccataggacacttctggaggaattggctcctatgtcttgtgcacacgcatgatcaagattgaagctggtctcgtcagggtccttgtcgcaatagaggagaacantcgggaattgagcgcagcgtataacagtcctacgaatctatgcgccagcccatggagagtgtatttgatcccaagaattcataagtgatacagtacatgattccttgcgaggaggtctactcctaggagttcactttggactctgtcatggattattaaaggaatatatggcgagtcgcgtgcgtgcagagtgattcggcacagggaatgctagggcagaaatataatcgggtagtacaagggcgccttgctcaatgtagagcgatccttaatgggcataaatggaggagaaacttcaataacaggaaatattgaactcaaaaggaccaatgacaattgtccgcgcctggaaaataaggagaactcacagagagctggcacgaaggtagcatgaagcgatgtaccaggtatatgtggcgagagctatatagaagagaacttgaatggttgacnacctctggataactttctgaagttcacgtggattaatcagggaatctcgattcgtgagagaagaaactggtgaggattctctagtgggaagactccgaacttggacgtgtgctgaaggaactggatcttcctctacggatgcaagcctgttttttgaagtgcttactaattgacggggtgagaatttacggcgcgaagttaactccgagaagatctggtgggcgaagtacttactcgtatattgggcgcccggggagcaaaaattcccctgttgaggaccgggggcggcactggcgtcaaggacaacaacataggtgttaactatcagcggacgttaatagaaatgtctgctgcagcaagtttgatattagataacataacaccacctggcgcggagtgtagtaagagaagaggaggtgtgactaacacacaagagccgcgagcgcacgacagctacgctatatagagtcgcggacaactcacaactactgctccatctg

SEQ ID NO: 499568 - DNA, 358 bp, Homo sapiens
acctgcacgcggccgagggaggcgaggcactttggctgaaaggagaacctgggaggaaaggagagaaaggagagcctgcggatcctggtccccctgtgtgagaccaggccctccgggggccaagcaggagtcccacggacccgaggtgtgagacccggccccccgtggagaccccgggtctcacggaggtgtgacgtcatgacctcacgtgacgggagacctgcggtgtgctgcgctccggaaagcattgggtacaccaatttcacatcgtggagaagaacttcgtcatcaacgtggtctaacaggctgggtgccatcgctaaggaccccaagtccgagacggggccgcgtagcaggt

SEQ ID NO: 499569 - DNA, 453 bp, Homo sapiens
agagatatgtcgccgtcgacgatggagcggtgtgaacctcagattactgcggagggtacattgaaatgaatgacatgttcagcgatatatctgtgaaaatgaccttagtgcacgggagtcttgtttttcgtgtgtagttaaaagttaaggaaccaaggtaaaatagtaaatgttatcattgcagattcggctgccaagcatattgggctttactgaataaatgtgaatgagagaaatcgctgcttatcaaaagaacttccaaaatcactttttaaaaatcatttgcttttactgtttatggtcctttagtgtaggataataatactgccacactgtcaggtatagctagttagaatagcctgggcgacagagcgagactcagtctcaaaaaaaaaagaaataaaaatgtctccttctagtcttcccacattacagcatacgcccaggtatgca

SEQ ID NO: 499570 - DNA, 159 bp, Homo sapiens
ctatatctaattggggccgggcaactgatctgactagtcttctctcaaagacagacatacggatggcaaagaggtttgtggaagaatgttcaacatcactaatcatagggaaaatacaaataaacaccacaatgagatatcatttcatccctgtcatct

SEQ ID NO: 499571 - DNA, 429 bp, Homo sapiens
tactttcacagggacagaaagacaaaccttgcatgttctcacttatttatggaagctaaaaatcaaaacaattgagttcatggagatagagagtagaaggatggttaccagaggttggggggcagggggaagtgggttaatggttaatgggtacaaaaaaatagaaaggatgaataagaactagtatgtgatagcacaacagggtgattatagtcaatattaatttaattgcacatttaaaaataaaggagtataaccagatcgtttgtaacataaagagtacatgcttgaggtgatgaatataccgtttaccccaatgtgattattacccattgcatgtgtgaatcaaaatatctcatgtacctcataaatatatacacctctgtacccataaaaagacgtcaacccctatggaaaagtagggtaccg

SEQ ID NO: 499572 - DNA, 960 bp, Homo sapiens
  misc_feature (25)..(25): n is a, c, g, or t
ttcgcgatcgtggggcagagtctgntggtaacgcgcagagggcttgtgaggcccatatctgtgctggattccgtacctcccctgggttcgccgatttcttggccttgccgcggctacaacactggcccctataacactttgtttggcgcccccctcaaattgtgcaacccgacacgtgtgtgccccctgcatttaggtttttctcgcctacctggtgttcacccctcgcatcaccagcacacaatttggggggggccagccgcaggtcactctcccccgtgtggggcctactatcctccgccgtgccccacacctggcgaccaccctgcgtgttttccaccactcccccattattccctggcgttgtggtggcggtaaatctcgcgtggtataaccccccccctttcggcagtgtggagctaacccaaccgggggggttcctcaccagtggcccccacttaaaacacctctctgtgtaagatgcccgcgcgtctccaaatagatttttcgtccgggggcgcccctggttgttctcggcacccgttccgaatacagaagggtcttgtgcccgggccccttggttgggtgcagcccccgccgaacaatcccccccgacactggtggggtcaggagccaggacacgcgcaaacaccccccccgccggggagatccaaaccgccccgcatcgccgccacacgctgaggtaaacccccccctctttccttcaaggagaaaaccacgcagaataacaacgcgcagagcgggcgggcaaagacgccggctaaatcccaccacaccccgtaggtaggacgagcagcacacaggagaataccaccctagaacacgggagggcgggcggaagctccccgaggagcaggaagaatgccgccccgccgacccccccccccgggggcagggccggcagccctttcccaacaaaaaaacaacccaacaaaaaca

SEQ ID NO: 499573 - DNA, 970 bp, Homo sapiens
aggcatcataagaagtttattgggggagtgtattggagaacatgatgtacagtggtacgtgtctgatgatgcttgcaaagagaataatcaggatgagatgtagttgatatggccttatataattgtgagcagtggggttaggtaaggagaacattgcatgatgtcgtaattgtgcgtggatatggtggatagatgttctgggaaggatgaacttatccctgtggagtccatatgtaagttggtgtcctgatattgattagaagtatgaagcttgggtggagtgaggtaaagagattagcattactaagagaagggatcttaaataaggtaagtgattggatatatctcgattgatttatggaggagtcttacccatagttactgcttgtcgcgtgggtaatctgcggcgacctggtgatgggagatgtaatatgagagagcaaagattattttcatttatcccagatgacctatggacgtgccagaggttagcatgaatagtttgacacaatgtgatatttaattctagtttctctcaatgaataatgtattttgtaggaaatgtaagatttcattctgaaaacataattattggtatggacaaaattggagatacattttgttgaggctgcagatatccaactttattcagtggttcagattagattaggtggtactaagaaataagcaggttttcactaattaagtactggagaagtctgtaagaaaaatccgaatgaaggtcgggaaagggatgttacggtaggaatacccctggacggggtggggtaggtatacgccgcctttaataaatttgggcatgaacacagggtctttggagtggtgacgactcgacagcgtacgagtgtattaaaaaaaataacggggggaaagtatgggaaataacagaagttgtggaagagcatgggacggcgaaagttaagtcgaggaggtgcgcgataggtccacg

SEQ ID NO: 499574 - DNA, 580 bp, Homo sapiens
ttggcagatctgatcatgctcatcttctcatattattgcaccgataagtaaagcttgaagtgcctaatctatctctatcatttctgctgaattcagtcatggagaacaggtacacagctgatcagtcatttgtctattgacttcaacgcatgcataaaccaaaatcctcacaaatcttcatgccgttttaatcttccttactgaatttttaaggcataagtcacatcctacatagacctgtattctcatatgcaatgtaaaagggctgttctgtgaactagcaacattctagtgttctgcgtttttccgcacatactcctatagtttctgtggtgtgactggtaatatttacaccagtcacagaatgagttcagtctgtatcttcaccttctttctttacacaggtacaattggctcatgcctatatcccactggttgagaatgcaggtcaccttctggactctgatcatcgactgattacttgcctgcaaactctcatacattaaatgatcaagacaagcagagtcatgccacttgacttttctaccaagcgatgatttaatgacatgtctatgcaagg

SEQ ID NO: 499575 - DNA, 311 bp, Homo sapiens
  misc_feature (75)..(75): n is a, c, g, or t
ttgtgttttgaggggtttttccttcttatgggggggcttctctgggcctcccccaaaaaaatgcccgagggtttngggggccctggcccccccctttaaccgggccttggggggggcccccctttaaaccccagtggccaagtttccagtggccccggccccggccccctttttgggggccccggccccccccccttattggggggccgggcccccctcccttttcccccccggggccccggggccttttttttccaccttttttgggtttggggtttgggggtggggcccaataaatttttttcccccca

SEQ ID NO: 499576 - DNA, 590 bp, Homo sapiens
cgctctacgaggatcccgtcccacatagtgttgtaggtgtatatggtattgagaattctgtgacagatatctaatgctgggcaccagctgcagccctacatacagtttgaaaaaagaataccatgctgttacattagtgagataagtagacacgcaatacacaaaaaaccccgcggcacttctggtgaagaacaaaaaagatacacaagagttaagcgtaaagatcacaggcaatagcattcaaacagtggatgtgggtagagaaaggagtacccggcatgagtacctgctatagtttgactgaatcgctgatgtttaatctggcttgtcatgggccgttcacgacacgcaagcgctgtgtgaggtatgggtagtcagctggcataattcataaaccctacactgccatcaagccaatgctactgggtctcgagttacaggaagaaagtgcattagaatgcgaggcagtaaagcaaaaaactagaaacatcctggacaaagaaatactagcagttgagttaagacaaagtagtccaacatgggcctccgaaatattcaagttagaaagcatatgtctctgccaatgtacg

SEQ ID NO: 499577 - DNA, 227 bp, Homo sapiens
  misc_feature (33)..(33): n is a, c, g, or t
  misc_feature (120)..(120): n is a, c, g, or t
tctagagcatcctatataggagagagaactgangcagaggtcagtaaactgcctgggccacagagcagcagatgaagggctagacctggatccagaagctagggctctcggtccagcatncatccactggtggacatcaccattggggttattttttacccagcgaaggttacgtagaaggacgaaaacgcactcatgccagcaacgtgaaactcaacagtttcaaa

SEQ ID NO: 499578 - DNA, 276 bp, Homo sapiens
tagatgggcgaggtgaaatccttgccttcgttggccatcaggtcggtgatggactcggtcttgccgtagcgaaagtgcgtaccgatcaagtcggaatcgttgacccagccgtcatagatgttcttgtcggactgcatctgggtttgcagcttctccaccacgtcgccttcctgcagcaggtcgtgggtcagcttgatgccggtgatttcactgaaggccttggccagcaccttggattcgtactcgtggtgatctgagtatcgacggtaccactca

SEQ ID NO: 499579 - DNA, 865 bp, Homo sapiens
gagttctccctgaattgtgaattgcctgctcctctggactcctggatcctgtctctgttctccatgcatggtgtgtctgaagctccctggaggttcctacatggaaaaagttgacaggtgacacgttgagtggtgcatgagcatccccacatgggtctttgggtcgtggtggacacctcgtaccactgtttcttgggaggtagagataagtatgagtgtcatttcttccacgggacggagcgggtgcggttcctgctcagagactgtctataaccatgcaggaggacttgcgctattcgagctaagtcgacgttggggcgagtaccctggagctgagtagaactgcgagtctcgtgagtgactgcgacactcgatcagctagatgttatcttggaatcccagccttagaaaggacttcctgagtacatcagaggtcgctgccagtgagtgtgactcagccctacctgtcaggaacttcaatttaccaggggtaagtgatgagagcttaaacaagttgcctgcgtgccgtagtgttgactcactttctggttgactgttgtaatactcttggtaaagggactcactagtagtcactgacttgacgacctatcgtaacttcctggttctgctcttgtgacatagtggttctcttcgaggcggcattggaatcatcaggtggttcctggattacagtcaccgaaggagaaccggcttggggtgagttgtcctacagagccctgattcagaatgggagacttggcgccttccagagccttggtggatgctaggaacacgcagttcctcaaagtgccgaaggttacttcgctgccgagtgggagggacccatagtcgtatagtggcttcc

SEQ ID NO: 499580 - DNA, 289 bp, Homo sapiens
aaaacttcagtcagtttctcaacccattccttcttctcctgcctcaatgagtaactcaggaaactcctcaaacagtgccctccactctatcaaatcttcatcctcgccaatggttccagtcacatattgatcgatgggattggagatttctgctctcttcactcctgttttaaacttcatcgaaagcactcgtggatggtgtctaagcccaccaatagtttgccttatctcctgcaaggcgagtgcagtgtatacgagactgctgtcctactgatctataggagtggtg

SEQ ID NO: 499581 - DNA, 1863 bp, Homo sapiens
  misc_feature (1205)..(1205): n is a, c, g, or t
tggaccgggaccctttgaattctaaaaaaggtttataatcaatggaaggaggtaacatgtagccttggctgggcgacaaagtaggcaaaaatgttctctggcccctatcctaagtgtgagctggccccggttgtaagggctctatcccaggcccggccccctctggggcagctctgggtaaccgctgggcgctgaggctgtaggaatcctctgggctgggataccctatacgaggagtatgagctggagatgatataccgccacagggacacatatgagctcacccccacggatggtgaccagggtctggctctatagggtgatatactacacctaacggagatatatcacagggacatcagtctaacagaaactgtgagtggacatagagaacaaacgagagcacccgcgaaagagggcagcacactagggaggggagacttcccaagaacagcccaggaataaaacgcgctatcgtgaggcgccacgggggcagaacacaactatggggcgcacctgacgagacacgactcatagccttgaggcagaaacaacaccgcagcgacaaaaagcgggagggcgcgaccaacaggtaacaacaacaagcgacattctacacagagacacgagacgggcgtacaacccaccgacgaaggggaaaaatcatcttggtggaaaaacaaacaagcgaactacgaagggacaaagccacaaacaatacaagagccgcaccgcggacaccgccggagccacagacacacgatgagacggaccaccacaagcgacaatcgacaggaaaaaaacgaagcagaacacaccacagaataacgcaacacactcgacgagcggagcacacaccacaacaggcagcaaacaagcagtaagctaacagctagatcacacgaagcgcgccgggcggacgaaggaggaccgtcccacacaaggccgaacatcacgcagatagagccaccaacccgcacacaaccgccgtcatatagtcagatacaattcaagacacgagagagaaagaccaacaaacccccgattaatgaggacccgaccaaacacagccgccaagagattgtaagaaacgcgccccaaaacgaacgacaacgacagacgggcacaccatcacggagcgcaccaagaacacacacagacaaacaacaacgtgcgcgacacaaaacaagcccccggatggtagnccaggcaaccaccgacgagcgcagacacaaagtcagatatagagcaaccaagccccgtgccaacgaggggggggacaaacaccaccacacatcacaacaagcagcaacacatgatgaacaacacaacaggcccacgaagacagacgagataacagcgatatcgattaccgacgacccagagagggggacgactataaacaggcaccccgctgatagtaaaagcgcccagacgacgcaggaacacacaaacaaaaacgagagcaaacttaacaagaccgacgtgaagaccacaccaatcacaaaacacatttagacgggcacacgacgagggaagaagcacgccccccgaacgcagcggacctatcagaggaaaaacacccgcccgcggagaacaaaccaccgagagaagacagccgaagtcacataccacccactaacaggaacaacgcacagggagaccaccaaagcagcgacccaaccacacccgcgcggcgaacaatatatatggatgcaggacacaacacaacgagggtgggggagaaacaagcgaacatatacacggacggggactgcaagcaagggcggagcgagccgaaaaaccacagtcaacgcagagccgcgtcggacgacaaagcgacgggagcgtgtggcaccccaa

SEQ ID NO: 499582 - DNA, 128 bp, Homo sapiens
tactacacaaacagaccccgtagtatacaagactcggtcaccaatcatgggcatctctgtacctgtgccctctactactatgatgaccttcagcacgccttcgtacctgttagtaggaggtagcacta

SEQ ID NO: 499583 - DNA, 367 bp, Homo sapiens
  misc_feature (367)..(367): n is a, c, g, or t
gcaggattcggcacgaggttccctttactatatcctacatttttgtgacactaagttttttcccattccaggacaggtcaagccctttaaaaatttcaacagctttattgagatataattgagataatttaaaaaatactgcgcatgtgtcatgctggagccctattgatttcaacaaggatggcgccttgtgcaagaagagacccagagcccgtggatgggacatatgggttatttatgactttacagatgtggtccactggcagtgggctggacaggacacgctactatttgtgaagagagtgtaggttatataacaattctacttatcactcttcacttagcaacctctcatttaccctgtgtn

SEQ ID NO: 499584 - DNA, 178 bp, Homo sapiens
ctagccactgacccaggtcccagatgtgaagataccatgttccgaaacaggggggaaatcactctacaaactaactatatactacgtgaggagaatgcatactttataatataaaactgtctacacatagtagttagctgtaaaaagccatacgatcttctcttggcttggaaaaaat

SEQ ID NO: 499585 - DNA, 1243 bp, Homo sapiens
  misc_feature (916)..(916): n is a, c, g, or t
agcgtgagggatggacatgatgctgttggtgacacggggtgcttgttgcatcgaaccagtggtctggcggcggtgactccctcagcctgtgctggctgctatacctactgcctcccggctggacatatgtgtaggacttccctcatgggctgcgtcgctgagaaaacactgatgagtcagaacgacgagggacactaggcggtagcatctaaggtgtcagtttcggcagaatggatgcttccagacacgggtgcctggcatgaaatccaggctcaatgtattactattattgctgggatggttgactcatgtgggtacaagtagcgactccatcgaaagtattacaaatataatacccacttgacgtctcacgtgcgacgtacatgcactcctaaactacacgacatggtagactcgtgacacgaattgatggccgcaatacaacggtggtccctcgttcacgacgtcaaacaataacacccatgaacgacatagcaagaggatgacactagctacaacactgcatgagcaaaagggtaacccatacacctagaaagaagtagttcatgacaaccattcttccctaagacgtgcaactatttggaacgcgagtcaaccttgaaaaagcggtaacacccaaaccggattgccacttccatattaagcgtatgattacgcggggacacacaacattgcgcgccaaagagcccccatggcagggacgcttaccacacattttctgtggcggaccgaagcaacaaaatacgtcaccaacccgaattccaaaggacgacacaagacgcacacgcgtttgcaaaacaaccttgcgcaccgacacctctactactcaggcgcaggacacaatatcagaatagagggaaacgacaaaacccaaacgaggggaacaccaaggggnccgatgcgagcggggaaacaatacaactcgcaacagtaggccaaaggatgcggcggagcaaaaaacaagcgcgttggacttgactgcaacaaacccccaagtgacgtgtattgccacgaggaagacacagctacacaacacaccattccgaacaatggtgccacacaccgagaaggccctcacgcgttaaccattacatgagccaggtgcaacaagtacacacacacttcattgcaggggcaacaccgctcggagaccaccgcacacgcgaggaacgggaccacgcatgcaggcgcgagcaacaaaacacgccaacagggaacccag

SEQ ID NO: 499586 - DNA, 1595 bp, Homo sapiens
aactttaactgacattctattatagagaagggaagacaatgctgaagaacgtcaaactgtagcatatgcaacatgctgcacgcagggctggcagcacacgcacatttgcaagcacagtggcaataccactcatgcaactcatgctaaatggtaaatatagcatttcatggtttgtcttagtcatcagctggtcacacatagtgtagtcatctatgcctgagacctctaaatatctactctggtacagccatcaactccaaatagtgtattgtagacaacacctgtataaaatacataataaggaaactacgtagatactaccatagacctagtgtctattataaaaacatgtcattcagggtacgacataagtattggacaacataatagttaaaaagacacaagacacctcattacccgcagaacttacactcttttctactagcacacaaacaggacacgatcacggtaaacgaaaaaactgactaaggttactaataatactacagacccctcttgatgaacctctaagggacttggtcatcccaatatatgggcaagcacaactaagagggcacaatataagactggttaaaacatagttggggtacttacctatactggctatctgaaaatatggtaacacaatcttaccacttggcatgggtacataaacaggaataaccaaaggctaatacaacatttcatcttggatacccttgtataccaacgcattacatatgggtaagtatatacaaagtcgttgggacatgaacgcataacgcgagaggagaccccaagaggtagatgactgtataataccattctcgccaaaaaacatccaatgacgaacacctataacgtctggcagataaaagaatgccaacatatgaattagcaccgatgggcacacaacgattggaaccaaagtgacaaggtacaaaacaaaataaaagaatacaagaggaaaaaggaggcgaggacaacaaccccagatccacccgcggaaatagacaaacaacgagacgggggaaaacaaaaataaacacacatatgaaaacaaatgaaccactgaaacacacacataaccataacaccagaaccacaccacgagaaaagaacaaagaagcaccacaaagaacccagaatacacgatcaaaggagcacacaagaagaaggggacaaactataagaagaccaacacaacagaccaccaacaggactgaacccaaaccactaaacacccagacgcccaccgacaagagaccatacacacacgagcgacatacccaacgacacaccaaaacgcgagaggccaaaagatggaggacgacaacaacacacagagagctagaccacaccgatgcaacctcagaaacacaacaagaggccgaacgaaccaacacaacgcgaagaaagaaccaaacgacaaagcaaagagacgacagcacacagactacaaacagaacacgaacaacccgacggacaagcaccccaacacgcgcgacgcacgcaccgaaacacaccaccagaaacaggccgacaccacagccctaccacaacacatacgcaaccaagaagcgctagatgaagga

SEQ ID NO: 499587 - DNA, 298 bp, Homo sapiens
aaataaaccccccctctgtcccccagggtggagtccagtggccgtcttttaaaatccctgtgagccctgacttagcccatactggcccgttgctcctaggaaaaatccagggttgcgttcctgtgagctttggtcgtgatattttcatcagctgaccaatatgtaatcttgttttatgtgtatttctgtttaaagattcatatatatatgggtatatatatatatggttgagttgttcccgttgaactcccagcccccaggactagaacccatgcctaaataaagtttttttaccata

SEQ ID NO: 499588 - DNA, 289 bp, Homo sapiens
tctcggcacactgcgacctctgcctcctgggttcaagcaattctcctgcctcagcttcccgagtagctgggattacaggtgcatgccaccatgcctgactaatttttttgtatttttagtggggacagggattcactgtgttagccaggatggtcttgatctcctgacctcaagtgaaccaccctcctcagccccccaaaatgctgggattacagacgtgagccaccgtgcccaaccctctttaacagcattttaacatggcaactgggacatacaaaattacatgtgc

SEQ ID NO: 499589 - DNA, 109 bp, Homo sapiens
ccccgacgctgttcttcagactgttttggttctcctgggtcccgtaattccaagctgacccttctacagaagagtgcttgactgccatgtggtttccccagtcattagt

SEQ ID NO: 499590 - DNA, 308 bp, Homo sapiens
  misc_feature (230)..(230): n is a, c, g, or t
attctatggttaaatcaattcctgtgggatttaaaacaaagtcttaatcagtccatggctgtgtacaagttgaatgacaatccaaaatctgacaagcatgttgatgtccgagttgatggcttaatgctaaagtgtgtcatcccctctgaagtgaactctgaatgtcctccatatccgccgcgtgctatctctatccagagtcctgaaatgatcgccacattatacggggncgctgtccaagctgtcgaccttctgaactagattcgttggtctcacgactttcaatattgtgatttccgtagtacaac

SEQ ID NO: 499591 - DNA, 142 bp, Homo sapiens
tcatcgaaacctacagtatcagcacatatggagacttgagtgcgggaggattgcttgagtccaggagtttgagaccagcctggcaacacaccaagactccatctttacaaaatattttaaaatcagctgggtgtggtggtag

SEQ ID NO: 499592 - DNA, 312 bp, Homo sapiens
cggctcgaccctttcaattttccataccggctttcataatgggtactccttcgtcaaaggctgccgtatccgggagaaacataggtctggtagaactgcatattgcccatgcgggaactgggcagcggcgtctcgtccagctctgggatggtcttaatctcatttgcaagatattgctgaagctcgtcctgaacgtcctttaagcggccgacgaccgaaccgtagcgcagggcgagcgtttcccagccgttacgcttaaaggtctggttccacaggcggcgatgaacgcgcatcagcgcctcggtctcttcg

SEQ ID NO: 499593 - DNA, 429 bp, Homo sapiens
tgggggatactgcgagtatggtggcgtcaaaggtgaagcaggacatgcctccggcggggggctatgggcccatcgactacacaacgtgacgttgccgcgcaggaggactgccgcgctacaggatgctggccatagggattggaaccctggtctacgggcactggagcataatgaagtggaaccgggagcgcaggcgcctacaaagcgaggactttgaggctcgcatagggctgttgccagtgtgacagtctgaaaccggccgtaggaccttgcaaatgcttcgggagagcctggaggaggcggccatcatcatgaaggacgtgcccgactggaaggcgcagtcagcgcaccagacatcccacgtgacggccactcctcgatctctagctcctcacgacggcgcgcattatgcgggtttgtactctatac

SEQ ID NO: 499594 - DNA, 552 bp, Homo sapiens
  misc_feature (38)..(38): n is a, c, g, or t
agtgattcaaatatcatcaactggtgggtgcataatanaatgtggtatatgactccatataatggaatatctttcagcagtaaaagcggtaagtactgatacatgatgaatcttgaaaacattatgctgtcagagagcccagtcacaaaagatcatgcattgtatgattccatctatatgaaatgtccagaataggcaaatttgtatagacagaaagtagatgaatggctaccggattctcaggggaatgtgaggaatgggattactgctgaagaatatggggtttcttctggaggatgataaaaatgttccaaaattgatatggtaatggttgcacaactctgtgaaaataccaaaaacctctgattgtatgcatttaatgagtgagttatatgtgtgtgagttatatgtcaataaaactgttacaaaagaaaagaaataagaaggcttagagtcaacctctgtagaacactagtttacaacgtgctggtgtctccatctcatgggcttttatagcactcctgtagagattgctattgctagatcaagttg

SEQ ID NO: 499595 - DNA, 103 bp, Homo sapiens
ttagtgagaccatcctctggccgggctcgaggccctgacagcaacgtgctgctcctgaggctgccggaaaaagtgcccagtgccccacctcaggaagtgactc

SEQ ID NO: 499596 - DNA, 134 bp, Homo sapiens
ggttttattttctgatttgtaaagtaatccatgttgaaagtataaagaagcagaaagaaattgcctatcctcctgctacctgggccatcacatttagtattacggtattgggagtattcttagacattctcatt

SEQ ID NO: 499597 - DNA, 592 bp, Homo sapiens
  misc_feature (288)..(288): n is a, c, g, or t
ggtgggcagaggccccgtttcttttatgaggtcttttgtttggggcaccctcaagggactgccaacccacctaattgggatggtttccttggggtggtgcttccctcaagccgaattttgtgggcatcatcaatgccaaacaatgagccccatccttcttcctcccccttcctgccaaggcaggggtataccagcccagaagcccagtgactgccctttccccgcatatgcttttgatggggtcatctgctccctcctgtggcctcatccaaactgtattttcctttnctgtttatattttccccccgtaatggttggggccaggcccatcccttttcccctttctataatggttggaactaaacgtccccaaggtggcttttccttggcttaaaaatggaagggggggtgggatttgctcctgggttccctaggccctagtgagggcaaaaaaaaaaccctcctttcccttttttccccgtgaggccaagatcccctcaaaaggcaggagtgttgccctttcccctgggggccgggccttttttctgtgttttttaacccccccttttagggaattaacctggcccttgga

SEQ ID NO: 499598 - DNA, 134 bp, Homo sapiens
tggatttttggggggggggggccccgtgtttattctggaatattaagttttaggccctccggggctggggaccccccaaaggtgtttaaagtttcccacccgaccgggcctgttttttatgctttggttccttc

SEQ ID NO: 499599 - DNA, 377 bp, Homo sapiens
tcatcactccttattgacgattttcacatcgactatatcaggatatgggctgcaattttcctttttagtgtgtctctgccaggtttggtagcaggatgatgttggcctcataatgcgagttagagaggagtcccatctttttcgactgtttggaattgtttcagaaggaatgctaccagctcctcttgtaccactggtagaattcagctgtgaatctgtctggtcctgggctttatttgcattgggaagctattcaattactccttcaatctcagcaattgttatcagcctcattcagggatttgactttttcctggtttcagtctaaggagggatgcgcaggggcatcctctcagcacctcgcactgcaggcatgc

SEQ ID NO: 499600 - DNA, 489 bp, Homo sapiens
cggagaaaaacaatctcaaagtgaaagaaccagttctgatgcctgccaagtctttgagaatcactaagagaaacacaccttgtggtgaaggttctcagacacaggatcacttccagacgagaatccataagcagctcgtggacctgcctggtccatcctggattgtgaggctgattgctctgttggaattgagctgcgagccgcggttgacatcaccattgcagatgcttaagccaagtgttttaataaagtgattatcacttgtcagaaccaggcacagtggctcacacctgtaatcccagcactttgggggctgacgtgggaggatcacttgagcccaggaggtcgaggctgcagtgaactatgattgtgccactgcgctctaccctgggcaacaaagcaagaccctttctcaaagacaaagaacagtgaattgtccaattaaaaaatgggcagggggctgggtgtggtcgctcacgcctgtagtcc

SEQ ID NO: 499601 - DNA, 859 bp, Homo sapiens
gccacagtgagccaatattgcaccactgcactccagcctggacaacagaataataccctgtctcaaaaaaaaaaaaaaaaaaaagaaaaaaaagaaaaaaaaaaaatttggcccttgattcaagaattttacccttttaccctgggttaaaatggttgtggaagtgacttggtccaaattgctgcacaaagcgtgtgtttgtgctggaagagcgattttgactagggcagtgatttgacattctctgtcccagatttttggcttacctttcccgtgctgggccccttcccttataggagcatttatttgcgtcacttcccctactttacaataggttggcgctataggacttgcttttgggccagtggaatatgggtaggaaggcaaaatatcgcgccgggcgcaaattggcttcacacctgtattcccagcacttggggcaggatgagcggcgggtgggatcagctgaggtcaggagttcgagaccagtctgggccaccgtggtgaaaccctgtctctcactaaggtccaaatttacgccaggcttggttgcccggcgcctgtaaatcccacgctgcttgagcacggctgaggcaggagaatcctttgaaacccccgggaaagagacgcgaggtttgcaatttgaacgcaccagaatttatggtccatttgcacctcccaagctttgtaccaaaaatgtgaaaatttccccggtttccaaaaaaaaaataaacataaaaacactccgagaggacctctaattcgcggtggcggaaacaaaccgtatgacaatggcccgtgcactacgttttcctaaccatttttttacaggggaaaacgggcgcccataaggcctaaa

SEQ ID NO: 499602 - DNA, 279 bp, Homo sapiens
tcttccttaggggtagaaggatgtaatggaactttgttgtcttccaaaccaatgcaaatgcagggcttctcagctccctcccctgacagtaggctcaggaaaccaatagatgactgtttccagctcccaagcagtattcccgctgcatcagacgcaaggtgtttggctgtgactttagtctgaacttcgtgtagccttggatgatgtttgtccatctgcctccgtgaaggaaggatattattattgccttaatgtaaaatgaaaataaatcatgttaaa

SEQ ID NO: 499603 - DNA, 176 bp, Homo sapiens
cattctcagacagctggatactcgctataggtggccatgcgcagcacctgccacatgagccagggctggtacaacctctacgagacctactgggagcgtgtacctcatgtccaagctgcgcaagcctgatggagctggtatagtacatgctgctaggacacagctgcgcttcctgg

SEQ ID NO: 499604 - DNA, 222 bp, Homo sapiens
tttatcagatccataaacaaaaatttcttaaaaagcagtcataatataaaatagcagtctcccagttaactatcttcagggttttatacttcaggaacgttgacatcaattcagatttgcctacattcttgagaagccacggatcaaccacacaagtccacgagtcagacggacaaggcctcgagtacccctgaagcactcaggtcattgtgcgtttggtgc

SEQ ID NO: 499605 - DNA, 890 bp, Homo sapiens
ggtacaagatcgcggtgctggtgctgctgaacgagatgagcctgcacaggcgaggtgctgccgtcatgcctcatggatgctggctggacggctcaaccatgctgctccatgcccctgctgcagtggcccagatattacacttgtcaaaactttacaatgttaactttgaagagtcattgatccacagcgtgtgccaacattcatgtgcaggcatccagcaatcgacaacttgccattggcattgacagtgctgcagtttgcacacgtgcatcattggcacacccacggttttttttgcatcgcacctttccagcatttcctttcttcttgtgcacacattgaacacgaacgacgtgttcaacaagaaccacacatgtcggtacggtcagtgatctatgatatcatcgtgcgtggacgaccaaattgcaatccgtctcggggccgttacaatgagtaaccgcgtctttcatatatcaaggcacgataagattgattatacaatagcggttggtaaccacgttagggcgcagcatactctccagagcatataggtaaacattttcgcagacggccacattggcggtttgcaaggcacacacagcatggcacgcaaggttggggcagggccatatgccgttggcaattccattgtgtcaaccccttggcacccccagagtcagccaagccagtcgccacggagtgacttggccagacaaagtcacaacaacgcacttggacgacgacgagacaatgcgagagccaacacgctcttggccatccggctcgatcaattcgtctaacccatagcaaggaggcagaggccaagcgggtacaatccgtcgtggaccacagaatagcgtctgccacgttcagtcggagacgcgacgcaa

SEQ ID NO: 499606 - DNA, 685 bp, Homo sapiens
ttgaagccacagccttaccggccggcaaggactttctctacaaattactatgccggtctaaggaaaacgttcgaactcattccagacccccccctgttcggagacattttccgccgatttaaggacgttgaagttgccaggacagtcatggttcttgctgtagttttgtttgaaaccgtcaacacttgggtcaggttatcttctaccggacaccaaggcgtatggagttcgattggaaagaatcttcgcctcagtttaacctttgcccctgaagcacagttggaggaagaaccagaagaagagccttgaagacacctcagaagacgcagaagactcagagcaggatgagggagaagagatggatgcagggacagaagaagaagaggaggaaacagaaaaggaatctacagagaaggatgaattgtaaattatactctcgctatgaatcccgtgtggagagggaatgtgaagttttgaagtcatttcttttgagagacttgttttggatgcttccccaagcctccttctcccctgcactgtaaaatgttgggattatgggtcacaggaagaagtggtttttttagttgaattttttttaacattcctcctgaatgtaaatttgtactatttaactgactattggtgtaaaatcttgtcatgtgtataaaaataaaaaaagatccca

SEQ ID NO: 499607 - DNA, 229 bp, Homo sapiens
ccctgaacattttcgtcctgcattcgtgtcctgcattcgtgtcctgcattcgtgtcctgcattcgtgtcctgcactcgtgtcctgcattcgtgtcctgaactttcgtgtgcggggggattgtgtgtgttggagattgtgtgtgtgttggggactgtgtgtgtgttggggactgtgtgtgttggggtgtggtgtgttggaaatcatgtgtgttggggacacgaatgttca

SEQ ID NO: 499608 - DNA, 125 bp, Homo sapiens
cgggctaacgccgatttttcgtatgccccattcctgtctaccagtgtcaggagtgcgataaatgccgatatatcgctggtatcgaactccgatccatcgcgtacggctgatgtggtaccgtagct

SEQ ID NO: 499609 - DNA, 123 bp, Homo sapiens
gggtattgagacggaactatcgcttcttctacgcgtttatactctccctctcgataattgacggccttcatcttcgcatgtgtggtcacccacctgacgttgcgcgctcagagtaagcaactt

SEQ ID NO: 499610 - DNA, 794 bp, Homo sapiens
ctcccggctgtgccccgcactctccgctgcccacccgctcgcccgctcctccttctcctcccgagatgccactaggtagaccgaagaccgtgagactgacgtcgaagccacagccgagggcactatggcttctggagttacagtgaatgatgaagtcctcaaagtttctaatgatactgaaagtacaggcaatcttgctacacaagaggagatcacacagagagacagaaagcagtcctcttctgtttaagcgatgacaaccgacaaatacttgtagaggaagcaaagcagatcttggtgggtgacattggtgatactgtagaggacccctacacatctttagtgacagttgctacctctgaatgattgccgatatgcttagtacgatgccacatacgaaacaaaagagtctaagaaagaagacctagtatatatatactgggctcctgaaagtgcaactttaaaaagcaagatgatttatgctagctactacagatgccattaacaagaaatttacaggtattaaacatgagtggcacgtaacatggcttggactgatatcacaggaccgtaacgacacttggaagcagaacacttgcgcaggcaaaatgtaaagtaagatctcacatatgaacggcaaaaccaaatataaaatagaccagacaaaaatgacaatcctggatacattaaaagagactaccaattacctccaagctcaagaacaataaggaaaatagtatatacggctaaaagggacaaaaaaggaagaaatacacaccaacaataaaccacag

SEQ ID NO: 499611 - DNA, 211 bp, Homo sapiens
  misc_feature (92)..(92): n is a, c, g, or t
ggtattacagatcttatgagagtggaggtgagaagtggagtggttaggagcttgaagtgacgggtccactgaagttgtgcgcgtgcaggtcngtcagtgcggacagggcgttgggcatgtcgtccacgtgcgccaggggtaggtcagcgcgtcggccacctctcttgcctgtgtccctttaaccttgggcatgagcctgtggctcaaggtc

SEQ ID NO: 499612 - DNA, 173 bp, Homo sapiens
gccggtacctgataagaacaaacaccagaaggacatgaacgagaagtgggtaactcgatggcacacttctcgttcatgtccttctggtgtttgttctgtatcagacactccatcaggtccctgtgagcccataattcagaacttctgccacgatgtggcagataaccagatag

SEQ ID NO: 499613 - DNA, 924 bp, Homo sapiens
  misc_feature (295)..(295): n is a, c, g, or t
  misc_feature (320)..(320): n is a, c, g, or t
  misc_feature (513)..(513): n is a, c, g, or t
  misc_feature (924)..(924): n is a, c, g, or t
taccaagtcttacagtgattatttaacgtgtttccatgtatctcactttggtgctgtatttaaaaaaacccttccatttgtgaaaactctacgtcttgtacagaaagccacatgtgttcttttaagtgtcttcgagaacaaaaaagcctttacatttaattttacagtgttgtgccacctcgtagagcggtgccaactttaaccagggggaggcggccttgagaaacaacgaaatgtggggaggcggcgcgctattttacatctaatttttataacgcaaaaagtgtgttcgccnttgtgcgtcgtgtgtgtcgcaaaancatgttgttacgacattagtggctctcttataaattttgagctaaacacaatattctttcttctaacacaggggtagagaagtcgcttgtggtatactggggtaactccaataaactctccgtgaaaatctcctgggtaactctcttttctcccatatacttattcagacacagtgtgtgtgttttacccaanctttattttgtgggttgtgaacgaggtggtgaacttcgtttttattccccttttcccacaacctctctctctgtgtgcgcacaaaaaacagcagacacaggggcggttcaccgtgccgataagtgtgaacaacgtgtgagcgccacagagccatctctataactttaattttcttaaaatatagttgcgcccctttgtggtgaaagcgcgtggtgttgtcaccccgttttaaaaatacttctgcggggacaattcacagtgttgggcacccccaatgtcggcggtctcttaaacttcgcattggctttaaacagttgccgcgactcacaacaacggtggggcgcgcacaagtgcggtggcgtacatctaaagcaggcgtgctctgaacgccgttcttcacaaagccgccan

SEQ ID NO: 499614 - DNA, 443 bp, Homo sapiens
ataattagcagtaacagcatagggaagggggcatccattggcctggggaagtcaagaatggccaggcaagggagggaacattagatttaaaacttgtgagaccaatggaattaggccaattggaaggacagaaagaattcatttcaggcaaaggaaacagtatgtatggtgttggcaatactatctgtgagagtaagcatttggaagctctctaaacatccatcaataagagatttgtttaaaaaatacacagaatgactaaactgtggaataccatgcatgagttaaaaaagaattaaattaacttgtataaaacgacaaagaaatattttcaggacacattgttaagtgaaaaaaacaaacttcaggacagtgcatggaagataacatcatgtaaataaatcctatacatgaacacaataaaaatactttatatacagata

SEQ ID NO: 499615 - DNA, 1561 bp, Homo sapiens
  misc_feature (405)..(405): n is a, c, g, or t
gagcctcgcctttgccgatccgccgcccgtccacacccgccgccagctcaccatggatgatgatatctgccgcagctcgtctgtcgacaacgtgctccgagcatgtgcaaggccaggcttcagctggtgctgacagatgcaccccctgtggtccgtacttcccacatccactcgtggtgtgctgcccacagtgtctaccagaggactgtgactggtgcgagcatgtggtacagcaagtgattacctcatgtgaggctgacagcaggaccctagacgcaatgacgacggcactacctacactccttgaacgtaccaccatactgatgcactggacattcgttcaacacaaacttgcggacctgcacattggcaccgaaacatcttgagacaaccacacatcacatntactaacaaatggaagcctgccgctgcatggcctccactgacagcgcagacaacaccacagattgaccattgcattgtcaacctgaagtgacacccccacatgaacaaccacccaaatggccccaaccgccgactgacgagacagatagacaccaatgactcaatgtttctgcaagcaccccttctcacatccaacccacacagaccacatggtcacaccgtctaaagtactcttcccacagagacgtgctggacttattctcacctgattcaccagcactactgggacccgaaaacccaaccctggccactacagatgcatagtgcacactccacgagctgaactgcgcggatatagcgcacaccaacttatgcaatgtccccacacacatccctaacccgacaggctgaagctataagcacaccgatactcctacaccttgcccatataccttggaccgactcttggagtaccctgccgcatctggcactagccgaacctgtgcaacatgtcgaaaataccacttcaatacataagttacctcacaaacggaacccggcgaacaatcacaggtcttgcaccgccaccacaccagccccgaatcagcagccacacttccgctggcagtgcctcacataccgctgagaaccctcgtgaaccccgggtaagcccgcagtcacacattccacgactcacacaaggcccccgcacattactacacacagcacacaaaccctgcaacccaataactccaataccacactccaccagcccgtcagcgcccacactcactcccccaccccgacactcgcctcaccacagcccccgtcgcacaccacccacacacatcatcccacaaccaacatccacctacgacccacacctacaacacacactcactcccacccttacactctaccacctactcacactcacaccacatccccccccacctcatccctactctcaccacaaccccacacctcatcactccacaccacgccacactccaaacgcaacacgtccacaccctacccctcacgaacaacccaccatacccacttaagatcccaaactaccccatcctctctcacacactccaaccccctcactctttccctaaccacgtctacctcgacacacacccacccaacc

SEQ ID NO: 499616 - DNA, 287 bp, Homo sapiens
ttgatatgcgccagaaatttgtggagatatttatttttacaaatgcttcctgatgataccataatctcagacaatttggtaaacaacggatagttatctggaacataactttcagttacctctgcagtttttatgtgctgaactactgatcatcctagagataacccactgaaaagtcttctctaatccagttctacaataaggaacgtctttttaccgtttggtttgatataatgtcttccgaagaaatactttacttgcctgttttaatttctgtgcccatttca

SEQ ID NO: 499617 - DNA, 1204 bp, Homo sapiens
  misc_feature (343)..(343): n is a, c, g, or t
  misc_feature (345)..(345): n is a, c, g, or t
  misc_feature (766)..(766): n is a, c, g, or t
  misc_feature (1204)..(1204): n is a, c, g, or t
tggcccgactttttgacaaggctgcggtgtctggcggctattctcccgagccttcgcaatgccgccttagaggacgacaagaaaaaaaagaggcacgcgtggaaaagtctcggccaagaaaagacaaagacacccgaggtgaacaatctccgggggcagaggccaaaaagaaaaaaggtggctccaagaggcaaagttctcgggcacaaacgctctcaatatacacttatagtctctgtgtgtgtgtgtgcacaaaagctatcacctatatgtgtatatacaactctctgtgtgtaggaggagagttctcccaatcttatatatacacttatatatatcaccncncagcagctgtgtgtggtctctctctgtggaagagagcacagctgtgagagagatactctcgagagggcgctctcccgcgggtgcgccgaggggcgcgagccccctctctcgagagagagcctctcccttatagctataagagagacactcttctctctacacagctggtggtctctctccaagaggcccacgagagagcctctcacagagttgtctaatatctcctcacacaccccgcagagaaaattaatctacgcagcagagtgttgtgtgtgggagaatagtgtctctcccagagagttgtgtgctgtgggtgtgaaacaagaatagtgtctgtgtgaacactagttgagtgtcgtccaacacaccagagtgtggtgtgtcacctctttgtgtggggaccaaaacacatatataaaancccttttatattatacacatctcccaaaaaaaccaaacataacacaacaaacaaaacaactctctcgagaggcgacctctctacatagtagcgccgcggggcgcgcgcgagagagacacacagagagcgtgataaagagagacagtgcgcgcgcaccctgcagtgtggccacactatgggcgcgtgggatctctccgtgtgaactccccccgagggttttctctgtcgtgtgtagtaccacaaaagcggggcggcggggaaaaaaatactccgcgcgcgcggggaggctcacccccaccatatattaatgaggggagacgagcgaggaggataatatataaattttccgacaaagataaagacgcgccccggggtggttaaacccccccgtgggtatattggaagactacaaatggagggaggtaagaagaagaggan

SEQ ID NO: 499618 - DNA, 432 bp, Homo sapiens
catgtcatctatgtaaaacacaccttctacaaatccttgaaaaatctcaagttgcccctattggccattaacataaggaccggccgagctcgtccagatactaccggccccgctagttctctacgacctatccaatcccatcagcgagagctcacacagctgcatctggcatgtgctgcatcaggtggtactgtgcctctgtctgacccaaaaagttgacatcttcttcggaagattcttcggtggagtgtcaaaaagacagcagcccccattttgataaaggtctggcaaattagcttatatacctgtcttgaacgaagtgggttaggctcatgcacgtggctcaagtgctccagtatagaaaccagcgagagtaggtatgtaactgccaaagggacggttggctgttgtcggggttctttaacacctgga

SEQ ID NO: 499619 - DNA, 286 bp, Homo sapiens
gggatcccggaattcgggcgggcacaaggagggacacgctaacacaaagtaaagacaactctagagaatacagaactagcagaggccaggcattatggctcatgcctgtaatcccagcaattggggaagcctaggcaggaggatcgcttgaggccaggagttggagaccaatcagcgcaaaatagtgagactctgtgtctaccaaaaaaaagaaacattagccaggtgtggtggtggtgcacacccgtagttccagctactggggagcctggggtgggagaatccc

SEQ ID NO: 499620 - DNA, 281 bp, Homo sapiens
ctccagctggccccaagcatctgaagttggtcttaagatataagccgttttctaaagatgcttccactgcaggggcacagggctatggcagcatttctaatgcccattctgagcaggaacacagggcatgtgggcccaaaccacctccctcccaggggagccagtgtgaaccagggttggctgtaaggacagtcgccaactgtctggctttatggaagaggcgggaaggcccactcagcaactgctctctgggagcgtgtgtccttgggggccagctggag

SEQ ID NO: 499621 - DNA, 265 bp, Homo sapiens
  misc_feature (73)..(73): n is a, c, g, or t
  misc_feature (122)..(122): n is a, c, g, or t
  misc_feature (132)..(132): n is a, c, g, or t
  misc_feature (151)..(151): n is a, c, g, or t
gcgtgtccccactaagaacccctacaaccccgcgaacgccaaaagaaccttcagtttggcagcagttgtttanaattaggggattttgctaagcccgagaatattgacttggccctccactncctgaagaancgggagaaccaatgcactncaccacatcccagatgtcatcacctacctttcgagactcagaaaccagagtgtgtttaacttctgtgctataccacaggtgatggccattgccactttggctgcctgttataat

SEQ ID NO: 499622 - DNA, 715 bp, Homo sapiens
tcacctctagcattcaccagtaagtagaggcaccgcgctgccccagatgacacatgcctcaacgggccgcggtagccctaaccgcgcgaaggtagcataatcacttgttccttaattagggacgctgctatagactggtctccacgagcggttccagctgtctcctgagctcgtgaaccagtgtacactgtacctgctccgtgtaagaggcagggcatgagcacagcaagacgagaagaccctatggagctttaatggatgtaatgcaaacagtaccgtgatcattacccacaggtcctaaactaccaaacctgcatggagaaatttcggttggggcgacctcggagctagaacccaacctcacgagcagtacatgctaagaccttcaccatgtcaatagcgaactactatatctcagattgatccaatcaacttgagccaagcggaacaaggtaagcctctgagtggatagagcagcgcaatcctattctagagtccatatcaacaataaggtgtttacgacctgcgatgttggatcaggacatcgcgcgatggtcgcagccgctatctaaaggttcgtttggttcaacgagttaaagtcgctacgcgatctgagttccgaccggagtaatccaggtcgtttctatctactcaaattcctcctgtacgaggacaaggaaataagctactccagtaaccccccgaaagtagtgca

SEQ ID NO: 499623 - DNA, 274 bp, Homo sapiens
cgatcattatcatgtgaccgaggtggatggcacgaactataaccaaccctaggattagtatagatcagtagcacggtatacgtaatcgctaaaggctaatcactgctgttacccgtgagagagtgtggctaggctaagcgttaagagctgcattgctgacgtgctacatgcttgtcccttttgatcgtggtgattaagagggtgaactcactggaacggggatgcttgcatgtgtaatcttactaagagctaatagaaaggctaggaccaaacc

SEQ ID NO: 499624 - DNA, 193 bp, Homo sapiens
ctcccaatcgtgctgagcctccggaggtggcactgcgtgctctcgcacctcggtacgtgcatgcagtcatgggcagtgcgttgacggccctgacctggtcattggccgacctatcaggtcgtacagcctctgtggaccgcacctgtgtggacagcgtgcgagaccagacgcctggtagtctgacgccgatgct

SEQ ID NO: 499625 - DNA, 170 bp, Homo sapiens
ctgtgcagtccactgaggtggcaagcgaaggactgaacatggaagcattgtcgtgaccgacttccgtgcctgactttgaaatgtgtgactctcctgagtgacgcagtgactgagatagctgtccactccgtagtgtattggttgattaaatactttcttccgatccttca

SEQ ID NO: 499626 - DNA, 468 bp, Homo sapiens
ctcccctctcaccaccccattcaccatcagtctgaagccatggtcctggggcccgcctcctagtgctgaggtctgttctagaccctgagctccagagcctctggagctgcagggatgtccctgtggctctctgatgggcagctagaagacagacctgtgctggaagtctcattcaagggcccagagcaacccggatggtgccagttcttcaggaggttggtgtggagctgtcggtgtagaaacaccggatgctcaggaaaccccagaaggggctgcctaagtggtctctggagccctctctctggagagggctgctcctgtctgcatcccggagagggctgctcccaagccccagtgctgaggagctggcactgggcacggtgtggaggagttacactccggcggctccacctctcacagagatggtgtatagaagcccccaggtggtgtggggtgggtggagagcgg

SEQ ID NO: 499627 - DNA, 152 bp, Homo sapiens
  misc_feature (135)..(135): n is a, c, g, or t
tcgaagagggccggtggcatgtatagaactcatcactagacatcgtactacactacacgtactacgttgtagctcacttccactatgtcctatcaagtaggagcgtattgccatcataggaggcttcattcactngatttccctctattctc

SEQ ID NO: 499628 - DNA, 317 bp, Homo sapiens
ggaacaatacatcggacatgacctcgctcaaagagcggatcatagaccatccgacggatatagtcataatcacgcgtaagatgaatagtcggcacgagctggctaatgccagggagagaaatcatcgatttctctctctgtcaaagtttctggccgcccttgtgcttaaataaatgtcaggcatggacgaatagacgtcaattcattgtgctacatcaagtgcttgtggatgaggtaccaacatgggacgcttgccaaacattgagtcctcctcaaaaatgacaattctgtgtctggtgggatctgaacttgtgtga

SEQ ID NO: 499629 - DNA, 657 bp, Homo sapiens
  misc_feature (209)..(210): n is a, c, g, or t
  misc_feature (261)..(261): n is a, c, g, or t
atattagtgtgttttttgtacttttagaacagttctaatgtttgcatttgaacctatttgtttataagttgattttttttccttcgagataaagtgccttataggaagtaaattttgtctccctaaatttaaaactaacgattttattagaaggcaccattggctgagcatggtggcttatgcctataatcccagcactttaggaggcnnaggcgggaggattgcttgagcccaggggtttgagaccagcctgggcaacanagcaagaccctgtctctacaaaaaaataaaaaaattggctggatgtggtgacacacatctgtagttccagctactccagatgctgaggcaggaggattgcttgagcccgggaggtcgaggctgcagtgtgctgtcttcatgtcactgcgctccagcctggacaacagagcaagaccctgtctcaaaaaaaaaagagaaaagaagccagttttaagggaatattctcctgtgttacactgcaaattggtcctcaggcatagaattaaaataatgtgtctacctactaatttgtgaaatgagtcaatgacttaatggtgtggttaggtcacatttcaggcttaatcttttttaaaccagctgtttttccctagataattgtaagctaatatataagtg

SEQ ID NO: 499630 - DNA, 181 bp, Homo sapiens
taaagaacataatttgtgctctcagaagcttactagttagcagctacagctatggctagtgaagggccagcagcgcgtagggcccagcggagccgtagggcccagagggtacccaggctcaaattcgaaataatggcattggttgtttcttgagttaaaaaaaccgccaatgaaatcatta

SEQ ID NO: 499631 - DNA, 390 bp, Homo sapiens
  misc_feature (24)..(24): n is a, c, g, or t
  misc_feature (63)..(63): n is a, c, g, or t
  misc_feature (96)..(96): n is a, c, g, or t
  misc_feature (202)..(202): n is a, c, g, or t
  misc_feature (207)..(207): n is a, c, g, or t
  misc_feature (214)..(214): n is a, c, g, or t
  misc_feature (231)..(231): n is a, c, g, or t
  misc_feature (273)..(273): n is a, c, g, or t
  misc_feature (278)..(278): n is a, c, g, or t
  misc_feature (354)..(355): n is a, c, g, or t
ctactactactaaattcgcggccngtcgaccatgaagagcctgatccttcttgccatcctggncgccttaggtaagtaactttgtgttatgaatcncatgaaagcatggaatcttatgaacttaatcccttcattaacaggagaaatgcaaataccttcatatcccctcagcagagatggagagctaaagtccaagagaggntccgngaacgcnctaagccgtgtccacgngcgcaatagggaagcctgtgatgactacagactttgcgaacngtacnccatggtttatggatacaatgctgcctaataaatcgctacttcaggaagcccccgaagggaccaaattgagacttnngggaagaaaaaaaaatctctttttttctggaggct

SEQ ID NO: 499632 - DNA, 118 bp, Homo sapiens
cgagagaattcgtggtgctgctgtgtccacctgtacttgtggctgagggctggaggctgacagcaggggtagctaaacaggtgaactttgccaaagatcatcagactgtaagccagac

SEQ ID NO: 499633 - DNA, 127 bp, Homo sapiens
gattagaggatccggtttggctctatcaggggcaggaaaaggattgttgggttcatgaaaaggaggggccaagaggaggcaaagagagaaaagggagagaaccacaaatttgtggcgggggagtaga

SEQ ID NO: 499634 - DNA, 1180 bp, Homo sapiens
tgcccctcatttacataaatattatactagcatttaccatctacacattctaggaatactagtatatagatcacaaactcatatccacacctacatatgacctagaaggaataatactatcgcagtatactattatagctacatctcataaccctcaacaaccacgtccctcttagccaagtatagtgcctatagccaatactaggtctattgaccgcactggcgaagccgacggatgggacctagacacacatacctaggtcatccaatctccgaagcacgagtaatggagcataggacataacgtagcactaagacataagaagctagactccaaagggcatcacgagcgtaattcggtcaccaaaggaaatgaatattcactcagcaacgtggaccatgacctgtgagccaaaaaaaacacaatacaatcggcagtcacagacagcaaccaacacccaaaaggactaacaggcatccagacagataaaacgcccagggagggaaagagagagacgcaccgcagagaacaaaaaggacaacgactgcagcgagaagcccccagacgagaaagccacgggaacgagcaaagagagaacgccggcagaagaaagctaaaaacaaaaactggaaaaagcggagaccacgaaagaaacgacaaggggaaaggaaaaggacaaaacaaaagagcagagagagaggagaagcaagacaagaaaagcgagacgggagacaaaagaaacaacccgctggacaggacgcacagcacgaaggaagaggagacacccggaacagaagggacgaagaggcacacaagcagacgcgacgagccggcaggcacggaacgaagccagacacacgcaacccgcacacggcggagacgagcgaacgcaggagagaggaccacgcacggacgaaggccagagagacgccaggaccaagcgcgaccaagaccgaagggaggaaggaaaaacaggaccaccaggacgaggaagacggagtacaacagcagaagcaaagaaaacgaaaaaaccagaaaacaggaaggacagtaaaaaagagccggagcgcaaacagagggcaaagacaccacaagtgacgaaccgcagagagaaggacagaacaggagtaacgctgagaaacacaacggcgaaaagaagcaagagcaagacgcaaaaca

SEQ ID NO: 499635 - DNA, 477 bp, Homo sapiens
tccactagtgtaggctaagccaagctgatgttcagtaggttaggcatattaaatgcattgtcaacttacagtatttccaacttacagtggatttattaaaacaaaacacacatcataagttgagaaatatttatagttatcactggtatttagcatcaaaatactaaagtgttcatctgaagccaaccctggtaatctggctagacagtttggagctatggccggaggagtcaagtaagggccagaaaagtaagtatcttcaaaccctagaataatgacttcagaacagcctcgtgcagcagaaaatctgatgcccctcctttcttagactgagtcccattagagatcattgaaataaggagctccagagctctcttatttgacactatgagtactgcttcagttgaagggtgaaaaaaattagttaaagtaagaaatcacaagaaagaatacatttacagtgcctacactagtgga

SEQ ID NO: 499636 - DNA, 152 bp, Homo sapiens
gtcagcgctcgacacacaggaaggcttcagttggtcatagtgcagtgaagagagggcggtagctggcacagtcatcaccaggtttgcggttaggccgctccaaagggatactggtgccactcgtgcctcacgatcttcacgaatgcatccat

SEQ ID NO: 499637 - DNA, 274 bp, Homo sapiens
tttacctaagacacagagactcggatttctatactccagaaacatcacaatttttacctcaaaggtactagaagaaagaccaagggtatttattaaaaaacatttttctttaactctggcaattgtctatatgttcctagagaaaaagagggagaacccaatacccacaggcctgccacgctatcatgctaagaggcatctgtgcagatctttatcataatactttcctcaggttatttccaaatccaatttaatggatattcaactgacactc

SEQ ID NO: 499638 - DNA, 283 bp, Homo sapiens
  misc_feature (1)..(1): n is a, c, g, or t
  misc_feature (78)..(78): n is a, c, g, or t
  misc_feature (97)..(97): n is a, c, g, or t
  misc_feature (103)..(103): n is a, c, g, or t
  misc_feature (105)..(105): n is a, c, g, or t
  misc_feature (111)..(113): n is a, c, g, or t
  misc_feature (117)..(120): n is a, c, g, or t
  misc_feature (141)..(142): n is a, c, g, or t
  misc_feature (147)..(147): n is a, c, g, or t
  misc_feature (162)..(162): n is a, c, g, or t
  misc_feature (165)..(165): n is a, c, g, or t
  misc_feature (194)..(194): n is a, c, g, or t
  misc_feature (218)..(218): n is a, c, g, or t
  misc_feature (274)..(274): n is a, c, g, or t
  misc_feature (277)..(277): n is a, c, g, or t
ncgggggcattttcgatgtgtccattttcctaagagatgtgtgtatgagatgcctccgggtttctcatactatatatncttgctttggggggggggnttgttngnggtttnnntttnnnnatgggagacattgcctttgtnngtggnatccctggggttgtnctnggtctccgcttcccccccgagatgtctgngatggggggctcttgagtgtcagngttcgggggtatgggcgttcgccttcgaaagtgcggggggtccccgccttaaccgnccntggttc

SEQ ID NO: 499639 - DNA, 930 bp, Homo sapiens
catgcactgagttactggaagcccttcctggtcaacatgtgcgtggctacggtcctcacggcctggcgcttacctctgctacatggttcctgttcaacagcaacacatatgcctgaccctcctccactccacctccacccactgtccgcctctgcccgcatgagcccatgcccgactagcagtgcatgccgcggtaggtaacgggcctgccggaccgcgtacgacgagcctgggcccctggacgggacgttggttcttgcactaaaacccatcttcccctggatgtgtgtctcacccctcatccttctcacctttttgcccctttccactttgcagtaccaaatccacaagccatttcctctgaggcacgagtgaaccgagagctaccatgctggcggcgcagagggaacggggcctacacccgtcttggggctcgccccacccatgggctccctcccttggagcatcccagtgcgggctgggcacgcccacagcccccccccctttgacattctcgcacggcgacgcaactcttccactcccatattccactctacaacaactcactcccccaaatggcatcccatagcggcactagccattctccttgcaaccaactacatgtcctcacccctccctcggctcgtcagccctttgcctctcccggccctttatccccaaacgctcactaacttcaatccctcggctagcaactggtgaattgcagcgcttcgcccatggggcctgcttgcgtcagcaccagctacctggcgaccgccgacggcttgtcagccctctggccctcccagctcactatcgccggcgctccccgtccgccccgtctccgcccatcctcttctctctcctcggccccctgggctcctcccacccgcaccttcttgtcgctcccctgtcgccgccgcatccccc

SEQ ID NO: 499640 - DNA, 743 bp, Homo sapiens
ttatctgaattgaaaatctatctaggtttccagattaaatttctacctttcatatagagagtttaattttaataaaatgtttaattagagcatccttcccttttattctactttgaacaaatagtaattttaccccaactacttttcatgaagagtgctttgacacaacttacaccggaatttttactcattatggtacaccttatgacgtaccaacataacgttacttctacattgctttactttcgttagttggtcaatttctctttggtacctatgctggtacactaatggtggtttagaactagtctttatgtacactcctgataactgagaaacagaacctaaagttttgccttacattgctaaattggataaacctcatattcaataaactagtaaatgtagccactgtgactgattggtaaatcgtgttaacaaccattctaaaatgttgtaacctaatttacgtgtgaatacctgttaaacagaaaatactggttataaaagtctaacttcacccaggttacccaagtctgtgggcacaatttaatacttgcgtgctaatagtttttactagccttttgtaaactatacatagtgagtgatcattaccttaatattctcgtacgtttagacataatttgattggccaacataactctctgtttacgaaagccttactttaaccataacttttcagtgtgggcgggtttgcaaatcattgtacggttgaaacctgt

SEQ ID NO: 499641 - DNA, 300 bp, Homo sapiens
  misc_feature (43)..(43): n is a, c, g, or t
tctcgtaaagaaatggggggccgggcgcggtggctcacacccnaatattcagcctttaggaggctgaggcaggcggattacctgaggtcaggagtttgagaccagcctgaccaatatggtgaaaccccgtctccactaaaaatacaaaaattagctgggcatggtggcgggcccctgtagtcccagctacttgtgaggccgagactagggaattgcttgaacttaagaggtggaggttgtggtgagccgagattgtgccactgcactccagcctgggcgacagagcgagactctgtttca

SEQ ID NO: 499642 - DNA, 119 bp, Homo sapiens
gatacccgtgagttccaaatggagtccaaatgtcgactgacaaccaagtactttggaaccttcctacctgaggtggacaagaagtttcccaacatgaagatacagatccatgtctcagc

SEQ ID NO: 499643 - DNA, 452 bp, Homo sapiens
  misc_feature (440)..(440): n is a, c, g, or t
  misc_feature (443)..(443): n is a, c, g, or t
aaaaaaaaaaaaaaaaggggggagccgggccgccctttttttaatatacgtacaaaggatcggacaggtcacccagtggacccatttcacccacggctcggttgggccgccagtctttggtctctctcttcagcaagggtgaggcggataccctttcctcggggaagagaaatccagggttggttgccctggccaataacaaaaaggtgggaaagtcgagtggcaaagctgtggccatgggcatctttcacgtgaaccacgtcaaaagatccaggtggcctctctcggtgggtgatcacaccaattcttcctaggttagcacctccagtcaccatacacaggttaccagggtcgaacttgatgaaatcagtaatcttgccagtctctaaatcaatctgaatggtatcattcaccttgatggggggttcgtaaaccagaanggnaagagagct

SEQ ID NO: 499644 - DNA, 127 bp, Homo sapiens
gatgcccaacatggaccctttgggcatcactgcagaataaagaatgtaggccacagaacagcatcatctggtcactcgtatcgaccagtattgtttctatacttttgaagctttcttgcatggcctg

SEQ ID NO: 499645 - DNA, 754 bp, Homo sapiens
aggcaggaaggactcggactcctgtgtccagctttaaacagtctaagtcacgccctcttctgggtcacgtctagaatcactatctgctctccagcatcttctgtttgctggcaagcgtctgctgctactttggattcgtcaccaggggctggagctggcttgcgacaggagcatgaggacttcttggtcagaggactcgcacgactgttgctggtagagaaggatctgccagcgacagggcctcagacaaggacttcataccagatttgagagaggaatcctctaacatccacatcagtaccaagctgtctgtactccaaggagacattctgtatgagccattcctgaactgagcctggcaagacgtctggggcgaaatgcacaccgtctgaatgattgctgtctatgcagtcctcacagagagtccatcttgattgcaaatcgtaaaggtacccacctactgttggaggcctgtatccaagccagcgtgccagtctgcatctacaccagtgacatagatgtagcacgccccaactgctacaaaggaactatgcagtacgggcacgaacaagaatctctgtgactcacatgggcctctctttacccgtgcatgaaaaagcttgctgagaaggatgggctagcagcttatgcatctgaactaaaggagactattactctttgccagcataatgttgcctggacaacatgggagctgtgagtgtggcaaggctctccatcacccatattagtggca

SEQ ID NO: 499646 - DNA, 180 bp, Homo sapiens
ccagacagctccatcaggaaccaagcaaagcccagatagcctgacagataggctagtggtattgtgtatatgggcgggacgtgtgtgtcattattatttgagttatgctgttgtttaggggtaaataacagtaaataattaataataataataataataataaaggagctgacgttctta

SEQ ID NO: 499647 - DNA, 150 bp, Homo sapiens
tgactctagaggaccccaagcttgattgccgtagtacatatcatcacagttgagcatttgaagcaccaggtatgaatccaaaagctcatgccctgttctattggcccttaggggttttaaaatcccttgggcttcccgcaatagattctt

SEQ ID NO: 499648 - DNA, 131 bp, Homo sapiens
acgctcactcggcaaatcttacatctcaattcccatcctaaaaagcactcatacttatatgcatccccgcagctacacacacacaacacacagcacacgcatgaacacagcacacacacgtgcacagcaga

SEQ ID NO: 499649 - DNA, 376 bp, Homo sapiens
  misc_feature (26)..(26): n is a, c, g, or t
atttgaaaaaattagggtagggattnccaaaccgtcataaatttttaaaggccctttttctctccttttttttttttagaaaaggatttttttttaagtcccttatggaacatcccaataatgtgatactgtcttttttaagccccccgtaaaccctttaaaaatttgaaggtgggtcttgactcttaatgcatgtggacaattcccagcgttttattccgtcggggggtttgtgttgggcaaaaccatctgttatttacagcaaaggacattttacattccgttcatggggcccccccaggggaataagaataaaatgcttttatggctaagttgttaacctatgcccatcccctgccttttgggccactttata

SEQ ID NO: 499650 - DNA, 410 bp, Homo sapiens
  misc_feature (187)..(187): n is a, c, g, or t
gccccctgtggtccttctaatctcagtagagaggtcctggtagaaagcacagttttctagctggtgtgtccatccagacatttaaaaaatatgtacatatttatacatgtctgtatctatggaaaatatatggtgccattttgtgtctgggtattttcattctatttttagaaaatacaaatgggancattctgcagcttttctactcagcagtgtttcttttctttcctctgtttttttagaaggaataaatatttaataaaatatcactggaaataaaccactgaagcagaagtcttctagcattttgtttttacaggactttttgacgaaatcgcttaaagcaatatatttttttttcaaaagactggaaatccttttttaaaaaaagaaaaaaacaacgtttttta

SEQ ID NO: 499651 - DNA, 448 bp, Homo sapiens
agtgcagagccttagcctattaagggtgtgtattcctatagtccggacaagactcattctacaagaggtaagtgtaattcagagggccttgcttctactactaaccattctatcttgctacaccccttttccagtagctgtggaccaatgcatctctataaaggcaaatattatccagcaagcagtcaaccctgtcctttgcaattgctcttgtacacgtctttcctgctacaagtgttatagatgttactaccttatttaccccgaattctatttttgtccttgcagacagaatataaaaactcctgggcttaaggcctaaggaagccagtcaccttctgggcaagggctcctatctttcctccctatccatggcactaaaccacttctctgctgactctgtggaagagattcctattactgcagtacatacgtctgccaggggtaa

SEQ ID NO: 499652 - DNA, 185 bp, Homo sapiens
aggtacaagcaatattttagcaaacatgagaagtaggaaaagcctcagcttgacgaggcttttcattaccgttttttctttttcttctttttcgctttcagttgcggaatatcttcgtaaaactttttgttcttatccggctttttcgtcggccattcgtcttcgcctttttgcttgttccgctg

SEQ ID NO: 499653 - DNA, 178 bp, Homo sapiens
  misc_feature (28)..(28): n is a, c, g, or t
  misc_feature (129)..(129): n is a, c, g, or t
aggcgtcagagaaacaccgtttcagggnagtgaaaccatcataggattgacgatcgagtatcccaaaactttaaagtcttatcccagctcccagtcatcacacagctgtacgttggagctttgatccanatggatggttttaacacggagcatcatgctgtgcgatctgtatcgcttg

SEQ ID NO: 499654 - DNA, 197 bp, Homo sapiens
cattacaataaaaagaaatagtgtgtaggggatgttaattcagagattcaaatatcacattttcacttttattatatacaagttgcgaaatagaattgtccatttatatgggattgtattttattttgggtttttaataagttatcttgcttattaataaaacccaagaaatattatgtctttggtccttctctcat

SEQ ID NO: 499655 - DNA, 349 bp, Homo sapiens
agagtaaccctcatcaagaagcttctagcaaggtacactaaccacgaactagactaactgtaccagtgaacgggtactaacgtatcacttgatcctctgaaacgtggttgcgccattgtacacctttcgtaattaccttgagctcagggaggcgagtctgttggtgtacaaagtcagaggtgcggcagatgccttaaaaggcatccctgtcctctccttgtcttaaaagcagtgggaaaggctgcacagaatgtgaagcttaggagttttgtagtacaggatagtttttgaaggtaatttttgtacattctcatctgatccttaaaacaagcctgtaaaaaaggcagac

SEQ ID NO: 499656 - DNA, 171 bp, Homo sapiens
cacgaggccgaccttagctctcaccatcgctcttctattatgaacccccctccccatacccaaccccctgggcaatctcaacctacggcgcctaggttattctagccacctctagcctacgcgtttactcaatcctctggatagggtgagcatcaaactcaaactactccc

SEQ ID NO: 499657 - DNA, 370 bp, Homo sapiens
cgtcgacaaataaggctgctatgaatatagtggagcatgtttccttcataccggttggaacatcttctagatatatgaccaggagaggtattgcaggatcctccagtagtattatgtcccattttctgaggaactgccagactgatttccagagtggttgtacaagcttgcaattccaccggcaatggaggagtgttcctctttctccacatccttgccagcatctgttgttacctgaatttttgatcttagccattctgactggtgtgaggtagaatctcaaggttgttttgatttgcatttcactgatgattaaggatgttgaacattttttcaggtgcttctcagacattcagtgttccgtcgacgc

SEQ ID NO: 499658 - DNA, 226 bp, Homo sapiens
  misc_feature (118)..(118): n is a, c, g, or t
  misc_feature (130)..(130): n is a, c, g, or t
  misc_feature (159)..(159): n is a, c, g, or t
  misc_feature (172)..(172): n is a, c, g, or t
  misc_feature (179)..(179): n is a, c, g, or t
  misc_feature (182)..(182): n is a, c, g, or t
  misc_feature (191)..(191): n is a, c, g, or t
  misc_feature (210)..(210): n is a, c, g, or t
cggctcgacggtgctgcttcgtctaggttgagggctaagcttgggaaatggtgtgattccttgatcgtattcagttctgctctggactatcaaaaaattcctgggcaatatatacccnccggtttccccntccgttagtcgtatataggccaagaaagnataaaagaatacnatgatanaanaaggaaagnaaacttaagggtgaagatntgaatggattacccaa

SEQ ID NO: 499659 - DNA, 962 bp, Homo sapiens
  misc_feature (561)..(561): n is a, c, g, or t
gcacccctccgcgctggtcagtgtggacgcggaactcagcggacaaacgcgattgagagcagtgtgtggattacactatcactggaaaaatacgaattgagaatgaaggacaacagagactgcggaagatgcagcacctctggattcctgtctcagatggtgaacactgtaaggtcccagtagaacactggaaaagaccaatgaaataaatcagtcagttatgaggcagagcctaagagaactatggcaacatcatggtgactgtcccagaaagtgaactcgcacgtggagaagagtcctgctgaggtgcacgtgacggctgggatcctcctgctcacggaagggacgtacacgccagacgcgagtttgtcggccatccgctggacctacgctcgccaccgatgacgacccacgctcagactcttcttgagatggacgaacacaacattcttatcctgagacaaaccagcttgcagaattggcggtgtgcggtgtacggcgttgaacgtgtggcctgcttgtgggagatcacattcccgtgtcgagaaccagtgatgtgcncgtgaaggctaccgttgcgtaatgaatgttgacggacctcgcgatcgtactgacgttgggctaggccatttgaaggtagctaacctttcagcgcaaggcctcacttgggatacctccttgcaccccatcgtccactctatggcaggatagtctggcagaaacaggtccacgacactaactaatataccacagtggttcagtacctcgcatgaatacaagaatcccctgaacggcataaaagtcatcctggacagttggggctgtgggactgggatcatcagtctcttctgtgcacactatgcgcgggcctagagcggtgtacgcgggtggaggccagtgagatggcacagcacacggggcagctggtcctgcaaaacggtttgctgaatcttcgcgtgtcc

SEQ ID NO: 499660 - DNA, 231 bp, Homo sapiens
cggcaccgacattaccgaagagcgccgcgctcaggagcgactgcgtattctggcaaataccgacagtatcaccggactgccgaatcgtaacgcaatgcaggatttaatcgatcacgctattaatcatgcagataacaataaagttggggttgtgtatcttgatttggataatttcaaaaaggtcaacgacgctatgggcatttgtttggtgaccagttattacgcgacgtg

SEQ ID NO: 499661 - DNA, 109 bp, Homo sapiens
ctagtacggcggtgtgtgaatcggtcagttagtcgggaccgcaagttaagtcggtacgcgtattgaattcaagtatatattaagtatgcatgtgaccactagagctaat

SEQ ID NO: 499662 - DNA, 222 bp, Homo sapiens
ccaggcatgtggcaggcgcctataatcccagctactcgggaagctgaggcagaaaaatgcttaaaccggggaggcgggaaaccgcctttgcaaaaattatcacagtgagaaaataatggcagtgaaagaaagctgatctagccaacctccctcttgcctttagctttcaagctgcttttacttattacaacttacacttttacatacaacaggggtaccgag

SEQ ID NO: 499663 - DNA, 829 bp, Homo sapiens
tgtgtgagcagcgggtgcgtgaggagcccatctgccgcggggtgagtccgcttccctccccagggactcgcttccccagccattctgacctaaggcggttagagggatcgagggccgggcgagggatacgtcaggagaacacatccagagtaagagggggcaggacggggggactagagaaaagatgagcgaaagggtgaatcatcgtttcgtctgggggagcagcccgatgactgcgccctaaggtgtgggcgtggcgtaatagtgcgcccgatctccaggcagaaaagagccaagacgggcagggagggcgccgaggggatgagagcagtcggttatgggctcctagccaagcgatgcggttgatggttaatgcaccagaggccctggggttcagacaccctggggatcaaggggctgggaggagctgctggagtggaagtgggtttcccccaaggcttggggcagtcctgcaccacgctagcgcgtcgaaacctgccgagtttcgtctgaggcacggtacgagggtgacagccatccggtcagagggccttgactcatggtccatatgcccgtgaacctacagcacggggcgagggaagacgcggggattgcacgaggcagggcttcgagggaaggtggctaggcggggtacattccaccaaggaggggccgaaagtgggccacggtgcaagggggggggccgggggacagatgtggcggcagacacaagggacgcggcttgcaatggcgcctccggccctggggaggcagccgggccccgacgaaggcacactgggggccaagggtgctggcgcgagaaaagggc

SEQ ID NO: 499664 - DNA, 2929 bp, Homo sapiens
tgagagaccgtgttgcaatgttccgttcagcttggtgtcaatggcctgtgtccacctggcttccaagatagaagaggccccaagacgcatacgggacgtcatcaatgtgtttcaccgccttcgacagctgagagacaaaaagaagcccgtgcctctactactggatcaagattatgttaatttaaagaaccaaattataaaggcggaaagacgagttctcaaagagttgggtttctgcgtccatgtgaagcatcctcataagataatcgttatgtaccttcaggtgttagagtgtgagcgtaaccaacacctggtccagacctcatgggtagcctctgagggtaagtgactaagacttctcctctgctgtccaagcgctttggtgcagggacagcggcatcttcagccaatccagtgcaggctctccaccgaaggctggctctagactggttggcagcggctctgatgagcccgagaagaggcctgactccttgggtgcggagtctccctccgcacgatgctcccacgcgtccaacttgcacccaagcgggctttggtccctcttccaagtggactccttcaaggaagctgcagctcggtcagcagagaaggggcctgccgccagcgccctggaggaagaggaagaggaacccaagaggatggcttgtctcccagcagccacaccggctttgtgctcagccagttcatttgagtttgcatgtttctctgcactatggattttgagcatttagatttctttaatcaaaagcgttttagtgactccagtagacattttctttctgaggcatcgtgctttgcatgagagcaggccaaggttgaggggaaaagtaaagttaaagtcggttctctttcatagcaacacgtattgtctgacattcagccagcttttttttttttctaataatttctgtgcctttctgtcctgtatttactgtatttagaaaaagcagctagaatatttctccattaactcttgagattcacaggactgtctagctctgagtcctagcaatagactccttagaggagtagtacgtttatctagattttctctagataatgcaggcggaagacctgggttcccgggtggggcattgcagttcttcctgtgtttggcttccaggaattacatgaacgacagccttcgcaccgacgtcttcgtgcggttccagccagagagcatcgcctgtgcctgcatttatcttgctgcccggacgctggagatccctttgcccaatcgtccccattggtttcttttgtttggagcaactgaagaagaaattcaggaaatctgcttaaagatcttgcagctttatgctcggaaaaaggttgatctcacacacctggagggtgaagtggaaaaaagaaagcacgctatcgaagagcaaggcccaagcccggggcctgttgcctgggggcacacaggtgctggatggtacctcggggttctcccatgtcagtggtctcaatgtattgactttgtgatcgccctcctcggcgctatctgggatcactgcaagctccgcctaccagattctggtgattcttgtgcctcagcctcccaagtagctgggattgcaggcgcccaccaccacgctcagagtctcgctgtgttgccagtggaatcccccaaagaaggtaaagggagcaagccttccccactgtctgtgaagaacaccaagaggaggctggagggcgccaagaaagccaaggcggacagccccgtgaacggcttgccaaaggggcgagagagtcggagtcggagccggagccgtgagcagagctactcgaggtccccatcccgatcagcgtctcctaagaggaggaaaagtgacagcggctccacatctggtgggtccaagtcgcagagccgctcccggagcaggagtgactccccaccgagacaggccccccgcagcgctccctacaaaggctctgagattcggggctcccggaagtccaaggactgcaagtacccccagaagccacacaagtctcggagccggagttcttcccgttctcgaagcaggtcacgggagcgggcggataatccgggaaaatacaagaagaaaagtcattactacagagatcagcgacgagagcgctcgaggtcgtatgaacgcacaggccgtcgctatgagcgggaccaccctgggcacagcaggcatcggaggtgaggcggggttgcagtgactggtggccgcaagcccttccctggggagtacctgatggctgccctttgacccccggtggctgccctttgacccccgggtgtgctctcagcgcaagtggtcctagaacaggattctttttggaaatgtctgtcgactggaccttggtggatttggaaatggaactgagggaccggtgacacgtgcttcagaccggtctggggtgcggcgcacacctgggcccgtgcagggctcagctcggcagcagctctgagggcagctcaatgaaaaagtgaatgcacacgcccttgttggcgtggcctggcatggcctggtgctatcggcagccgctctccactccccgactgatactcaattacgtgaagccaagaaagatgatttttagaacctttgcctatattaggttgtacttatgtacatattttgcagtgtttcacaggagaaagtggccttaactgccccttattctctctccacgttgtaaataaacatgtgtttaatacaagttaaagctatgtatgaaaactcagaacttgaatcccgtcagcttaaaacttgtgtagggaatcctgacttttaaaatgtgagggtatttggatctgtgttgaaagtcgtatatttttatctgtgcggtgctgagtgcaggccaccagctcctaaatagaggttccctatatgcgcgtatgacatggtgaataaacacaactctctccacc

SEQ ID NO: 499665 - DNA, 264 bp, Homo sapiens
agcgaaatctcatacacggatcccccacgatattcgcccgcaaatatatatctcctttggcattagactagaattccactaatgagtcttcactctatccctccagctagcagtttactgttttgttaattcccctgaagttgacctgctaggacacagaaattctttgctgcctgtatcccttggagtaagaaggtagtggcatgagtggagtgtgtgttctttctccaattctattatgactgtttattaaacacttctgta

SEQ ID NO: 499666 - DNA, 149 bp, Homo sapiens
aaatgtgccacatcttcctcatcttccacctgggtttgaatcactcatcggtttcttctcctgagtcatcgctgctgtcattggcattcccctacccggatcttgccttcctccttcatcctctccaagtaggcttcagcctgtacaag

SEQ ID NO: 499667 - DNA, 1354 bp, Homo sapiens
  misc_feature (555)..(555): n is a, c, g, or t
gcacgtaccggcgctacggcttcctgcaggctgcctccgcgtatagctctcgccgagtagcttgttctcgacacgtcacaggacaccctgcagccctaacgatccaagccctcacccgtgggatcgctaaggtcatcggcaagtcagaccccctgctgatgagttacccagaaactgcaaagggctccgactgggtcccgacggggtgtcgcggagaaggtcagggcagcttttatcaggacgatcctacactagcttctaactgtcgctggaaccccgcgagtcaccggagggaccgccgtactaacgatggaggttccagctgttcaacaactgctacagttcgcggttcctaaggccagtccatcaatcgcgcggagccgtcacctagaatagggccgaggggtcccttgcgacatgcacctacacgtgtgccgcatttgtgccccgtgtgcgaagaatggcgtggctcagtctgtcgccacatggcttttccgcagtcactacctgcttaggggccgcgcctgtctgatggagcgatgcacaatggctttncagcatttgcccacctctgtgacagctgttccctttgggcctgcgatctatgcgctgcgcagctgcggcgcagcgccgttgagggcttcggccctctccccgtttacagcagctgtcggcatggtgtggcgccctcattgacctttccaggcacgagtggaacccttgctgagctttcacccgaggccagcacgccctgtgcacggtttgctcgtcgtgtggcctttctgcgggcccttcccaagcgggcgcccagggccccgcggggccccaaagtgcgccccgcggcatgggtcctcctttttgagtgtacggcgagaagctcctagaagaccccatgaactcaaagggggtggattacccaaggggggccttgctttgggcttccctcttgggttggcgcccccaagaaatcgccattccaccagaatgggattgcaacacggcaagcgggcggcctcatttttgttgggtatatgggcaccctcggagcccttttggacttaggccctgggcctcaaatagggaggcccccccattgtttgattctttagaacttggggctaagaaaggggggttttagcctttgcaagggggatggaaagcgcactgggacaaggttttcttggacgcctctatataggggtgctcaattggccccttttggcttggctggaacgaacaagtgtccactctggctcttttgggggagaagaaacctgaatcactgggacttggttgggcccagcatttggtcacgccttgacgagacaacagaaggtctacgcaaggaatctca

SEQ ID NO: 499668 - DNA, 415 bp, Homo sapiens
cagaggttaccgaatctcgaaagtggtgcaaagcacgataggtgacttactaaatgccaaaagctctctgactggcctttaaaaaaaacaacaacactttagcaaagaatattcagattaaaaaaaacagaaagggggctgggcgtggtggctcccaccggtaatcctagcactttgagaagccaaggcaggcgatcacctgagctcgggagttggagaccaccctaggtaacattacaaaaccccatctctactaaaatacaaaaaattagccgagcatggtggcgcatgcctgtagtcctagctactcaggaggctgaggcacaagaatcgttggaacctaggaggcggaggttgcactgagccaagatggcaccactgcactccagcctgggatgcacaattggtcgagatt

SEQ ID NO: 499669 - DNA, 313 bp, Homo sapiens
atagcacaactagggtcagttttgcaggtggtaagccatttaccaagatagttgtaggtaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 499670 - DNA, 321 bp, Homo sapiens
gtcgacgatcacctgaagtcaggatttagagaccagcctggccaacatggtgaaatgctgcctctactgaaaatataaaaattagccaggtgccgtgcatgtgcctgtaatctcagctcttggagaggctgaggcatgagaatcgcttgaacccgggaggtggaggttgcagagagctgagattgtgccactgcactccagcctgggcgacagagtgagactctattaaaaaaaaaaatgaaaggagagagagatgaaagaaagaaagaaaagaagaaaagaaagaaagaaagagaaaagaaaagaaaaaagtcgacgcgg

SEQ ID NO: 499671 - DNA, 172 bp, Homo sapiens
gaggatccccatggaagaatgtgctcattctattatttcactacaaacagcatagaaagcaagggaagtggggaatttattctaaaatagaagggaggtcgtcatctacagcagcactcctcactcctcgtgtgccatttttagcaagtactcctgggcacattcttccaag

SEQ ID NO: 499672 - DNA, 576 bp, Homo sapiens
acgtgagtttatttagatgtagggcgtacatacgcaggttgttacgtgggtgtattgcgtgatgctgaggttgggatatgaatgatcccatcgggccaggtggtgagcatagttcccaagagttagttttttcaacccttgaccccttctctcccttccccccttagtagtccccagtgtctactgttgccatctttatgtccctgagtacctgtattagtctgttctcacactgttataaagaaatgcctgaggccgggcgtggtggcagatgcctgtaatctcagctactcgggaggcaggagaattgcttgaaccctggaggtggaggctgcagtgaaccgagattgtgccactgctttccagcctgggcaacaagagcaaaactccgtcacacaaaaaacacgaaaaaaagaaaaaaaagcaattccattatggggtatatatcccaaagcgaacaaagtattataccaaaatgacatagggccttgtgtgtgcctggcggcctattcacaatagcaagaccaggaatcaacgtaggtgccgtcaatggtggcttagataaagaaatctagt

SEQ ID NO: 499673 - DNA, 420 bp, Homo sapiens
agcaggaggggtttgggcaggagctttatgctgaagaggttggctaaaacatacatattcaacaggctacaggaggagctatgaatattcatgtaggtggttgcagtccatgcttattgaacaaacatgtgtggaacatatgatcccagccgggcatagtggctgatgcctgtaatcccagcacttggagaggctgagacaggcggatcacctgaggtcaggagttcgagaccagtctggccaacatggtgagaccccatctctactaaaactacaaaattaaccaggtgtggtgatgcatgccttttactcgggaggctgaagcagaagaatcgcttaaactcgggaggcggaggttgcagtgagtccagattgtgccattgcattccagcctggacaagaggagcaacactctgtctc

SEQ ID NO: 499674 - DNA, 142 bp, Homo sapiens
cacgccaagtcatcgtactttttgctaatttgaatgtctgtttgctattgttctttttaccacttcttttccaaacaatggaatgtatatattctatttttgtagttaacacttatttccatgtcaaatttacttggaacta

SEQ ID NO: 499675 - DNA, 718 bp, Homo sapiens
agcggggcagaacgcagctgcgtgcggctgcgaggatctcgtgggggcggagcggtcgccgctgccgtcgcagctcgggtcgggattagaacgattataaactccgggtggacgacgggcggcggcgttgcaatgtgtggcggaagcgctgggggtcagcggctccgtgcgccggcggacatctcggcggcgtctccatcagtatgaattagtcgcgggtcgtgggtgcccacggagacccgctgagcataaagggccgagagcggtggctggtggcgcctgggagcgtgggctcagacgtctaggccagcgttcggcggggctgtctgctgtcgttcgagcgatccgtcctggcggggacccgcgactgaagtctcgacggtgccctctggacctgtgtgcgcggtgaacccgggctggagtttgggcgccgggcacctgatgaactactaaccaagctatctacgggcttggtaccccctgcccctgcagctagagcggagaaacgtatgaacttctagacttccgccgagtccgggactccgtcgactgtggactacttaccaggctgaggggtagagtaggcggacaagcgggtgggggagcatcccttgttgctctgcaggccgacccgagcgtcggccctgcgctgggtccccgactgagactcggggggaccggcggaagcaagaggaagggtaacccggggcaaagggac

SEQ ID NO: 499676 - DNA, 605 bp, Homo sapiens
tgacgaggccacatgtgcgtgagcccatatgggccacacctgaggaagtgtgtcttgtgagaatgtgatgacacccctgtttccaagagatagcagcacacatggaggccatggtgggggcctgtcatggggtccttgagggccacagacaggctgagggaaggataggtgggcactgtccacaaggggcctcgggggaaccggttccaagacagacttatagcttgaccccgttggcgggctctgtgttgaaccacaactcatttaacaccttctcttgcgttatactcgggtgcctctttcatgtgaagggccttagacaccctgttataagggttggaccaaaggtctgtgcttctggaagccaaagtgcggacatatggcttgggctcttcttctctctggggttcttgtgtacttaggagtgacacagaggtcaagcacagaatgtgggtctcgcacgctatggacctcaaggagaggcctctgttggccttttcagaaaggctgtaaatgggatatgtggcgggacatcttctctgacgttacactataccttttgggtccgggcactgtgcacttttttatagagtcactctccggtg

SEQ ID NO: 499677 - DNA, 109 bp, Homo sapiens
gatctgatataatggtaccacagccaatggaatccagagtaaagtacaaaaacgccaccttttattgtcctgtcttatttcgcgggaaggagggttctactttacacat

SEQ ID NO: 499678 - DNA, 544 bp, Homo sapiens
  misc_feature (92)..(92): n is a, c, g, or t
  misc_feature (119)..(119): n is a, c, g, or t
  misc_feature (123)..(124): n is a, c, g, or t
  misc_feature (318)..(318): n is a, c, g, or t
  misc_feature (376)..(376): n is a, c, g, or t
tatgagctgatgaattgtatagtggtgaagtctgggcttttagtgcacccgtcacccgaatagtgtacagtgtacccaatagatggtttttnaatctccctccttttttttttcttttnaatnnaaactagaatggccttgtctgctcctgagactcttcatattccccacagagctaaatccaagctcagcatgatccacagtccatgtgatctaagtcctgcctgcatctctccagctcccctacccagtgcttgaactgtgcaagttacctaaaattcttgcacttagcagcgtattttctgcctgtcagttttnggctcacactgccctgattgtttaggatgtttgccatccacatcctgtcctctcaccntttctcccactccatttacctgaaaactggtatctttaagtcttagctcaaaagtctcttctgtgacagttttcctgacatctccgtcctcctgataaggccatcacctctccctctgagctccccacggtaccatggtccccgtcgtcatccctgcattgcggccgc

SEQ ID NO: 499679 - DNA, 154 bp, Homo sapiens
agtgcagaagatacctaaaacagctaaacacagcgtcagcttgtacagacactactacgactcctgcctgagattttcaggtttcaacacaaaacaaaaattagattcactgtttccagtcctacaggaaactcaggtcctttatttatctagc

SEQ ID NO: 499680 - DNA, 669 bp, Homo sapiens
ggcatcctcaattgtagtgagtcttcatttctctcatgttgcgtgacccttgaagctcaacatcgcgcttctgttcactttcaacttcaccttcaagttcacgaaccctggcccccaggtttctggatctgcttcttcccacccttcagtgccagctgctcagcctcatccagacgatgctgcaggtccttcaccgtctgttccaggttcttcttcatccgctccagatgggcgctggtgtcctgttccttcttcagctcctcagccatcatggcagcatcagtgatggccttcttggccttctcttctgcattgcgggcttcctggatgatgtcttccacctctccctggatttgggaaatgtctgtctccagcttcttcttggtgttgatcaggctggtgttctgggtgtgcaggagcttgaacacgctcactggcatccaggagctcctgttctgcgattttcctgctcctctccgtctgttccagagtggcccgcagctcctcgatctcagcctgcagcaggttggctctgcgctccaccatagccagctgttccttcaggtcctcctgggtccggagagcatcatccaggtggagctggtaccttgaggatggcgggacgagtcgaatcgaatatggctagtgtctgatgtttcctaaacaaaa

SEQ ID NO: 499681 - DNA, 181 bp, Homo sapiens
gtggggggcaaggggaggatagcattagggatagcaaaggggaggatagcattaggcaaaatacctaatgtagatgatgggttggtgggtgcagaaaccacatggcacatgtatacctatgtaacaacctgcacattctgcacatggatctcagacttaaagtatataaaagaaagatggt

SEQ ID NO: 499682 - DNA, 124 bp, Homo sapiens
cgggccagtggagaagactgagtaactaatggatggcactgaactgacgactgacggtttctcttgaaggagagagaaaaagagatttaaatagtaacaattataataaggctgggcatggtgg

SEQ ID NO: 499683 - DNA, 715 bp, Homo sapiens
ggagagaacttagtctcgacttctcttttttttttcttcaatccccattaattttgggccctgggggggatgtcatcttttcaatatgaaaaaaagcagcaagtcaaataaaatagaattcccaaatgtggataaaacaaacccaagtgtgtgaggggggaagcaaccgcaagaggaacaattgaaatgtggaaaaacgcatggaggagggttcccctctccttcgtggggactgactcaaacacgtgatgtggcagtatccaccagttccagagttcaggggtgtccatcccttttcgggcagtccaaaagggtggggatcaagagcacgttctggaggctacgggcaccaaggctggtctctttccccgcttccaacaacccccttgtgatcccttcccctcgtgaccccccggccgacaaggaccctcgacgctgacggcgacggacacgaagtccgaaaaccggcgacccggaactcccacctgcccacgcctgtggccagcacgatcccctcctccacgagctgccaacccccctgtcggccacacctctgcaaccgctggcaccaccctccccctgcccgcaccccccctccccttctcaacacctcaccacggcggcacccctgcgaacccccccccccaactcttacctcccctccaccaccaccacgggctctctcccgctaccccccaacaacctccgccaccgg

SEQ ID NO: 499684 - DNA, 494 bp, Homo sapiens
  misc_feature (449)..(449): n is a, c, g, or t
cttctagaggatcccgaaatgtcgtggctatatgcggcacatgtgtgagtgtcttcctggctacaactggtgataactcgtgaggacgacgtggactgagtgtgcctcccatgccctgccagcacgggggttcatgcattgaccgtcgtggccctgctatcttctgctccgtgtcccgccaggaagcgctggggcgtgctctcgcgaagattaagtgaggatgacgtgcggcccaggcccaccgagtggactcagggccccggtgcctacacaatggcacctgcgttgacctggtgggtggttaccgctgcacctgtcccccaggatacactggtttgcgctgcgaggcaaacatcaatgagtgtcgctcaggtgccttgcaggcgggaaaaacccgggactgcctgcgggacccaggcggaggttcccgttgcctttgtcatgctggntactcaggtcctcgctgtcagactgtcctgtctccctgggagtcc

SEQ ID NO: 499685 - DNA, 288 bp, Homo sapiens
tcactagcctcatgcagacgttgacaagtaaattaattatgactaaatacacggtaacatagtctgtgccgccacagttgaagtgctcaggagccacaggcagctggtgccactatagaggacagcacagctagagaagggttccatcactgcagacagctcttagcgcggtcagtgtgcagatggatgagccagatcgtcaagcagggggccctgtcagactctccagcgcctttgtgccagtttcaaaaggctttatctctgggcaggtgcaacttcttgccaagg

SEQ ID NO: 499686 - DNA, 175 bp, Homo sapiens
ggtgacagagcaagactccgtctcaaaaaaaaaagggccattttagatgacactactttaagtaatgtaattttgggcttaggggagcttgtttaaaataataaaatgcattggaggccaaaacagatggttaaatcatgattttacaggtgagacctggatttttacgtgaagc

SEQ ID NO: 499687 - DNA, 1103 bp, Homo sapiens
tgtgtcttttcttttgatactgaattcttgaggtttgtgcttatttcatcatgtgtgtatatgtgttgttcgttctaaggttaactgtggcgtgtttcctatcgtttgtctgtaatccctgcttcagggtagtcctatatttcagcttacttttctgttgatgaagctgaattcaggtgattgtgggctggtcaatcccttgtggctcgcattcttcctcatcgatctgttggtaattggaatatgcattctattctgtgtctcttactatttaatccatttgtagaatttggtgttattgtgaccccttatgtttcgctctattaagtctttctttccgtctgttcagagcgcctttatttataggctgacgacatgtgattcagataaagagtctacaagtgatgaagctgtccagctcgttataaccgaggctgcgttttgcttattggtcattcgcagcaaagtatggtttagtcataaattagggagttcaagtattttagaatcactccgttccctttccctgtctgctcctggagtgtttgaaggggccacgagcttatttcgttctcttgctttcttgttctttttgtgtttcttgcttgttactgttttgctggtcgcttgaagaagtgcgtgttaaacaatgagactaatcttagaacacttccattgaccttcttgttgcctgttcatttttgtggccaaggaagtagctttccccagtgtatgtcttgcagttcgtccgcgtctatatgcttggatagaggagacgattgcatgcagagcagtctctacgcttgtcgtatgtgtcaatgtatatctacttcttcttttccaggacctgacagaattcagggaagagtccctgggtatatgtccacacttagcaccatgcaaattgttggcgatgtggatggatgtgtgcataagagagagagagaatatgtgtgtgtgtgtgtgcgtctgcgagcgcacacacatgcacaagtgcgaatgagattgcggttgccttcatgttctgaggtatagggcaaattgaattgtgcactggtggtctgtctgtacagttactcatgtctatggaattggtttagtcc

SEQ ID NO: 499688 - DNA, 304 bp, Homo sapiens
tctgataggaacgaaacaatagtgacagtatgtttctgaacctgtcgctgcagtatagcgagtcagcgttgccgtaataatgtcatcacgaaaacgtacccactgcgcggcaggctcaatagccagctgattttgtccaggtattgaggatcatccagagtatcaagctgcgccagcagcaccgtgaaaatacgtttccacaaccagctactgtcgggaatttgcgctattttctctaaagatgatagggagttgctctcaccggaaagtagttgttgtgatatcacaccgccagcctgaggcg

SEQ ID NO: 499689 - DNA, 380 bp, Homo sapiens
tcccaaggaatgagaaatagaaaaacataaaaagaaacgccatagatacaaagtccaaattcttactttatggatgtaaaatgtaccaggtagctacaagaatacaccacggtatatacagccatgctcaagacagtggttctttgtgtaggtagtacaacagtgtattgccagcctacaggaggaaaggccagactcacagaagggtgtaacatttagaagaaagcaacactaatgattcaaacagcttcctgaattttaattatagtgtagtctcacagaaagccttatcataaattccataattctaattaatttaccaagataatgtaattacatttggtaaagtaaggtatacagcagttcctcatccttggaag

SEQ ID NO: 499690 - DNA, 709 bp, Homo sapiens
  misc_feature (16)..(16): n is a, c, g, or t
  misc_feature (37)..(38): n is a, c, g, or t
  misc_feature (51)..(51): n is a, c, g, or t
  misc_feature (56)..(56): n is a, c, g, or t
  misc_feature (89)..(91): n is a, c, g, or t
  misc_feature (93)..(93): n is a, c, g, or t
  misc_feature (96)..(97): n is a, c, g, or t
  misc_feature (99)..(99): n is a, c, g, or t
  misc_feature (112)..(112): n is a, c, g, or t
  misc_feature (119)..(119): n is a, c, g, or t
  misc_feature (124)..(124): n is a, c, g, or t
  misc_feature (137)..(137): n is a, c, g, or t
  misc_feature (156)..(156): n is a, c, g, or t
  misc_feature (158)..(158): n is a, c, g, or t
  misc_feature (162)..(162): n is a, c, g, or t
  misc_feature (165)..(165): n is a, c, g, or t
  misc_feature (168)..(169): n is a, c, g, or t
  misc_feature (175)..(176): n is a, c, g, or t
  misc_feature (183)..(183): n is a, c, g, or t
  misc_feature (317)..(317): n is a, c, g, or t
  misc_feature (324)..(324): n is a, c, g, or t
  misc_feature (338)..(338): n is a, c, g, or t
  misc_feature (343)..(344): n is a, c, g, or t
tgcgcaggagccgcanggccgtaggcagccatggcgnncagccggaatggnatggncttgaagccccacttccacaaggactggcagcnnncnctnngncacgtggttcaancagccgncccgnaagatccgcagangtaaggccggcaagccaangncgcnccncannctccgnnccccgcntcgggtcccatccggccatcgtgcgctgccccacggttcggtaccacacgaaggtgcgcgccggccgcggcttcagcctggaggagctcagggtggccggcattcacaagaaggtggcccggaccatcggcatntctgtgnatccgaggaggcgnaacanntccacggagtccctgcaggccaacgtgcagcggctgaaggagtaccgtccagagctcatcctcttccccaggaagccccatcggcccccaagaagggagacagtctgcagcagaacctgaaactggcgcacccagctgaccggaccggtcatgcccgctccggaaccgtctcatacacaaggagacagctcgactcactcacctgaggacacagaagattcccacgccttcgctcactcttcgcatggcccggccacgcccggcatcctccgggatacgggcacccacgaccacgggaaggcgcgcacacgctgtcgacacgaacgactccagccctccggcgcactggcaacccaaaaccaacc

SEQ ID NO: 499691 - DNA, 1039 bp, Homo sapiens
gagacgccggacccgttgtgagcggcagagagcggggtcgcagcgcagttatctgtccctggtacctgagaccgccgcaaaggatggatccgctgcgctcggggaacgcgacaatgtgcgctcgtggtcccgaacctgaatacctttgcacaatgccacaggatagttcccccagggacgaacccagcaaagcagttctcctaacatggagctctcgctcaactggtcaagtagcaaagacctggacagtacctcttcgtgcaggtactggtaaacccggcgaggtggcgacatcgcaacgggcctcatcatttgtgtccacatggagccggagagtacagtggtcgctatgaagagctggctcgtatgctgatgtggggctggaactgcgtggtgttcgcccaccgacatgttggacacggacagatcgaaggggacgaggattgcgtagctgtcttgacattaccgacgttgtcccgtccacgggcattgttgttaggcacgccattgctgatacttccgatgcaacgataaggacgtaacgcactggcggtatactgtcgttccattctggagcacgaattctcattggcgagagcggccatccgacaattcctcaacggcccaggaatagaaagccgagagtccaatttggccgggtcatggtactaccatgtcgtccatctgagttgctatgaccatatcctgaatcttcgagaacaaatcttcttaggtcccttgcgtgagaaaaacgatgatcaattcgtagagattgacaaagttggttcattctagtggcaatcaacattcgagagtggctcgtcttagggagtaagaacgagggtgaattaataattagaagcacaagtaattttgcgggacaaggattgagggtgtgatcaggatacaagtggataaatgcggatagggatgaaggagagacccaaaatagtgggacgaagtgtcaaggattgagatgagctatataaaacatgggatcagtatgaatagaaagcaggaaagcttaatattaggagaa

SEQ ID NO: 499692 - DNA, 222 bp, Homo sapiens
gagacaaggtcccggtggtgatacgatggccaccaagatcgacaaataaggcttgccgggcgtcgtaacaactggtgcgcgacgaacggctcggccgtcatctgggtgacttataaatatgacggctccaccaacgtccccggcgagcaagggagctgagtaccagcacttcatccagcagtgcacagatgacgtccggttgtttggcatccgaatacacca

SEQ ID NO: 499693 - DNA, 844 bp, Homo sapiens
cattcgagcttgatgtggggaggggtgtaaaagcggtcggctgagggtataattgtctgggtcgactctaggaggtctggtgagaaatagtgtaaatgtcattaaggagagacgggcagatatagatatgctcgggggagtcgtatgaatagtataatatgaggtggactggttgcacttcttacttctgtggaaatgcgcgtaatgtgtccgcagatcctatgaggcgacccaatgacatgtatgccctgcactaaattggcttaacgcaggagttaacttgttgcccgtcagactcgagtgcacctaagtcagcaagacagtccctcaaccaggtcctctttcatccagaatcaggctctacgattcaacatcaaaggaccgtttgcagtgctcaattgtgctcgttccacaggctatctctcacagggccctggagtgcggcacgacaaaaaagatcgccaatctcggttaatcttcgtactcatgagaaaaaccacctttagtacacaggaggcatgctctgatacttctataaccacgttgaacacgaccagacgtgtgtgcactcacttgttgcgtaaagtactatcactgaggctagggtctgtaacgagagtctcttcccgagctacctccgagttccatgcccggaccctgggccaaccaggaaggaaactgagaatgaggtcccaggagcgtcttggctcagagaactgcccgatcagaggacggagggagcgtactgtcaaagaaggaactgaccgcaggaatggatcttctcaagaaatgaccgggcgatgggcccctggggactggtttactggacgcgctaagtggcaaa

SEQ ID NO: 499694 - DNA, 100 bp, Homo sapiens
gcggaaggagcacctgacctcaggatttgaggctacagtgacagtaagctatgatggcaccactgtgctccagcctttgagatagcaagaccccatctcc

SEQ ID NO: 499695 - DNA, 787 bp, Homo sapiens
  misc_feature (214)..(214): n is a, c, g, or t
  misc_feature (324)..(324): n is a, c, g, or t
tctgggagcccaacaaggaaagggcctcattccctgtgcggtaattctctggggaatgttgggttccatccaaggaattggggggctctctgtgtcaaccaactctggatcccaaggattctaagttcccctgtgcctcctgggacaaggtgtgttccctggaaagaaaagcaaaggtctttgtggtctcccctgaagaaaggcaatggttccntcggtggctggtcatctttgtgctgggttccaacgtggtgtgccgtgtgccctccaaggcttggtaattataaagtctcctgtgggctgtgacccctctgtggggtgtgncccgccggacttccccaaggtttccacctactgtggtggttcatggttcagaggcactatttggcacagtggaaaagagccaacttaggtgggaacagcatagggaaacagaggacacaaataaaaaaataacaacacaaataaagaaagaagaaacagaacaaacaagaaagaaataaacacaaaataaactcgcaggggggtggggcccgggtatccccaaattcgtgcgctaataggtggaggtcggtatttacgacagttcacgtgtggccggtcgagttttacaaacggtcaggtgaactggggacaaacccgtgtggcggttacccagaagttaactctggcgttggcaaggaaaattcgcccattataggccaggatgagcggtaacttgccgaagggccgggaacagatatggccgtttccagtttgtgcagagcttgaatgggcgattgggctt

SEQ ID NO: 499696 - DNA, 694 bp, Homo sapiens
  misc_feature (256)..(256): n is a, c, g, or t
  misc_feature (368)..(368): n is a, c, g, or t
gatcggtttgcagacgccactgctatggaaaaacgtgtactattatatatggtcaaacccaccgtgttcttcgaaattgccgtcgatggtcgatgcccttggatctgggtctcctttgagctgtgcgctgaccaggtccctcagacagcagataattttcgtgctctgatcactggcgcgaaaggatgtggtcgtcatgggttcctgctgttcagcacgatacttacttccatgcggtatactggtgctcacgcgnttcggctgaccgttctccatctgtaccataatggacacctaggtggacaagagtccactctactgtgggcagacaatttcgacatgagtgacgacaccttcgagtcctaganagccattaccagggttcctcggcactacttgttccaatgtgcatacattgcctgtaccccaaatacataatggcgttacccatgctttttatcaatctggcgacgtagcctagagaactgacgttggtgtggagtcggcatacgcagttgtgtgctgctccgagcaagaagtgaccaccgaatgcgcttgtacatatttgtcggtcggccaatgagaggtcgcgttcggcgtctcaggatagtggccaagaatctagcgctgaaagatcacgcaatgttgctgcacctggtggactaatctccgcaatacccgtttgactccgtgt

SEQ ID NO: 499697 - DNA, 234 bp, Homo sapiens
  misc_feature (94)..(94): n is a, c, g, or t
  misc_feature (121)..(121): n is a, c, g, or t
  misc_feature (136)..(136): n is a, c, g, or t
  misc_feature (156)..(156): n is a, c, g, or t
  misc_feature (184)..(184): n is a, c, g, or t
  misc_feature (217)..(217): n is a, c, g, or t
  misc_feature (219)..(219): n is a, c, g, or t
  misc_feature (234)..(234): n is a, c, g, or t
gatcattggctatgacagagaacccgtctctcaagcagcagctcttctcctatgccattcttggctttgcctgtctgaggccatggggcttttntgtttgatggtcgccttcctaatcctnttcgccatgtgaggntccatggggggtcaccgganctgttgatactgcaactacacaccattnttggtgctggggtgtgttaagatttaaccattnancacaacgtttctctn

SEQ ID NO: 499698 - DNA, 148 bp, Homo sapiens
tccccctcccaagcatgagaatactgcctctgaaatgtgtatgtcaacacagcacaccttaagaatactcaggaaaagtatctaataggctctacaagtatgatcacaacttagtgaacgctatcaatgcaattcctcatccttggag

SEQ ID NO: 499699 - DNA, 434 bp, Homo sapiens
aactctgccgtgcgccagctgtacttacttccacaagaacttcggctgaagatggatcccaaagcccaaagggtcccatccaaattctgcccggggccctgcccctacatttggaacctggacaccagttcacaaaggttctggccctgtacaacagcataaaccgggcgcctcggcggccccgtttttggtaccccaggcgctggaacccctgccccttgtgttattcgtgggccccaaacccaaagtggagcaactgtcccacattattgtgcgctccttcaaattcaactaaggttccgccccgccccgccccgccccggcagggccggccccccccccccccgccccccctgcctttcccatggggggtgtatttaaggacacccgtgccccaaacccccctggggcccccttaaaaatggagagaggga

SEQ ID NO: 499700 - DNA, 850 bp, Homo sapiens
atggctcctgcggcgcaagtaggtctacaagtaggctacttccccgtatcggatagaagacgctatatcgagcgtttcatgatcagcgccctcgatacagtcattttgccttatctgtattccatagctcactgttatgctccttttcctaacgagatcacaacatgaactataggtaatacgtaacatctcgagacgcgtcaggaaatggcagaaccggtctgagacatatcatgaccgccatcatcctaagtcctcatcagccactcagtcattcgctagggcatcctatatacataactcaggacagaatgagtcgaaaccgatcaccttcactttatccatcataacttaattgtgggaagaccaaaatgagtacttgagaggactactgacgttccggcctgaatgtaactggggtgtcgcataacactgcgtttcaatcctcgcttacaattagctttccggcagcgcattataagttcccttagggagacctcacgtggcggaatcgtagcagagattcgttattgcaacgttggcacgcacttcttgaggttagtgcacgtcccccgcattcgccatggacccccctcatgtcgatgactcaattctagtcacaatttactcgggaactgatacctttggccccattccattcgacagctggggaacgcctagcacgtgttggggggcctttagaacaaaaacaaaggactggcagaaatcccccggggaccggttcttagaaactccatcaccctgaccttttgagcctggctttgcaccagagccgggacggtagtagtaacgtggatcgaatgctctgtgaaatctagtggccgcatag

SEQ ID NO: 499701 - DNA, 138 bp, Homo sapiens
tctagagtatccctttctcatggagccacaggctcactgatgcatccacacggctggggagaggcgtcagtgaagaccaggtcctccaggccctgctcgacgactttgattacaaactccgtgccgcagcctcgtgcc

SEQ ID NO: 499702 - DNA, 426 bp, Homo sapiens
aatagctgataacattcatctgtggttatgaatggcatccactgggcaaagtcctttgaagcagcagtgacctttaatgagctaaatggaacctgactataaacgcaaacctagccaggggaccttatctgcaagacaggatcaggaggcagagaagctcccagtattaaggtgtgaggttgacttatgcaatacatttgagcatgtcatttgttcttccagctttctccccgtttttctaaattgggagtagcaataattttaaactctgaaaatataaaattccctcagaagtaccttattcttatatattagaaatcactactgttaggaactcttttgaggactggcttatgacaaataaagaattctctgcatcttactatgtttttagcaatagataattaaaatatattttgacaactc

SEQ ID NO: 499703 - DNA, 104 bp, Homo sapiens
aagcgttgtcacggtgcccccaatggagatgatcttggctggagtgctatagaccaggagatggaatgagagacacatccagctttctaaccctgtcgcaatag

SEQ ID NO: 499704 - DNA, 1140 bp, Homo sapiens
cgatgctttacgttgtttctccccggcaggcactttggttccggcttgggaacctcgccctttggggcacctggcggtgtgttcctcgcaaaggggtggagtctcccgttttttttatccgagacctacgtgggcgagggatccttcctgtgtgcatgctagtttatccccgcgcgaattatttgtgcgctggggcttttctcagcggcgggcgtgggcctcctgccacagggggtaattccggggggaccccctggtgccagacgtgggaagccgaatgggccggaatctttcacagcccgcgtttggtggaaacttgggggaaacgggcttgcgctcagagggaacacaagcccaggcctgttaacaacaaagggctcccctcgtggttttcggggacctgggattcacacaggaagaaagcaccttgggggtaatataagggggccggggggcacacacgcgcacaaatgggggtaacaacccctgtgcgggggcccacacccactgctgggcacacacgcgcccacgggtggcaaacgctctggcacggtctggagactgggacccgcctggagctggacacaccaggcgcccccgacggaacactaaccacctgtggagaactccacatttctcccacggggcttccacaatcgtcgtcctatagttaataccccttctccgcttcctccacggcctccacaaaagtgggaagcctcggagaaggtaagaacaggggagggacacacctggtgggtttctacctgagacctcacacactcgggggcacaaagggttttgaaagacaccaacgctctctccctgccagcgcccaaagcctgggcccgaaggcggcggtttgtgcaataatcttgcctcgcccctgtcttttaaaggagagcaagcgggaacggagagcgttcggggcctcctcacgtgaaggtggtggggctgccggagtttgggctgtggggccctctgggccaccgcttcttgagggaaagcccacgggttcggaggagaccctggagaaaacacaggaacgggttctgaagactgaaattgttttaccagctccccgggtggacttcagtgtgtgtaattgtgtaaatgagtaaaaccttttatttcttttta

SEQ ID NO: 499705 - DNA, 145 bp, Homo sapiens
agcggccctgcagaggctcggcaggtgtcttgatataatcatctgctgagggtggagctgagggctggaaggggagctgagctgacgctcggaaggtgtcttgagattatcttccgctgagggctggaagctgccccgcagacgc

SEQ ID NO: 499706 - DNA, 511 bp, Homo sapiens
agcggaggttacgcagctgtcttccaggtgactggacgtgttgatcagcggctcgctgggatttggctgacgtggccccagcgcgaagctgcaatccccattccagaatggcagaagaaatggacagagtaacattagactgcagacacaagaaaccaggtacagacagaattttggcagaagaaaacggccatggatgttccagcagacagcagaagaggaacacggaaaagcaaatggcagtaacccctggagacggtcagctactggatggattgccatcatctgaaggctggttgacaaatacattgacacatgagcagcagaggccatcatttgcgatggcacaagctgaggatcccaacaggcaagccaaataacaaccgagcccacatcgctcaacgaatatgctgctactgagaaacatgagaatgcggaatacactggatataacacagaaataactgaaacctacgggccagcagcacacatacaactccaccgcatacaa

SEQ ID NO: 499707 - DNA, 690 bp, Homo sapiens
ctacttgggaggctgacgtgggagaatcgcttgaacccaggaggcagaggttgcagtgagccaagactacaccattgctccagcctgggtcacagagtgagactccgtctcaaaaaaaaaaaaaaagaaaaaaaaaatttagccgggcttaggggtacaccctttagagtccgggggctcgggaggcgtgagggggggaggaatagcttggagccaataggagttcagggccgggccggtgagcttagtgattcacgccagtggcaccttaatagcctgggtgttgacagaacaccgagaaggacccgtgttttcttaaaaaacgaccacacacaacacaagcaccacacacaacacacaacaccaccaattagtttcagaaaagactcaacgttgaacacgcagaaatagtgtactccaggactcgcgggcccacattgaggaggatagtgggcaggataaaccaattagagggtgttcacatgccaattagaaaagtgcgttggagaaactgcaaaggtgtagtgaaccccgaagtatttcgcacaacagtgcagctaatggtggtgccccccacaaccattagccagcaggttttcggaaagaacccggttaataatgttaagaattctaaacaaacacgaggaggggaattggaacgccccacaaaggggggtttaacaagccagc

SEQ ID NO: 499708 - DNA, 377 bp, Homo sapiens
cgtgtctgtggtcccagctgctaggaagcatgaggcagagggatcacttgagaccagctgtttgaggtcatagtttgctatgttgcacctgtgaatagccactgcactgcagcctgggcaaaatggcatcaccctgtctcaaataaataaatatttgagttggactgtaatttttaggtatcattgttcatatttatttgattaggactggaattctcctgctacagatttttctgtttttagaaagcaatacaaactttcatgtaactcagtgccatgtctatcttcctcctcaatgtataacttgaactatagactaattatctcaccatatttgttttatttctgtcatttcttgtttgcttttgaggtttctc

SEQ ID NO: 499709 - DNA, 415 bp, Homo sapiens
ctgggaggcggagcttgcagtgagctgaggtcgtgccactgcactccagcctgggcaatagagtgagactccatctcaaaaaaaaaacgttcagttggctgggcgcaggttgtcacgcctgtaatcccagcactttgggaggccaaggtgggtggatcatctgaagtcaggagtttgggaaaagcctggccaacatggtgaaactaaaatacaaaaatgagccgggtgtggtgtcaggcgcctgtattcccagctacttgggaggctgagacgtgagaattgcttgaacctgggaggcggaggttgcagtgagccaagattgcgccttgaccctccagccggggcattgggtgaaactccgtctcaaaaataaaaaataataaaataaagccgttcaataaggagaatttggaaa

SEQ ID NO: 499710 - DNA, 857 bp, Homo sapiens
  misc_feature (8)..(8): n is a, c, g, or t
  misc_feature (46)..(46): n is a, c, g, or t
  misc_feature (212)..(212): n is a, c, g, or t
  misc_feature (245)..(245): n is a, c, g, or t
  misc_feature (344)..(344): n is a, c, g, or t
  misc_feature (360)..(360): n is a, c, g, or t
  misc_feature (362)..(362): n is a, c, g, or t
  misc_feature (376)..(376): n is a, c, g, or t
  misc_feature (390)..(390): n is a, c, g, or t
  misc_feature (393)..(393): n is a, c, g, or t
  misc_feature (403)..(403): n is a, c, g, or t
  misc_feature (409)..(409): n is a, c, g, or t
  misc_feature (477)..(477): n is a, c, g, or t
  misc_feature (486)..(486): n is a, c, g, or t
  misc_feature (491)..(491): n is a, c, g, or t
  misc_feature (499)..(499): n is a, c, g, or t
  misc_feature (503)..(503): n is a, c, g, or t
  misc_feature (518)..(518): n is a, c, g, or t
  misc_feature (520)..(520): n is a, c, g, or t
  misc_feature (525)..(525): n is a, c, g, or t
  misc_feature (529)..(529): n is a, c, g, or t
  misc_feature (558)..(558): n is a, c, g, or t
  misc_feature (572)..(572): n is a, c, g, or t
  misc_feature (575)..(575): n is a, c, g, or t
  misc_feature (587)..(587): n is a, c, g, or t
  misc_feature (590)..(590): n is a, c, g, or t
  misc_feature (596)..(596): n is a, c, g, or t
  misc_feature (599)..(599): n is a, c, g, or t
  misc_feature (601)..(601): n is a, c, g, or t
  misc_feature (604)..(604): n is a, c, g, or t
  misc_feature (616)..(616): n is a, c, g, or t
  misc_feature (624)..(624): n is a, c, g, or t
  misc_feature (628)..(629): n is a, c, g, or t
  misc_feature (631)..(631): n is a, c, g, or t
  misc_feature (637)..(637): n is a, c, g, or t
  misc_feature (644)..(644): n is a, c, g, or t
  misc_feature (651)..(652): n is a, c, g, or t
  misc_feature (654)..(655): n is a, c, g, or t
  misc_feature (657)..(657): n is a, c, g, or t
  misc_feature (663)..(663): n is a, c, g, or t
  misc_feature (702)..(702): n is a, c, g, or t
  misc_feature (756)..(756): n is a, c, g, or t
  misc_feature (786)..(786): n is a, c, g, or t
  misc_feature (795)..(795): n is a, c, g, or t
  misc_feature (797)..(797): n is a, c, g, or t
  misc_feature (800)..(800): n is a, c, g, or t
  misc_feature (811)..(811): n is a, c, g, or t
attgtttngattgttacaatgaacttgcattcttttgtatgaaganaataatacagaggaaataacaacaactaaacctttggcctggattatcatcggctggaaattcatgttggatgctagtttttattgataacaagttattttttgttttatatgctaaaaatgttcattgaatgcctcctatttggctggcactgcctaggcacttncacaggtatttcatcctaatcctcacaacagcnctatgaggtaatcattggtcccagtttacagaagccttgggtgggagattattgcttgatatacttctatttgccacagatttttgtgggcaagaggtncgtgtcggctggggantnactggtcaagagcnctgattggccaggngtncctatttgtngctgtnagattcaaataatcaaaatactagaatttttcccccacaagaatgatgggaccaatggcataagagtnaaggaaggngagtnagtgggtntctncctttgaagcaccantngagtntgcnttggtcagccccacacaggtgggcgggangaggtggtggaggnggngaggcggtggtnatnagtgtnctngnttnagtgggatgagnttactcangagnncngtgatntggggtntgaactnntnnantgaaanagttgggtaaaaagaaaataaaaaatttaaatatggggntaataggtaattaaagaagttaaaggtgggataattaaaagaagtatatagagnaaaagggaggggagaaaagagtgaaaaaangagtaaaananaangggaattaaanataagtgtaaatatttaaatggtggaagataataatggtgaaaagt

SEQ ID NO: 499711 - DNA, 795 bp, Homo sapiens
  misc_feature (8)..(8): n is a, c, g, or t
  misc_feature (46)..(46): n is a, c, g, or t
  misc_feature (212)..(212): n is a, c, g, or t
  misc_feature (245)..(245): n is a, c, g, or t
  misc_feature (344)..(344): n is a, c, g, or t
  misc_feature (360)..(360): n is a, c, g, or t
  misc_feature (362)..(362): n is a, c, g, or t
  misc_feature (376)..(376): n is a, c, g, or t
  misc_feature (390)..(390): n is a, c, g, or t
  misc_feature (393)..(393): n is a, c, g, or t
  misc_feature (403)..(403): n is a, c, g, or t
  misc_feature (409)..(409): n is a, c, g, or t
  misc_feature (477)..(477): n is a, c, g, or t
  misc_feature (486)..(486): n is a, c, g, or t
  misc_feature (491)..(491): n is a, c, g, or t
  misc_feature (499)..(499): n is a, c, g, or t
  misc_feature (503)..(503): n is a, c, g, or t
  misc_feature (518)..(518): n is a, c, g, or t
  misc_feature (520)..(520): n is a, c, g, or t
  misc_feature (525)..(525): n is a, c, g, or t
  misc_feature (529)..(529): n is a, c, g, or t
  misc_feature (558)..(558): n is a, c, g, or t
  misc_feature (572)..(572): n is a, c, g, or t
  misc_feature (575)..(575): n is a, c, g, or t
  misc_feature (587)..(587): n is a, c, g, or t
  misc_feature (590)..(590): n is a, c, g, or t
  misc_feature (596)..(596): n is a, c, g, or t
  misc_feature (599)..(599): n is a, c, g, or t
  misc_feature (601)..(601): n is a, c, g, or t
  misc_feature (604)..(604): n is a, c, g, or t
  misc_feature (616)..(616): n is a, c, g, or t
  misc_feature (624)..(624): n is a, c, g, or t
  misc_feature (628)..(629): n is a, c, g, or t
  misc_feature (631)..(631): n is a, c, g, or t
  misc_feature (637)..(637): n is a, c, g, or t
  misc_feature (644)..(644): n is a, c, g, or t
  misc_feature (651)..(652): n is a, c, g, or t
  misc_feature (654)..(655): n is a, c, g, or t
  misc_feature (657)..(657): n is a, c, g, or t
  misc_feature (663)..(663): n is a, c, g, or t
  misc_feature (698)..(698): n is a, c, g, or t
  misc_feature (729)..(729): n is a, c, g, or t
  misc_feature (738)..(738): n is a, c, g, or t
  misc_feature (763)..(763): n is a, c, g, or t
attgtttngattgttacaatgaacttgcattcttttgtatgaaganaataatacagaggaaataacaacaactaaacctttggcctggattatcatcggctggaaattcatgttggatgctagtttttattgataacaagttattttttgttttatatgctaaaaatgttcattgaatgcctcctatttggctggcactgcctaggcacttncacaggtatttcatcctaatcctcacaacagcnctatgaggtaatcattggtcccagtttacagaagccttgggtgggagattattgcttgatatacttctatttgccacagatttttgtgggcaagaggtncgtgtcggctggggantnactggtcaagagcnctgattggccaggngtncctatttgtngctgtnagattcaaataatcaaaatactagaatttttcccccacaagaatgatgggaccaatggcataagagtnaaggaaggngagtnagtgggtntctncctttgaagcaccantngagtntgcnttggtcagccccacacaggtgggcgggangaggtggtggaggnggngaggcggtggtnatnagtgtnctngnttnagtgggatgagnttactcangagnncngtgatntggggtntgaactnntnnantgaaanagttgggttccaagccccttccacctttccatctngggctactaggtacttccagaagttccaggngggctcctncccagaagtttgggccaggtacttnaaggcagggtgggcaccagtcccggtgactgc

SEQ ID NO: 499712 - DNA, 439 bp, Homo sapiens
taaagtttttaaaaaagaattccaatggccccccctgaaatatgtagatattttgctatttatttaaaggagtattttaaaagatattgaactatctgaaattggcccgtaatcaaagttcccatcatctgaatgcttttccctgaggtagaatgtgagtctcaaaaaagactgcattacgggcccctttttgccccctttctgtctttttattttgcagaacaacaacaacaacaaaattgggccttagctgtatttttttgtctaggggagtttgtttctgtctgacaaagcaaccttttttgcaaaaaacagtggatgtatttaatactgtatcatacccaaaaccctgcaggggtatataaatgctttctgtcatactgtgttttcagatgcagaattttaaaattaaaaaaaccccgcctttatgggacagtga

SEQ ID NO: 499713 - DNA, 1354 bp, Homo sapiens
  misc_feature (492)..(492): n is a, c, g, or t
  misc_feature (521)..(521): n is a, c, g, or t
  misc_feature (1338)..(1338): n is a, c, g, or t
gctggagcgtgggtagtgcgcgcgaaggggttgggcgccgccgtgattggcgggtggaagtcgcggtggccgctggctggttgcggtgttctagtggtctgggtggacgtctgtctgtctgtcagtcagttgcgcccgagcggggaggggccgtggacggcccggactgagcgtggggcatggacgaggtatccgtggcccgctcatctgctcgtcagattgcgcctagttgctgcgcgtctaggtgctgcagccacatggtgagtggtggacagtgcgatctccctgttgccctggctatgctgccagatgtgcctgctttctgccaggacgagccatgctgtgctcgggttggcttgtgcctggtgtccgatggagcgggcaatgggtgccgggtgctctggagtgcctcgcttagaccctttgcgttccttgctgcggtgcaaggctttctcccaagctttccggcatcctgtgtctcttcgggctatngacgaagtcctgcccagggccctggggcnttgcaggcgtgaccctacagaccctgcgcgcacggcttggtcagctgcatcctttggctcctgcgggacgccgctgtgcgtgctgatagcgctgcgcacggagctgcggcctgctccagccgcgtccgtcgtgtgttgcccccgtgggtggcgcgtgccagtggatggtggttgggggttgaacttcgaaggtaccagcaatgaagggatctccgttggggacactgggggctttcgaccggttgcgatcttccagaggtgggcgtgaaccggcagaaaaaacttgatttgggacgtacggtgtttaaacaggggtgcttcgaatagacgaccgaatccttgctacccacagtcaacaccattccctggggttggtaactcgtgacatttttgcacttcctcacagaggagcacattggccagtgcaacaaatatttgccaatctgcgtcctatgaacagcttcgcggaatttacgccaaccactgtgtacttgtgggccgatatagacggcaatttgtgacacgagcgtgggaatagcgcctcccacaactttattgggtacccgtagaggggtgcttgtgcgatcacgcacggtgtctacccagggtctatgtggactagagctagcgctggcacagataaacccctgaagaggaagcgtgatccatagtggaccttgcccttaggagcagcgggcctgacccgcgagtatagcgaccggcgtgtacttaagcgatgtgtgtagtcccaaacacagagtgctacggcatatctgtggcccgtagtcctacttgaagcactattccctctctggtncttaggatggtagtcg

SEQ ID NO: 499714 - DNA, 333 bp, Homo sapiens
cgactctacattactaccagacacccttagacaaaccatttacccaaataaagtgtatgcgatagagattgaaacctggcgcaatagatatatggccgcaaggggaagatggttatataccaagcatatatatatgcaaggacttacccctatacctcttgcgtaatggattaacttggaataactttgcaaggagaggcaaaggttagacccccgaaaccaggcgaggttccttagagacaggttaaagagcacacccgtctatgtggcaggtgggtgtgcaagatagaatattagatcaaactttttggccacagaaccctctttcccttg

SEQ ID NO: 499715 - DNA, 905 bp, Homo sapiens
gaatattcataggtcgaggcctggtttaattagtccgatggggcgctctggctgatctcctgtgtcatccgccgggccccggctcggagtgctcccggcggagaggaaggcggcccgcccgggccctgggaccccgcgcgagtcggcgcccggccgaggggctgcgtagtgccccgccctggccaggcccagccgggccctggacaggggcagtggcattgtatcatagcactgacctgacctcatgcagcaccctggcaatgaccttcagtggaacgtggagaacttcgttgccatcccagcaatcagcctgtgcacgttgccaccccaagaagtggtagggaccggcctcggttccccttgggcatagagttgcgtgcgaaagttcttcgagaggaacaggcaaacgctaattagacagacaaggtgggagatattacccgttgagccccctatggcaaggacaaaagcgttatccccaaagccaaggaccaaaggagcaaatttcgaagacaaagctacaaagccaacgaaacgacccaaatcgcttgagaaacccctatccggcgcgtcaagagcgcaaaattttgggcggcaaccggcgagcaaagatgcccccgccaataaaactttccattttgtgacgagaagaaacgtgcgaaacaacaaatatttcctcccaaaaaaaagaaaggagcccacatgacgcggagcaacacggacggaagacgactttgggcacccattttacccatcaacccgcgcccactattcactgacaacaacacaaagtccttttcccacgaaaaacagcagaactactgagactctttgacacaaagagcccctttaccccatatggaaatttggtcggcaccacacgtggaggagagtcttagtgcagc

SEQ ID NO: 499716 - DNA, 441 bp, Homo sapiens
cgcaggcagctgagataatcctcaacaagccaggattcaagtacaaggcctgtctgcaaccaggtgagctctctgggccttctctcctttcggttcttcatgccccctcttcctgtcctaatttgccaaattatctgttggtttggtcccagttatcttggtgacgtcgaagattatctagagagcaaagcttctgtcacgaaaaggcgtgaagatttcttgtatgtaccctgcttggacaagtatcagggaaaaattgggaatgagtttaatgctgactcgtgtgtaatattggggggaggtccatttgatcaggcaggccttggaatcatcaattagacactcagggaaaggtggactttacctctaagctatgaaagatgaccagaaagtgcatgggtgaaggtgattaggaggtaataggcatgggtacccgagctc

SEQ ID NO: 499717 - DNA, 430 bp, Homo sapiens
acgagaatgttgtcgaagagtcgatgcatggcaataccgctcactaggccgcagaccttgagagattgatcgagaaggacgacgcggcggcatcgcgatggaacatctgtaccgtctctcgcgagtaatccaggagatccttgccggccagactgagcttggcaatcatgtcgttggtgcaggtgatgatatggcagccgatatcatccgcctggaagatgttcagcacctcacgcgggctggcccacagcagttccgccttgggattggaggcaagaatgtccctgcacccacgcatatgcgccaccgggtcgatgcccgtatccgctacacgccccgcgaaaacagaaatgatgctcggcacattctcgtccagcacctcggcaacggccgcgacctgctccggcgtcatgatcgccgtgacattgag

SEQ ID NO: 499718 - DNA, 124 bp, Homo sapiens
  misc_feature (79)..(79): n is a, c, g, or t
aagatcatcacaccagtgcgctccagcctgggcaacaaagcaagactccctctcagaaaaaaaaaaaggggtatccggnccttaaggttcaccaattcttagaacccaacggaatcaccggtcg

SEQ ID NO: 499719 - DNA, 794 bp, Homo sapiens
  misc_feature (19)..(19): n is a, c, g, or t
  misc_feature (100)..(100): n is a, c, g, or t
  misc_feature (131)..(131): n is a, c, g, or t
  misc_feature (151)..(151): n is a, c, g, or t
  misc_feature (203)..(203): n is a, c, g, or t
  misc_feature (281)..(281): n is a, c, g, or t
  misc_feature (307)..(307): n is a, c, g, or t
  misc_feature (317)..(317): n is a, c, g, or t
  misc_feature (359)..(359): n is a, c, g, or t
  misc_feature (386)..(386): n is a, c, g, or t
  misc_feature (406)..(406): n is a, c, g, or t
  misc_feature (430)..(431): n is a, c, g, or t
  misc_feature (434)..(434): n is a, c, g, or t
  misc_feature (449)..(449): n is a, c, g, or t
  misc_feature (453)..(453): n is a, c, g, or t
  misc_feature (455)..(455): n is a, c, g, or t
  misc_feature (458)..(458): n is a, c, g, or t
  misc_feature (460)..(461): n is a, c, g, or t
  misc_feature (473)..(474): n is a, c, g, or t
  misc_feature (477)..(477): n is a, c, g, or t
  misc_feature (482)..(482): n is a, c, g, or t
  misc_feature (488)..(488): n is a, c, g, or t
  misc_feature (490)..(490): n is a, c, g, or t
  misc_feature (492)..(492): n is a, c, g, or t
  misc_feature (503)..(503): n is a, c, g, or t
  misc_feature (506)..(506): n is a, c, g, or t
  misc_feature (730)..(730): n is a, c, g, or t
atactttctttttagtatntacaagccaacacagaactcattttattcaagaatgaacacaatgtacaaaaaaagtatgcttatattataaaaatatgtnaattttatcttctgggtgcttaggagaagtnattttaaacaaaatcaaggnaaacttgttctctataatgagtctgctataatttaacaacaaagtgaaagcnaatgtacttacgaagtatttttaaaggggcactgataatgctgcactggaaatggtaaacccaatgttaactaaagtnaacatttccgctctaagcttactggnaccacttcangcctaaatcatgggaaagtacctcttttacagaatgcagatnactgctaacaatccacatgactaagtnttcagtttcccttgcttaanatttgttaggatatatttgggggnnggntaggagtataatggntgtngngtngnnaaatggtatttnnttnggttnagtttngnantgggatatggngcnatgggggagaaatgaggtcttgagatttacaaccccctttataaaagtgggaaagctgcctccctaaaaaaaattatgtccaaggtgtaataccgtatctttttttgtagttttcttatttcttgattttattggcacctcccaggcactttggcatgtgctcctgtataaagtgtagttactgtgcctgtagagttagtggcagctgcagagtagttataggntgacaagtccacttttggcttaccatggagatctgctccaacacatgctggtcgttggagcagc

SEQ ID NO: 499720 - DNA, 723 bp, Homo sapiens
  misc_feature (364)..(364): n is a, c, g, or t
ctcacacggatgctttagctttcacttcatctagcccttcattaagcagccctagcaggactccacctcctattcttgcacgaaacgggatcaaacaagcccctaggaatcacctcccattaccgataaagatccaccgttcgcacccattacatacagagagtcaaacgacgccctgcggcattacttctcgttccttcgtctgccgtgtaaatggacattaaacacatattcgtcagcgcgagacctacctaggcagacccacgacgaagtatgacccatagccgaagccacttgaaacagcgccatcaccctacgatcaagtcccgaagtgagtatgttgcgcctgagtgttcgctcgtgnacacaatatctcgcggatcctggcccgtaacgaaagctgaggaggcgtcctgtgcgcctattactagtcgcatgcctcagtcctagcaacttgataccccacctccgaagatatctcgatcaagcaaccgaggtaagtcacgcacccaacgaatgactgaagtcaagactgaagcctcgaagaacgaaagtgataaccatacgacaacagctaaaggacgaagctgatctctgtatacgtagtgatcctgtaatcatttgttagtggccacaagtaaacatcctcggactgcctgcctcgagtgcattgtacggccaaagcagccgactatctataaagctagaccaggccatgcccct

SEQ ID NO: 499721 - DNA, 440 bp, Homo sapiens
caaacaaatagtgtataagtctttaagtgaattacttgattatttattttagcattgtaaaccaggaaaacaatcaaaatagcaaaaaactcttaatcctcatttacgtattaagtggattccaacctgtgcaatcatctttaaaatctccagtaatgcctgggcgcggttgctcacgcctgtaatcccagcactttgggaggctgaggcgggtggatcacttgaggtcaggagttaagaccagcctggctaacatggtgaaccccacctctactaaaaatacaaaaattagccaggtgtggtggggtatgcctgtagtcccagctactcgggaggctgaggcaggaaaattgcttgaacctgggaggcaaatgctgcagtgagccaagattgtgccactgtaccccagcctgggcgacagagtgagattagtctcaaaa

SEQ ID NO: 499722 - DNA, 1097 bp, Homo sapiens
gctgcactcttgccatacctgactgctcagctggatgaggagctgggagtgtacccctgtccagagccgtgtggtccaatggcaaggagccctgcccacctcatgagcctgtttgtgttgtgtgaatgcccatgatcatctacaatggtgctggcacctccctgcgatgggctggggcagacatgcccctgccatgctaccctgcctcttccagtgtcctgcgccaacagctgctggagccacccgggctgtatgaggtattgcctaaggctggtgcactgaactccaacgatgcctttgttctgaaaaccccctcagcctgcctacctgatgggtgggtacatggagccatgcgatggcagacaagactggggtgcccaggagctgctcccccttgctgctgggcaccaacctgctgcaggtggcagaaggcagcgagccagatggcttctgggaggccctgggctgggaaggctgcctaccgcacatccccacggctgacaggacaagaagatggatgccatcctcctcgccatcttagcctgctccaccaagataggacgtcatgtgatcgaagaggtccctggtgagctcatgcaggaagacctggcaacggatgacgtcatgcttcctggacaccctgagaccagggacttatgactgggttggacagggatcctccaagaatcaacacacagaacagcaagccttgaccttcttgcattaactcggttaccgttcgaagcaacggaaccacaagacgaaaacggggaatctgcgaacagacctattcaacagttgatgcactccaaggccttcgagcctaccctccatctgagtgacaggttcacttgcatggtaatggtctcacttggtctggtgaccctttagacaagggccatggctgaacgctggcgagccataagagagcttcatccccgccattataacgctcacgcctttttaaacgacttccataaggagcctgatcagcgagcaagtcatataaatcatagatcgacggagcatctaagaaaaacagaattactaaaaaataatagaagaataaattgttagaataaataataaatgaaaaa

SEQ ID NO: 499723 - DNA, 376 bp, Homo sapiens
  misc_feature (90)..(90): n is a, c, g, or t
ttataacatgtattattttctggtagcacatttatataagtgatttaagaggtcgggcgcggtggtcatgcgtgtaatcccagcatttgngaggcgaggcgggcggatcacgagatcaggagatcgagacatcctgactaacatggtgaaaccccgtctctactaaaaaatacaaaaaaattagccgggcgtgggggcgggcatctgtggtcccaattacttgggaggctgaggcaggagaattggttggacccgggaggcagaggttacagtgagcagagatcgtgccactgcattccagccggggtaagagagcgagactctgcctcaaaaaaaagaaggcttagtgtgcaactcatcagagttgcacagggca

SEQ ID NO: 499724 - DNA, 367 bp, Homo sapiens
aatctaaacccactatatgttagaggttgccagcacacaatgaataggcaatcccagtcaatgatgctccaaaaatgagactctatatgcacttattcttgccttctgtagcttctccaagacagacctccaaaagtgattacatgtgagacatacaggcacagtatagtgaaaagaatcgaggacaggcactgctggcttaatgcatccttgaagtcactcaagaaacaaggtgctttcctttcgattgtcacgtatcaaaccacacaaaaagccgtcccgtcctctgtagctcatgtgcccagcactgatgagcgtgactctttaggagtctcacccagtgtagggtgttagtgtctggggtacc

SEQ ID NO: 499725 - DNA, 121 bp, Homo sapiens
ttacgagtaacgatcactcacaaacccacatcaccctccttaacctctacttctacctacgcctattttacaccaaccccgtagatcgtggtggttgtaaaccccacgatcaccaatagga

SEQ ID NO: 499726 - DNA, 198 bp, Homo sapiens
catgcactcatccagcgggcatttgagtttgtagcccatgtggtatcatgtagtagataaatgtatggaatcgggctggcctacatctgattcttgagtccatatgtgacagcttaggctattcttgactcgtgcatgtaacagcttaggcttctggaggtcactactatagagccactggatgagggcatggggtac

SEQ ID NO: 499727 - DNA, 497 bp, Homo sapiens
tgcccatcccctcagagcagcttcccccagccagccgctgtgtatccatccaccaccagcagctgccccacggcttcaccaacatggcccatgttacccaggcccatgtcaaactggaatcacagcagcctcggccttcaacctggagctgctgacttggtctagttgatggagctgcccacctctcgatgtcttagtatacactcacactatcagttgtcgcgaaataagactaagctcttgtattgcgtgctttagactcggtacacatcgagcattattcgaatacttggcttcctttcttgcagcgcttgatttgcttggtgaccgagattactagtgactagtttactaactaggtcattcaaggaagtcaagttaacttaaagcatgtcacctaaatgcacttgatggtgttgaaatgtccaccttcttaaatttttaaagatgaacttagttctaaagaagataacaggccaatcctgaacggtactccc

SEQ ID NO: 499728 - DNA, 325 bp, Homo sapiens
ggtttatataatccaaggagaatatgaataaaccccccgcccctcttggtgccttgaaagaaaagatgagaaatgatgaaaaggttgcctgaaaaatgggagacagccctcttcttgccaaaaaaatgaagggattgggccgagctggaaaaccctcctttccaaatgctgactggccctggtggtttttgctctcgacagtatccccaaaagctgacggctgggtgtttcagtttgaaaaaattttgttgccttcattttccctgcaattttgggtaaatttttcaaagatttgaattaaataaataaaattcatttttccaga

SEQ ID NO: 499729 - DNA, 300 bp, Homo sapiens
catttattggccggacgcggtggctcacgcctgtaatcgcagcactttgggaggccgaggcgggcggctcacgacgtcaggagatccagaccatcttggctaacagggtgaaaccccgtctctactaaaaatacaaaaaattagccgggcgtgtgtgtgcgggcgcctcgtagtgtccagctactctggaggctcgaggcagagagaatcacattgaaccccgggaggcggagctctacagatgtagactcgagatttgcgccactcgtactcctcgggcaacagcgagactccgtctca

SEQ ID NO: 499730 - DNA, 456 bp, Homo sapiens
  misc_feature (40)..(40): n is a, c, g, or t
  misc_feature (108)..(108): n is a, c, g, or t
  misc_feature (185)..(185): n is a, c, g, or t
  misc_feature (194)..(194): n is a, c, g, or t
  misc_feature (201)..(201): n is a, c, g, or t
  misc_feature (204)..(206): n is a, c, g, or t
  misc_feature (209)..(212): n is a, c, g, or t
  misc_feature (214)..(216): n is a, c, g, or t
ctactaccaggctgatgatgccaatgtggtactgaccgtnacctcgaggtggacaccaccctcaagagcctgagccagcagatcgagaacatccggagcccagagcgnagccgcaagaaccccgcccgcacctgccgtgacctcaagatgtgccactctgactggaagagtggagagtactggantgacccaancaaggcngcnnnccnnnntnnnatcaaagtcttctgcaacatggagactggtgagacctgcgtgtaccccactcagcccagtgtggcccagaagaactggtacatcagcaagaaccccaaggacaagaggcatgtctggttcggcgagagcatgaccgatggattccagttcgactatgcaggccagggatccgaccccgccgaggatggctatccactcgaccatcctgcgcactgatgtccaaccgaggcctcccagaac

SEQ ID NO: 499731 - DNA, 149 bp, Homo sapiens
aattttttttttaaaaagggggggttcttaacaggaggccttttttaattcaaaaatgtggttttttcccccccccccggaaaaataattttttttttgtgtgtggtgggtgggtcggaaaaaaaataaattccccggtttgccaggga

SEQ ID NO: 499732 - DNA, 346 bp, Homo sapiens
gtaacacaatggtaagtatttgtgtatctaaatacagaagaggtacagtgaaaatactatattataagatatgcaacacatgactgtaattgttttaggaaagctcagtgaagttgaagaaaaaccaaaaatacaatccaacaaaattacaaaaataatggattactaaaataaatttaaaagagaagtcaaactaatttttaaaaaacatagaaattatggagctgaaaaatacaattaatgaaataaaaaatgcaatagagagtgtcagcagcagagttgttcaaacagaaaaaaaatctgtaaacttgaagataggttattcgaaaatatacagttagagacc

SEQ ID NO: 499733 - DNA, 1010 bp, Homo sapiens
  misc_feature (548)..(548): n is a, c, g, or t
ggacctttccaacattgcgctgcggatctgtggtggcgttctgtagcctgtctcgtcctgcgtccactggatgctctcaaagtattcattaacaatacgtatgtgatccccatgatacgccctattacaccaaagtttaccaggacgattcggattaggaatggtgctgatgggcttctatcgttcataactagtccggtgctgctgatgaagatacgcaagtcaaggctttgaaacgcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcaaaaaaaaaaaaaaaaaaaaaaaaaacgccaaaaaaaaaaaaaaaaaaaaaacagttttcggcggcgcacttgtgaggcccccgaaagaacttgttacaaacaccattctgtgtgtgaggccgccgggagcnccacatagtgataagatacactggtggccaaacggtgtgttccccaaacgagaaactcgcgagaacacacacacgggctactagggattctacctaccacacaataatataaacacccgcccgaggagaaacaccagagcgccgtgttatagaacaaaacattcacacaaaggagagcctacgagggcgcacaacaggggagatatacaaacaagagaagctcacaccaggagggaacacagaaaatataaaaaaataagcccccccgacagaggagagtaaaacacaagagcagaacgaaaaggcacacgaagcaacacacaataaacacagacagcacacactgactacgacaaacaagacacaagcggaaagccgacagacacaagagcgacaacacacaacccaacagcaaagacgaagcaacaagaagcaaaacaacaacaccaacagacgcgacag

SEQ ID NO: 499734 - DNA, 172 bp, Homo sapiens
  misc_feature (19)..(19): n is a, c, g, or t
  misc_feature (27)..(27): n is a, c, g, or t
  misc_feature (111)..(111): n is a, c, g, or t
cacacccttcccttgcttngggggtgngcaaaagcaatacactggccactagagaggaccctagagctctagaatcccctcccaacacgcacacacacacacacacactcnctgtctcacacacacacactgagtcacacacacacacacacactaaacaagcctttaaaac

SEQ ID NO: 499735 - DNA, 723 bp, Homo sapiens
ctccctctgatgccgagccgaagctggactgtactgctgccatctctgctcactgcaacctccctgcctgattctcctgcctcagcctgctgagtgcctgcgattgcagcctcacgccgccacgcctgactggttttcgtattttttgggtggagacgggttttcgccgtgttggccgggctggtctccagctcctaaccgcgagtgatccgccagcctcggcctcccgaggtgccgggattgcagacggagtctcctccactcagtgctcaatggtgcccaggctggagtgcagtggcgtgatctcggctcgctacaacatccacctcccagcagcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgcccagtccgccatcccatctaggaagagaggagcacctcttcccggccgccatcccatctaggaagtgaggagcgtcctctgcccgggcgcccatcgtctgagatgcagggagcacctctgccctgtcgccccatccgggatgtgaggagtgtctctgccccggccgcctactgggaagtgaggagccctctggctggccggcgcccgacgggaggagtgggggggtcccc

SEQ ID NO: 499736 - DNA, 235 bp, Homo sapiens
gcacgtacagctgaggtgagtccctcagccccacctgccctggcctacaccccagccagcgtggcggccagtgcagggccaggtgggcatcatacgaagaccttgtgccagggcatcagcgcgcagcactggcaatgagtggccttgctgggtgtggcaggcaacagcgtggatggcctcctcatgcttcttgcggtgggccgtgatctcctgcacgcacgttttgttgtctcag

SEQ ID NO: 499737 - DNA, 345 bp, Homo sapiens
cgctcgagtttactatagatcagtcatcagtctattcagtaataatacttacttgcccaggatttggctgggcgcggtggttcacgcccagcactttggaaggctgagatggatggatcacttgagtgccaggagttagagaccagcctggccagcatggtgaaaccccgtctttacaaaaaatacaaaaattggccaggcatggtggcgtgtgcctgcagtcccagctactcgagaggctgaggcaggagaatcgcatgagcctgggaggtggaggttgcagtgagctgagattgcgccactgcactccagcctgtgtgacagagtgagcaactccttctcaaa

SEQ ID NO: 499738 - DNA, 167 bp, Homo sapiens
gtatttttagtagacacagggcgtcaccgcgtaaaccaggatagtctcgatctcctgacctcgtgatccgcccgtctcggcctcccaaagtgctgggactgcaggcgtgagccaccgcgcccggccaacgtcattttcttttcaggagtcccttctgtcgtcttctc

SEQ ID NO: 499739 - DNA, 347 bp, Homo sapiens
  misc_feature (48)..(48): n is a, c, g, or t
  misc_feature (57)..(57): n is a, c, g, or t
  misc_feature (59)..(59): n is a, c, g, or t
  misc_feature (193)..(193): n is a, c, g, or t
  misc_feature (212)..(212): n is a, c, g, or t
  misc_feature (284)..(284): n is a, c, g, or t
  misc_feature (290)..(290): n is a, c, g, or t
  misc_feature (306)..(306): n is a, c, g, or t
  misc_feature (325)..(325): n is a, c, g, or t
taaacgtgttttgcttcctgttttttttctaacctttttattgtttcncttctactntnatttcacatccttttcttcttagtcaaataagttgaaaaaatatatttttatagaacatgttgctatggtgatagtttatgaaaatatactttatccctgtttaagatctttattaagatcttgctatatgatnatcctgacctggggtgctntaaaaggtaagggtataaacccacttccttcctgtagattccattggttttctaagcattttttcctgtccnaggtanttctgacaataattantggtgtagagagtgaatanatatttaaaaattgtgtgtgac

SEQ ID NO: 499740 - DNA, 334 bp, Homo sapiens
tatcgcccaacacgtaaccttcccgagcatgcatatttattttgagaattgaatgttatatggccaggtgcagtggctcacgcctgtaatcccagcactttgggaggctgagcgaggcggatcacaaggtcaagagatcgagactatcctggccaacatggtgaaaccctgtctctactaaaaatacaaaaattagctgggtatggtggcgtacacctgtagtcccagctactcaggaggctgaggcaggagaatcacttgaaccgggcgccagaggttgcagtgagccgacatcgcgccactgcactccagccaggtgacagagtgagactct

SEQ ID NO: 499741 - DNA, 372 bp, Homo sapiens
  misc_feature (119)..(119): n is a, c, g, or t
tgagtgatctagaggatcccgccgaggggtgtcccaggacagtaactcctaggagtgctgagagctgatttgtttcaggtcagctctggccttggagatgccctccctgggaatcaggncagagcagagggcatctgtgccaggagggtgtgctctccgcgtcctgctgtgggagttccctcagggaagcaccttggccaccctgacactggtgtgtgcgagccccttctggaaacagagttgcagtgccctggtgaatgcttcttcagggcataggcccctctgtctaccaggtcatgccttcctctgccacttgaagtcagcaaggacgccaaaggggaccagccttcccttcattctcctgtcacctga

SEQ ID NO: 499742 - DNA, 317 bp, Homo sapiens
  misc_feature (23)..(23): n is a, c, g, or t
tgttcaccctcccccccctttcnccaaatggggggggggggggggcgggggggggttttttttacccaggctttttttttttcccccccgtttccctggggaccccccccccccttttttttcccccctttaagaccccggggccgttcccccccccgggttttttctttggcccgggggggggttcccttttttccccgggaaccccttttgccctttgggcttttttggggccccttttaaaccggttttttccaaaaaccgggggggggccgggccgggttttccggggtttttttgccccccggggcccccca

SEQ ID NO: 499743 - DNA, 1573 bp, Homo sapiens
tggggttcacccataatttaatgagtcaaaatcgctcccctggcgccaaagtgagcagtacccaacattgtcaggggttgggagctcatatttacaaaacccgaggcgcagatagaaaaacgcagagagaaagaacaaaaaagaagacaccttgaacgcacagtggaagacttattaaattattctcagggaaagaagactagttgtgaattttttgtgtggtgtgtgaagtcgccctccgcagaggcgcttagtgtgtctgtgacacactctctcccagagagtgtgacacagaagtgagagtgtgtgacacacacctctttgtgtgacacaagtgagagaccactctcgagtgtgtgtatactcccaaagaaggtgtgtgtctcacctactcgagctctcacagacactcccatcacagccgcagtgtgacactctgagagacactctctctgtgtgggcctgtgtgtgagtgtgtctctctctgagtgtgtctcacaccgagagcaaacagacacatcaacatatatctcgcagcgtgagacaatatctcatacacaaactatatattcttacacgctcctccttatacacagagagagcagcactgctgggagaataaatactcccccagcaggtgtgctcacacaacaacaccgacactactctccctcaagaaaagactgtgttgtccaccacgcagtgtctataaaggagggaagcgcacccagcccgcagagggcacacccaaaaaaaacacgggtgttttctccccaaagaagacaccgcatgtcgagagtggtgggggccccccaggcgggagacttcttgttgagagctctcactctcctcactcttcccaaggtgtgacacagttgtcgccggtgttgtgggacgcttcctgtggtgtcgccccccaaagcccctcttctgttatatcaacagttgagaagtgttctcccccacaattcttaccagacgagcatgatgtaagtcttccaatattacagaagaagaagaaactaccaaggtgggcggttggtttctaccccccccccaactattgctggtgaaacagacaaccaaaaacccccccccacaatggtggtgcaccaaaattgtgtgacaacgagtagtgccccccaaataaaaggtcccccaagtcgcgcggtggcgcacccacgtgtacacccccaacaataagtcccccgggtgataggaaaacctctctccccgggaagagaattaaccgcggggaccaaatttccttctgccccctgtgtgcaccctgttgttaggttgcccccccctcttgtgaaaaggaaacaaaccccccggcgtgagggggccgcccctcttttggcgacccaacttaatatctcccctcgttgtgtgaccccctctaccgaccggcaagggagcatcattttcccctctcgcgcgcgtgttgatactgggcccccgacgccgccctatgtcgtgagtgagggcgcgccccctcccggggggggggtctacaccactcgtgtggtagcgcggcagagcaatcctcccgcgcatcaggtccccgtag

SEQ ID NO: 499744 - DNA, 238 bp, Homo sapiens
tatcagccacatgacatagtgaggttagcacatgatgtagggcgccaagatatggctagcagcgacgtccacaggtgtatagatagggttgaggtcagagctctgcgcagtcagtcaagtatcttccacaccgatctcaacaaaccatatatgtatggacctcgcttagtgcacaggggcatatgtcacgctggaacaggaaaaggccttcccgcaactggtacggcggggatattgc

SEQ ID NO: 499745 - DNA, 1324 bp, Homo sapiens
agcggagggctcgtcccaggagtggggggttgcttccgggtcgctgctccgcggaaacaggaatgttgcccatcctacctctgccctggtgaggtcacgtggtccccagaggctggagagagatgccctgatggggcgctgctgagcgcctctgaatgggattgttgatatttggaagacaatcggatcttgcttagccaagcgcagatcagcccttgatcgacaaacgttacgagacgacttgtgagattggcgtgaccgacagaaccgggacaattcagtggtgcgcagtggtcgacgacggacatggcaaactgtgaaaaatattttactcgagggcacgactgcgtggaggagacacagggacagtggagatgttcaatgagaaacctccgcccgcacgttaaagtcattcgctgcgtgccttgactagcattcgccaggtaattacagggggtttgcgtacggcagaaaccgcgtaggagggcagtttaaacctagtttgggttccaatcttgtcccaataacactgttcggtatggacatatagcaatcgcatcttgtccaagaggcacaaatgtggaagtcaacccgtttgaaggacccaagacggcctactggccatggtgaaagacattgcaataacccgtgggcccgtcctttcctaacatttcgattggcccagatcccaacatttactaaacgcgacgtggacattgatcccccgttttggccaccccaagttaggcggcaataagcaaacaagattagccaatttggctcacaaggcacgagtcacttcgacacgtggccaggtatctcccatcactgggacacttaggtgcgcgtagtttgcaactggacagcgaaccaaggacccgccctctatccccacgaacgattttttggagaccccgcatttgggtggggatgcaaaatagccagaattatttgttggcacagcacggaacatgtggcaaggtccacagcacgccccccaattgccggcttggtcacgacactgttcggaaaaccctagtggcccttgggtaggatcccctaaggaaatctagacacacccatggacaagagagcgtggaacggactatccctttggggcacagcgacacggaccgccagaccggggacacaagtacacgcaagtacagaggcgacagcacagcacacgacacggccctgcgaaccccgacagcaactggcgagaaactagcccccagggaatcaggccacgcgacacgaccaacaagacaaccaagcaacacaggcccccccaaacacaccccggtcaagcgccgccaccacc

SEQ ID NO: 499746 - DNA, 345 bp, Homo sapiens
  misc_feature (4)..(4): n is a, c, g, or t
  misc_feature (67)..(67): n is a, c, g, or t
  misc_feature (69)..(70): n is a, c, g, or t
  misc_feature (111)..(111): n is a, c, g, or t
  misc_feature (113)..(113): n is a, c, g, or t
  misc_feature (116)..(116): n is a, c, g, or t
  misc_feature (126)..(126): n is a, c, g, or t
  misc_feature (131)..(131): n is a, c, g, or t
  misc_feature (139)..(139): n is a, c, g, or t
  misc_feature (148)..(148): n is a, c, g, or t
  misc_feature (155)..(155): n is a, c, g, or t
  misc_feature (157)..(157): n is a, c, g, or t
  misc_feature (159)..(159): n is a, c, g, or t
  misc_feature (168)..(168): n is a, c, g, or t
  misc_feature (173)..(173): n is a, c, g, or t
  misc_feature (183)..(183): n is a, c, g, or t
  misc_feature (192)..(193): n is a, c, g, or t
  misc_feature (199)..(199): n is a, c, g, or t
  misc_feature (202)..(202): n is a, c, g, or t
  misc_feature (206)..(207): n is a, c, g, or t
  misc_feature (257)..(257): n is a, c, g, or t
  misc_feature (339)..(339): n is a, c, g, or t
gtcnagcataaccttaaaatagtttgctcttttttattcctcaagaaaaattagggcaaggttaaanannccgaatttttctgatcttgttcattaaaaatgaaaaatcancnatnttggttggantttanaaaacgcnttaatttcntttcttntnanctttcatanttttnagtatttcantccaaagcnncatttntcnatgnngtcaactttttctattgtgaattaaaaatatatccaactcttattttgcnacttatttatgaatatcgaacttcaataaaaatattcattattgtgctttggtcttggcattgggggaaggggtaatttttnttttaa

SEQ ID NO: 499747 - DNA, 192 bp, Homo sapiens
ctggcccgtatgtatccctaacactgaaaataggatgaaagccctgtttactgcaattccttttacccagtgtatcatgtctacctatcaacagaaaattacaaagcatacttaaaaggcagaaaatgcagttggaagagactgaacaagcattaaaaccagagtcagtcgtggcaggagtgttgggcgata

SEQ ID NO: 499748 - DNA, 186 bp, Homo sapiens
cacaataggaccaatctatcaacacatatagaagaacaaaagaaagatatcaagtacacatgacaacatacacctccgcataagcctgcgtcagattcaaacactgaactgacaatacccagcccaatatctacaatcaaccaacacgtcctaattaccctccatctgatgctgtccggggatcct

SEQ ID NO: 499749 - DNA, 205 bp, Homo sapiens
cgtaaaatctctatgctcatggtgtgcggaacttcacgatctagctgactgcctaccacacggctgggaaacttgttagcgttgatatgctgaactgactgtaaagtgtcatagtcaatattcaagtgtgaatagcagggctttagtgttagtactgtcttatgtccctgtttctttttttctcccagaagcgtttcacttccga

SEQ ID NO: 499750 - DNA, 1187 bp, Homo sapiens
  misc_feature (383)..(383): n is a, c, g, or t
gggcggtcgggccgttgcgtgtgtgtcggtccctgggatcccgacgctcgagtccgtgcatactagaccgatctgtgccgagtagtcctgaccgatgagtcgctcggattctagcctgtgggcctatcgcacgttcctgggggcgatcgcctcggcaggacgggcctaggcatctatggtccggcgtgagctggcgacagcgcgccttcgcgcgcatcgtgcgcccacgcgctgcctgggcgcctgtgctcccttccttcatccattcctcgagctgtagtgagacccagagcgttcccaggcgaacgcacatagtgccttaggagacgtagtatacttgcgagaaccggggtctgcacttcggcgcgtagtaatactaaagngaggtatgcacatggcatgggtacaggcggctgaaccatactttcactcggggtgcccggggctgtcactccatggcagcgcagaaggggaccgcctcagaggggctcccggcagcgtcttgcgtggtaagaagcttgtgggctccttgctgtgtgcgacacccacattgaacccggtactgcccgtcgatatatgggcaatcgggcacttagaccaagaaacaagactaccattaaagtgggtaggctcatcgattcgacacttgacaccctgttgtcgcggaaaaggtggttggggcaccggtgagggccaactataaggtagagcatacgaaaaaccccatacattgggccttcgtcacgcacaccttgcaagatggcaacgcaagtagagaggttccccttggtggaatttagcacaggcaatccctcgccaaaggggttgtggcaaataagagccacgaacggtgacaagatcgtttagccttcagcttggaatgaactgaacaagttcgcacttggccgcagaatccccaaaggtgtgggccgctgacatttctatcggtcgaagtttgtcccaataaacagtttgacaggaaaccggtgggaaccacccagaaaggagtagtcccccccgaccgagatggccataggggatagatatgctcaggatatatcccataaaccaggtgagacactactggaaggctacaacggacaccaagggaaggggtcacagagatataggggatacatgtcggcggttgtgtacccctttgatatatggaggaggccgatagggaa

SEQ ID NO: 499751 - DNA, 186 bp, Homo sapiens
cgcgtcgtgatgctggtacaaggttgtgggactgcatgctactgtctacagcttgtctcaagtggatctagcaacttcatctgccctctagatcgccgatcacctctagagcacccaccttgctcattcactaaatagccccatgagccccctaggagccacacccaggagccttcacccaggagt

SEQ ID NO: 499752 - DNA, 729 bp, Homo sapiens
gagcagttcagtcgatttcctcgtttaccccggccccctttctcttgctcgccccgaacccctctcatctgcctggtggaggatgaagcggtgcagtgagcccagactcagcagcggcaccggcggtggcgtgcgaagtgggtggccggaactggggaggtgaagaagcggaggtaaggacggctgaatggagcggatagcagactcagacctactttccctgtgacttccttatacctcttatagatgcagacgaggaaagttatactgacttctgtacgatgtgttatagtagtgcgtgagatgtgggtggttgtagcgcgtgagtgtttagtggttgtggcgttttgtagcaaggcgtctgggtatgataatgcaccgagcttgagcattccgcgataacctcagtgccaagcctggctgtgagccttggagctagtggacccataggagagcggtggcgcagagcagagcagagagctactctcacttacatgttagtctgtatacactcaggccatagggagtgaaagccttgaaaggtggcgaaggaccagcggatcatgggaatgagacgagcatagaaatccggagaagacacacagggggcacattgaagtagagacccacatgagggagcataccacagaagactgtggacaaaggagataaagggacacaagataagacacagggacattaaaaacgaatgatatggcaggccctgag

SEQ ID NO: 499753 - DNA, 668 bp, Homo sapiens
  misc_feature (581)..(581): n is a, c, g, or t
  misc_feature (591)..(591): n is a, c, g, or t
  misc_feature (593)..(595): n is a, c, g, or t
  misc_feature (599)..(601): n is a, c, g, or t
gggcaggcacaggaaggcaacggcagctgtggcagacggtgttgaatcgccaacatataaccgatggaggccgcgaccagcagtgggatcaccgaactgatctgtttatgcaaccccgccaggaaactcaccacttggggatcgaaccccagcgccagggcgcattcggacagaatcaggaagccggcggacaccaacaggcacggcagaatccacagcagcccctcacgaatcgcacgcagcgactccgtgctggccaggaccgccaggcgctgggtcaggaaaagtttgaacagggtgtgcgccatgggccgtcctctgcctgtcaccgactgccgctgaagatcagcggccggaaacaccgctaacgctacacgccctgatagccgaagcgaaagcctttatccccgccccagcccggctttttaccagtgaatgcctggctgctagactaaatccctacagatttatcgaactttctgacttgaatcatcccctaaggctgtctgagtcggtatcatccgcacggtttgtgcgtgttaaacgatgttacaacctgtctgataatgggtacgcactanggatcttgcntnnnacgnnnacaggccaaaggagagaacctcactatgcaagacaagcgctcaagtaacatgcgtcctctattcgtc

SEQ ID NO: 499754 - DNA, 263 bp, Homo sapiens
  misc_feature (55)..(55): n is a, c, g, or t
  misc_feature (116)..(116): n is a, c, g, or t
cactctgaggaccccatgattcacgtggtgatcttccgccgcacctggctgattntcaaagtcgtttgagatgaaaacaggctacgatgggcagtttcttcatagtgagctgcttngtggactcctggtagctattgcaaccgctgcacttaatcttggcgctgctgcccacgtgctctggtctggtgaatcgtcgcatgcagtccgtgagcgtggtggttcccgacacgtggctttccccgtttaccacgttgaaatccata

SEQ ID NO: 499755 - DNA, 308 bp, Homo sapiens
tgttaaaactagggggataggggtataatgcgccgtcacagtcattctcaggcccgccgccaaaacagatagcctgccccttccttgtactgatccctgatgcggcgtacttatacgcacgctccatcggcctacgacaaacagacctaaaatcgctcatggcacactcttcaatcagccacatagccctcgtagtaacagccattctcatccaaaccccctgaagcttcaccggcgcagtcattctcataatcgcccacggacttacatcctcattactattctgctattgaacttctaaaactagg

SEQ ID NO: 499756 - DNA, 236 bp, Homo sapiens
caacgatgtcctcagctctacaaaacataataaactagccggctaggtgcggtagcttacctgtgatcccagcactttgggatggccgaggtgggtggattatgaggtcaggagatggagaccatcctggccaacatggtgaaattctgtctctaccagaaatacaaaaattagctgtgtgtggtggcgtgtgcctgtagtcccagctacttgggaagctgaggaccatcgttgac

SEQ ID NO: 499757 - DNA, 101 bp, Homo sapiens
cgccaacgcaggaccaaggagaaacacatacatacagctcacatgactcagctgaggtccgtacccgtgcgccaatcatcagagaccctcctctgtgctgt

SEQ ID NO: 499758 - DNA, 236 bp, Homo sapiens
gaaggggtgatgcggtatggaggctccatgttgtgaatcggcgccgttcgtgcttgttagcggggaatccgggtagccgcggggtgagcgtgtcggggagcctgggccctaagtgaagatggaggcccgctgtggcctgccgcggacatcctgagtgcggatggcggcagcaggactacgaactcgtccagagggtcggcagtgtgacctagggggacgtctatgagggcagaaat

SEQ ID NO: 499759 - DNA, 417 bp, Homo sapiens
  misc_feature (273)..(273): n is a, c, g, or t
agcgggtcgctgccgctgccgctgccgccgtcgttgttgttgtgctcggtgcgctgagccgcggctccgcgagccggttccgtccccttcccgccgccgccatgaagtgcgatgttcaaggaggaccactcgctggaacacagattgcgtggagtccgcgaagattcgagcgaaatatcccgacagggttccggtgatcgtggaacaggtctcacggcctcctccagaatcgttgaccattgacaaacggaagtactggtccatctgatattncactcgtggcctcagttcatgtggatcatcaggaaaacggatccaagcccttttccctttcctgacaacagggcgatcttcctgtttgtggataagacagtcccacagtccaggcccctttaaaacccgttaacttgcgggcag

SEQ ID NO: 499760 - DNA, 627 bp, Homo sapiens
  misc_feature (189)..(189): n is a, c, g, or t
aaaagaaagtaaataaaaatgcttctggtctcttgaatcttcattgggcctatactagaataagtcttgacagcaaggacttccaagcttcttcctgtatctcccatcctctagtcacttcagtgttttatcaaacaagctacgtgtaggctttccacaaagtcaggttatgtcagaggtagcgttagnacgcaatatgcttgatcatagtatgtagtgagttcaaatgaacacatcattatctaagcgtattacaatagttaaaggtgcgaaaagaacatgtactgccttcactgctatgcgctaagaaaaattctgagaaactgagaacattcattggaagccagacaacaggcaattaattgcctcatcttccatgagctcctttaatgcaccagttcaggctggttttcctcgaagggtagcaccccactcacataataagcaatgccaataggcatcaaagcaatgacgaagatcggcagcaatactctccagaagcccagatcctccacaaactcctgcttatctgttgccatctcatcatccttgggtgcagggtctgggatgcgtatgtccagtggggcccgaaggtaagtcaagtcagccacattgagggagtcctct

SEQ ID NO: 499761 - DNA, 904 bp, Homo sapiens
cgtctctgccttggggagtcgcgaggcggtgtctcggctggagggccggtggcaaggatgctcatgattatggctggggcagtgctatgacgacgatatatctcgtgggtggctgtggcttgactaggtgtagaacacgggaacgtattgtacaaaaggagggaggaacgaaccattgatctcgaggtcagtgtccaggaaaggctcgaatcgtattacaacagaacgatactgatgcattggaagacgatcataggactgtgcgggacagaagagtgtagagcacgagtagatagactgaacatcactgtgcaaagtatagatggagagtgaaatagacaggtcattgagagtgagtcacacttgcatggagagtatagatggcacaaaggtcactgtagtgaaaagaggaccagtgacttcggtgtgtagcagagtgctaaggatggtggagtggaggacaaagaggcaaaagaggttaatctcttggatgacgagggagggactgttctctcatgtacttctttgcagtcgagtcttagtggaagatatatgaccaagtaggagaattatagggcatactggagataattttgatccaggaggaagtgtgttgaagtggatgggcatagaggagtatgtccaagaaaacggtgattctgatacgatgaagtgcagtcaggataggctaaagtggggagggcatctcggtaggcctgatgttaatggtagatttgagcgtatgaatttttaatgctggatattttgaattttgcgcataataggccttgacttgtaggaggagttgcctgatagtgcctggtggtccaatatttggtactttgttaccctgtggcttgtaaggggtgtcagatggttctacttgtaaatcggataatcattg

SEQ ID NO: 499762 - DNA, 118 bp, Homo sapiens
cagtgtcatttggagagatactggcttggctgagggtgctgcttcttcctttgccaggtcatgcgaggggctgctgccaccccatgcacatccccttcgccctccatgtcagatgcgt

SEQ ID NO: 499763 - DNA, 309 bp, Homo sapiens
ggaaggtaaccactacttgatgccgaactgagtgcggacacccgatcggcatagcgcactacagcccagaactcctggactcaagcgatcctccagcctcagcctcccgagtagctgggactacaggcactcgccaccatagcctggctaaattttttatatttatacgaagagatgggctgtgttagccagatggtctcgatcttctgacctcatgatccgcctgcctcggcttcctaaagtgctgggattacaggcgtgagccgccgcacccagcttcctctctctaataattctatgagtagatct

SEQ ID NO: 499764 - DNA, 227 bp, Homo sapiens
ggtgtttacaactaattgatcacaacctcaaggacccaggaaccccggcctgcgcggaacgtgctcagtggggccatctccgagacttatagcaagatgacggcagaggaaatggccagtgatgaactgaggaagttgaggaatgccatgacccaggaggccatccgtgagcaccatatggccaagatggcgacaccaccactgactttccaagtgcagcaattaca

SEQ ID NO: 499765 - DNA, 453 bp, Homo sapiens
ggctgagtcgtgccgtctgtctcaacccacaggatgtctgtagtcggtcggtgtgacatgtgggaccaagtccccaggcatcttctccgtgtgtgtgtgtgtgtgtgtgtgtgtgtgtgtgtgtgtgtgtgtgtgtccgcgagtgaggctctctcaagcctcatggtctcagagctctctaacttgactctatctctctgtgtgtctacataccaactccttccaagagtgagagtgtgttggaccaccatgattcctctctctatttactctccctccccttctatgtggtgtgcacttaacgatgaacacctcctctccccgacttggctcagctcccatgaatctgcgacacagatgaagcgagtgtctacagcacaggacccctggaggacaagattggcatagcatacgctgtaccacgtcccacaacactgatcactagttctcaaa

SEQ ID NO: 499766 - DNA, 106 bp, Homo sapiens
gcccatgtcaactagatatctatccgtcactctgcacgtaggacgcctagcgcttcatgcgttgacccagtccttgaaacttttggataagcagtgcacggctccc

SEQ ID NO: 499767 - DNA, 200 bp, Homo sapiens
caaagaataaataatttttctattcctgaaagttaactaattatttattagaaagtcagaaatatgtggaaagcaaaggaatatttgagaaagtgatatgaaattaataagtggtaaaaaattaataaaattaatattagagtttcctttgagctaatcctttatttatttatttttttccttgagacaatgtcttgcca

SEQ ID NO: 499768 - DNA, 1174 bp, Homo sapiens
gccgaggaactgacgactattctcagacaatcagactgtcgacattccacgaacacatgtcgacattactctgaagggagccgcacagtcctcgtgaagggcgccaggaggaaccctgcgcgcagggacttccattcatcgaatcaactgtagaactcagccttctgtgtgatatgacaactaaaggcaggctccgggttgacaaatggtggggtcaacagaaaggcaactggctaccgttcggactatttgtcagtcatgtacgagaacatgatcaagggtgttacattgggcctacccgtcttacaagatgagggtctggatgtatgctcatttcccccatctacatcgttgttatccaggcagaatgggtctctctgttgacaatcgcgacaatcctctatgggtgagaacaaatatcatccagcacgggttcggatgagacctaaggtcgttgcattgcttcagctactcgtctacagacccaagagacagtactgaaattcaatcctatggaacggtaaatcgaccagttgaggctttggtttatcaaaattcagacggactcttgatatcagacgatagaccacctaaaacagttaataacatcacaggtatcatcatgtgacacatcctcaggatcaggcatctaatgtcttctgaacacatatggacactgtctcagcaaggctcgcatcgagataaagatctagagaagttaccatggctagcagcaaagaaagatagccaagatgacactttaaggacctaattgtgagatctccccttgactgccatttacagagaagcgtattggactttggaaccataataaggactttcgaaccatccgaaatatctccgggaagtccccttgtcgggccctagtgcacaacgaggggcgaagaacacggggccccttggttactaagcgaaggtccccttgaacccagtatttattctgttgaccaaaggagggggacaaatatctggaggggggtccccccccattgaagactcacgaacaaaaatttcgatgtaagccagggacacccacttctaaactgaacccggggaacacaagggaacttcagaagagagtaaacccccgaatgccggtagaaccaaatactacacgtccctgtgagcaaacaattctcgacaaagaacaccg

SEQ ID NO: 499769 - DNA, 246 bp, Homo sapiens
aacttgctacagcagctatggtttattctttttttttttcttttacacatgttcctggggctcatggaatttactagtttattataaaggatattacaaaggatacaggggaagagatgtgtagggcaaggtatgggggagggacgcagagcttccatgtgctccccaggcgctccaccctccaggagcctccacatgctcatccatccagaagctcccggaaccccacccttctgtcgtcttctc

SEQ ID NO: 499770 - DNA, 117 bp, Homo sapiens
ctgcgcgtggatgcattcggcgcggaatgattccgcgcgcatgcattctgcgagtgaacaggaagagccagcgccggaatgcctctcagtatgccaccctggatgccgccccgaatg

SEQ ID NO: 499771 - DNA, 176 bp, Homo sapiens
taaaagatataacaggcctagctctttgtacagcggatgctcgtaaagagggggcgagcggtagaaccttgggtccttttcgccgtagtcccaggacggaaagatcggccgcgccagccagggtcacgatgtgcatcttctctcgcaaaggtgggctgatccgctatgcgtcgggt

SEQ ID NO: 499772 - DNA, 105 bp, Homo sapiens
tgagatcacgccattgtactccagcctgggagacagagcgaggtcccgtctctaaataaataaataaagcttacgcagatagttggggcctcctgagtagctggg

SEQ ID NO: 499773 - DNA, 909 bp, Homo sapiens
  misc_feature (888)..(888): n is a, c, g, or t
gtcattcatatttgtctttgaatcaaaaaaaaaaaaaaaggtctattgccagaattaggaatgcatgtatatgttaaccatttagaaagctggggattggctttaaaaggagttttgtcttattttaacaagtgggcatgcttatttggattaatcatagtctttctactccagcatcactggggtatcaaagaatcaatagaggacaccagaaatcttggtcaaaataagacaactgtgggtaatcataaactggtataggagtactatataaaataatttctcccataacctggccgaccaggtggacaaacaactttggcctataattatattatattttatatatttattaagagaaacaaagaaatattttatacagacacaattctaaatttgtgggctatttatattgtgcaaacacaagaggagctatttgaggggactctataaagtgtgtgttggccccacaatatgagagggtgttgtacaacaattctctatcaatatatatctgtgacacaagtgtgttatatataatactcacaaatatatatgtggggtgtcatcacacctaatgtctatattcactatactaaacataaaatattatataacatgtagtgtgaggagggcgaggtatgtagtatactaataatcacaaactaatattaacaaatccacagcgctgatggaatattaaataaaataataatccagtgagggatatattatatcaaaccgaccggaggggaccaaaaatgttgtggggagagaatataataagaacacaaccatatattaaataacccgacccgaatgtggaggggatgatattaatacataaggatggcagtagtgagccgcatgaggttttgggcgtataanaaaaaaataatctaaaaacaa

SEQ ID NO: 499774 - DNA, 1032 bp, Homo sapiens
cgctgcagaatctaatcgtacgagacattggcaagcaggagaaagggatgtttctgatcaagcgcagcccctacctgagaatgtacgaggtgcacacagctatcccgggaatgaccggagcacctggatccgggtcattcagctcagagcgtgcgcacagtgcccatccagggaggacttccccctgattgatgacagaggatgaggcttacctgcggtcgaattaagatggagttgcagtccgttaggaccgggctactggctggagctgctgctgagtagaaggtccgggctgtttgctgagatgaccctatttccatggctcgatcgcatgcgcatggtttgcgcagtgggcatggccctgcccaccctgcccagggccttttccggtctgcacgtcccttgagtcccctcgtggcgagcggctggctggaggatgccatctcgtgaggtggagggtctgaaagacactgcgtggtgggggccagtgagtggtagacgtgcttctttgacacccctgagtagtccagccctgtcgccttggaaccctggaccgtcggtgttactcgacgagtcctggcggtcacctgtcgacctgggtgacggccagaaccgttcagtggctccattgaacttctgcatagctgactcagactctagccaagagggatggaatgtggacatcaggcgtgcgatcaccgccagaggagtgtgttcacgcgatgggtccactctctatgggacgttctacagtgggctactggcggctgtgggccagtggacactctgttggtaagccgttgcctgagggcctgacggcggagaagttgtgccgggttcatctcgggtgggaccttggagggtgtggttgcctgttggcctggttaaccgggggcggcctggctctctgggcgatgcgtcggtgcgaggttggccccgttgttgtggacggccatggctgtcgcgcgtattagctgttttggagcgtcgtgtgtaccccgccgcttttgccgggtgtccggggtcgctcgg

SEQ ID NO: 499775 - DNA, 147 bp, Homo sapiens
tgctagaggatcccacccattcccccacagtgacgataaagcagacacaagacgggctcggagagactctatattccctcttatccgaaacataactggttttgtatagtagctctgagtccttagtttttcatgtcattgtcctag

SEQ ID NO: 499776 - DNA, 1476 bp, Homo sapiens
  misc_feature (977)..(977): n is a, c, g, or t
  misc_feature (1476)..(1476): n is a, c, g, or t
ggctcgtcaagtcctcgggcggtcagatggggggtgcgcggtcaccacgtcgggcttcgccttgcagtatccagaaagagtggttatttatctgtatcgaggatcgcgaatctactcgcgtgggaccgccgcccatgcattgcttcgatacctgcatacgaactttgcacaggctgttccaagactatcgtcaagactctatgatgtcaattaacaagaggctatatactccacggcaagtcgacagagtcgcatcgtgcagaagcgtatagagctgggaacgcagacggccgagtttcccgagcagaaagtcgagtgcatggccatacacagtcaggcctgtacacgtcgtgcagtcacctctccactgcgtgtgacactcgtgaatggacacccgtgtggcgagacttgcagacaccgtactcacacatgtagccctggtcgagacaagcctacctggcaactgtgcccaccccgagtctgcagtcggcgactgacatacatgcagatttgaataacacaactcgaatagccccgtagacgtcgtaccaccaagccctacggagctctgtcatcacaactggaaaccttcgcactttgggcactcaactccactgctacctggacgccttaccacgcacaatcgccttcaagggtcagtacgtcacacaacgaaatgcatcacgagccacaatacgcactccaattcatttaggtcccggacgtctcgcggcttctttcggccccgtgctcccacacgcgggaccaaaccaagctctgtgtcacacggcaatcgaacacggacttggaggtggaccaaagcccgacccttcaagccacacgcaatggggaacttgattgcctgaaccccattgggcggcaaggcaaaatggctcttcccgtgtctataaccaacataccttcactgcactgtcgtagcaccccaacttactcacgctaattaccataagtgtatnttaccgaattttctaccgacgcttcacactcggctcccgccttctgggcacgaactttaccctgtaagggcatggaacctatggcctattacacaccgctcttactgtggcgcgccaacatcactacactccaggccggcgtggaacaggtagggctccactagccttggcaccatcctgtgtatcaacacggggcggcgatcgtttcagcaccccaccgaaagccacctctcgtgtctcctctccaagggcccccatatttctggccccccacgttgcggtaaggctacgttaaacacaccttatacttccagccgcatcttgacttttacggcggtgtcgatctcgcgttacaccgtagcgtttgcgtagcagactcttcgtccacacgctctggccttatacaaccatccccctttgatcgccagagcttaacgaccagtgcgtcacccccactcccagctcgtccgcagcactctccacacggctcgcacagccn

SEQ ID NO: 499777 - DNA, 250 bp, Homo sapiens
taccaatgatttaatagatactgtatgtaaagataatttccaaagataatttttttaaatagaagagctttaaataatattatactatcagaaagcatgctttcaaaaactatttccattgcatatgtaagagtttgattatgtctattaatgatgactcttaattcataaacctgtcacacacatctattaccttttaactggtgagaaatatacatatatattaaatatataaacatttatataacat

SEQ ID NO: 499778 - DNA, 368 bp, Homo sapiens
  misc_feature (36)..(36): n is a, c, g, or t
  misc_feature (38)..(38): n is a, c, g, or t
tcggtctctatgaacctgacggtgcaactgcacagnanctagtggcgaaaggggggcccaaaagggggatggttcccaggctcagaatctggagtcccggacaataattcggggcaagaggacccgcaagtggatacaggcagaaccagtggtggacgaggagagaggagaagcctcaggccccatgggtggggttttcttggcctgggtaggagatcaaactcctgcctggaagacagtgaaagacaaacccaggactcagggtgaccaatggctagtgggtcaggctgtcactacagattaataacttgaatgttgaagagaacagcagtgggggatcagaggcgggccccactgggctggcaggg

SEQ ID NO: 499779 - DNA, 233 bp, Homo sapiens
  misc_feature (83)..(83): n is a, c, g, or t
  misc_feature (147)..(147): n is a, c, g, or t
  misc_feature (191)..(191): n is a, c, g, or t
  misc_feature (194)..(194): n is a, c, g, or t
  misc_feature (198)..(198): n is a, c, g, or t
  misc_feature (200)..(201): n is a, c, g, or t
ttgccttgggcttttctaacctatttaccttcaggcttaaccactctcttccctttccccaacatcactccccaagggaaaangccaattttttccacccataatcctttctggcccacccctaattccctctggctgcaggccaangcttgttatcaggctttgcaggggccatggttcacattagggtnaangatngnnattgggggggggggggggggggaaaggggcgg

SEQ ID NO: 499780 - DNA, 115 bp, Homo sapiens
aacgggtgatgcggttgctgagtgagaaggacgtggaccccgtacgcaccacgtccaatgacattgtggagatcttcacggtgctgggcattgaagccgtgcggaaggccctgga

SEQ ID NO: 499781 - DNA, 429 bp, Homo sapiens
cttttttggaaactccagaggaaatgaatctcaatctctctctctctttctttctctctctctctctttctccctttccccgcttttgctgatgactcgtctcagtaatgctgagcataatttgtgtactggcctgtggcagaaaaagcccaggactggcaggaggagaccagactgggggctgaccaaactggatgtgtgtgacagcgggcaagccacgtgtcttccctgaggctcaatttccccactaagatgagaagattggagacaatgatgtctaagtaatcgcacatggtgtccagtattatgtgtgttttgctaactttgtctctttaaagttctcattttctactactgtgaaattttcttattttaattatccttcttgttagtattgagctattacccatcttttaaattgtcttttta

SEQ ID NO: 499782 - DNA, 233 bp, Homo sapiens
ctagaggatcctccggaagccttaaccctccttccccaaacagggctctaaatcatggtcctcaagcacactgagccattcacgtaccccaagtaggctggggctgctcatgggctggtctgggcttatgcacacactgtggctttctaaccataaacgcttctctgtcagtgtagtatggaaattaaaacacgttctctttctctggctctggcctggacagctcctggtta

SEQ ID NO: 499783 - DNA, 541 bp, Homo sapiens
  misc_feature (128)..(128): n is a, c, g, or t
cccaagaataaaggtggtgaatgttgagctgcctattgaagcccaacttggtctggcagttcagggcacaagaccttcgttaaccatgtcatcattgcagcacagcagggtcaagcatgcataatgcnaagcatcaacattggcacaacaagcaacaggcaatgcatgactaaaacatgccagttgcaggaatcatgtgtatgacgttcagacgacaacgctgtgtggaccatatgaaaacatttatactgtgagcaggatcatcaacaattttttgacgactccttcacagaaaactgaacgactgagctgtatgaagcaacggagaggaccaagcataaacaagcactcatgttgacacagttggacagaattaatgcaaaattggcactccagttcaaagttcggtttcaggaagctgaagaacggccaaaaatgtttgaagaactaggacagaggctgcagcattatgccaagatagcagctgacttcagaaatcaaggatgagaaatacaaccatattgatgagtctgaaatgaaa

SEQ ID NO: 499784 - DNA, 257 bp, Homo sapiens
atttgtctccatgctgttgcacatgctgcttcctttacttgttctccaccagggatgattttgcttcccccacccttgcagggtatgtggcatgtctagggactggttgtccacaactggaagggtgctactggcatcaaattggtaaaagacagggttataccaaacctttccatgaatacccggaaaggcctcaccccaaagaattttttagtcccaacattccctgttccaaggttaaaaaacctgaaccggaa

SEQ ID NO: 499785 - DNA, 455 bp, Homo sapiens
  misc_feature (11)..(11): n is a, c, g, or t
  misc_feature (62)..(62): n is a, c, g, or t
  misc_feature (231)..(231): n is a, c, g, or t
  misc_feature (249)..(249): n is a, c, g, or t
ccaccccaacnaaggtaccgttggaaaacggcaggtgccatccaggcctgtaagatgtgaanggaaattaaaaaaatattttaaccccccaaaatacatttcctttgaacataattttgaagaatgtcctgttccagaaaagcccagcctgccagaaagtagcccctgccaaagttgtcctttccgttggggaagatttgccatctgtagggaatctgcattgatgccagnccaagtcctttcccttgncccagatcctaggaaagattaactgagagtctgacagctgtaaaggtctgaaagaaactttcagagcttattctttctgagagctgctgcctgtaaggtttcatttacatattaagatcacctttgctagccaggcctcctcttctctccctcccataacctgtcttgcccacaataaatggatatacctctgactctaaaaaaaa

SEQ ID NO: 499786 - DNA, 119 bp, Homo sapiens
gaatacagcttcttccgcttctatgtgagggcgtaccaggccacggagagcaggaggaaccaggtagtcaggaacatggcccaggtggggctacaccactgcggggtgcaaaggtaaga

SEQ ID NO: 499787 - DNA, 1539 bp, Homo sapiens
gaaactaaatagctggcgtcctaccacttgcacaagtgcatggtgagccaaggccactgatttcagtgaacccggtatgacgtaattaaatcactcttaccctttctctaattacctcaacttttacccattatccaactcgtactcttgatatgatacaacactgacaacatgggcatctaggataactcaactcaatcatgttttagtcactacttactctacgaagataggctaatatcattgatggccacaaaccttctgggacgttagtgcactgctatcgcgcagtattagcacgcgcgcactttctagtctctgacaatcggtctcttggaagctgactagtgccctcgatacactattcgctagtctccataacatactctcttagattacagacgtacacacttgtctcgacattagctccattcagactgtctggaatttatacattctacggactacaaaggcactcaacttgtacttcattctacaacagcagtaatctattctacgctcatctctttcatggtggatgataagcaaacttatgttagtaattgcctgtggtagccgtagaagagtgggttgatataattggaccattagggcatttgggcaaacaaaattaaggctgtgtgactaaaggtaaacagtgtaatcaacgcaatctaaggaacgagaaattcccaatttcttagtgagcgttcacttctactatgctcgctagtgataacgtaacggcgcgctttcaatttcaaacttgtgtgtgtggcaaaccaagtatttccttcatgtctcgtccaagttaaccatactgaggacaataatcttaaagtccgggggaaatatgagattagttataattattcgttccctacttagggacatcgaatatttcattctataccaacgccacacatgggagccaataattggcacatgaggcacgcctaattcccccttctttctcttggtgtttggcttaacttccccctatccaattgtattgcgccacgcccattatatttataaccaattcggttatactcgaattaggtagaccaataagcggtataaatagaggtaggtaattatttctggagttgggcggacaactccttggagcttggtttctctatccataggttcagaagagtccaagaacacctaaggcacctccgtgcggtctaaataatttaaccgaagtgcgcgaataatgcaatgccttttcccgagcatgaccggcctctgaaagagttaattcatcccggggtcgcggagaaccaaggtctctgctatttaaacgtctggcgcccccacggtggacgttcttatcatctacctcttgcgaggtttaccttattttcctggcgctcagtgggacaaattctaccagattggtacactcgaagaagggtcctatctctttcacccggaacggtcaatttagcctatattccacaagcaacggggagagacgacctgttcaaaatgtccttggatttgcgagcttacaaataagttcttgggaac

SEQ ID NO: 499788 - DNA, 795 bp, Homo sapiens
  misc_feature (596)..(596): n is a, c, g, or t
  misc_feature (656)..(656): n is a, c, g, or t
  misc_feature (682)..(682): n is a, c, g, or t
  misc_feature (700)..(700): n is a, c, g, or t
  misc_feature (785)..(785): n is a, c, g, or t
tttaaaaaaagggaaaagggcaaaaaaaaatataaaaaaaaaaaaaaaaaaaaaaaatttataaaaataaaaaaatatacataaaaaaaaaaatttcaaactaaattataaccacattaaaccttatataaataaatatccaattacctttttttccatataaaaattttttaaaaaaaggggtttttgtccccccccttccccccatattttttttttttccccttttttttttttgcccccaattttaaatttctttttcccatttccttttttagggggggcttttcaaaattccgccgccctttttttaaccctgtttttgggaaaaaccccggggtccccccttttttatctttttaaaaaatacccctttttccgagaggggttttttacaaaaaggccccccccctttccctttttcaaaatttttcccccctataagggaaaataaatttattaccctttttttttttgttcaacacccccaaaaattttttttaaaaaaattttttttttttccccaaagccccatttctgaaaatttttttatttttaaaaaataccccccccctataggttttttttttttcccnttttgaaacacagcccttttttcttaaacgggcttcccacccagaaaggggaaaatcccnttttttggagggagccccacctttcnggacccctcttctttatnatttttttctttggacgggcgccccccaacccatttttgctccctcctccgcgcccccccttttattttttccttgaaacccccncccttcttca

SEQ ID NO: 499789 - DNA, 94 bp, Homo sapiens
tctacatctttttattgatttcttttcttttctttttttaagtatggaggctcaagtataagaaatcaataaaaagaaactggggcgcaaaaaa

SEQ ID NO: 499790 - DNA, 265 bp, Homo sapiens
tcagatggatcccggtcgctcggacatgacatctagggcctctgaactttctccggggcgcagcgtgacggctggcatcggccccactcatgatgatgtgacctttgaggcagtggcacaggcctttggagatgagctgaagccacaccccaagttggaagcagccaccaaagccctaggaggggaaggctgggagaagctatcattggtgccctcctctgcccgcctgcattatggcacagatccttgcactggtccgagcgga

SEQ ID NO: 499791 - DNA, 197 bp, Homo sapiens
aatcgagctcggtaccactctgaagcctgggagatgctatagcttcattaccataactgtgacctgtgtgctgaaataacgactcactgcatctgcacaactgcaacccctttccatgcaacgacataccctcttccctctctatcaccccataaaaccctcctgtcactttcctgctttggagactatgcccagtg

SEQ ID NO: 499792 - DNA, 1251 bp, Homo sapiens
accgtccgcgacgttccgaagacatatactcggacccgcgaaggcacgcactgaactaggtccaaaggttcaagtatccaacacagtcaaccctacctctgtgtgcagcctccttgggaatccagatatacccgtctagaccttgcatcttcctcaggctccaacgctataccgatgctgccaccttgcctactacagaagctctatcgtaccagagctttgttgcacccaagggtgctaggcacgagtcacccaacacatgtcgagcacgcgatttccgtggagcctcgtctgtaatcgttacccataggcgccagtctagtaggctagtatcgggcagcatatatagagttcgcacaaatcccaaagaggacttcatctgatcacagatacgagtaccgcatcttatcgaaccttaggactcgcacaggagcttggatggaccaggagggctatgaactgcaggttgccacgactttggaagactaggcggctaagtgcatggacatacatgtcctccatccacctccctggatgaccctcccaatgcaggcatcagattgcaggtcattgccagcggcgagaccaagcctgtccctccatacacctccatcgcgacaaagcggcgaaacttacttccaatgcggtggaacacagcactggttggccatatgacccaactctgactgaggacacccaacaggcagcctcacgttgcccggaaaacacacattcacactacccggttccagcccccctttcgtcgcaccaacggctaacctggatctaagacacccactctcacaccttgacacgtatagcacgatctattaccgagcatgatgagcacgagatgtggaacacgcagcgcagcaccaaaccgctccgggcacaacatactaaaactatatcatgacccatgatcacggcgcaacgcaccctccctcaaaccaacaacgacaataacaaaaggcctccaatacacaacatccaacctatagtaaccgacacacacgcataccaaaacacacactatcactcactcgtgaccaccccgtcctctgaccactcagaaccaccagaacatacctcaaacacctatacaaaccaaatcaaaccctaatactactcatcctccacctcccatcacattctcccaccctagtcaccacctatcacaaccaacatcaacctcagacctcccaccctgaccaacgccaccccatacctcacatacccttgcgtctacct

SEQ ID NO: 499793 - DNA, 334 bp, Homo sapiens
gctcatctctgtgggggtgtagggcgcagcggcttatgacgtgcaggcggggcactgggcactgtgcactctgtaccatctgggacaggcccctcccttgccccaggtgaggtttcctgaactggagcctccagcctccctggctccacgctcagccccttcatcctgacctctcgcctgtaaggtcctcgatagacggactccagcagcaaaagggtaaggcatctcctggggactcagaggcaagggacaagactgtgggacacccacttcctgcaccccaatacagactgacgctaaggtcggaactgactctaggcacccgggcaccccg

SEQ ID NO: 499794 - DNA, 147 bp, Homo sapiens
ctggggactctcttcctgctccgaccgccctcgatttcctctccgcttgcacctccgggacatcttctcggcatctcctgcttctgggacctgcagcaccgtattgtggttagctccttcttgccaccaaccatgagctcccggagt

SEQ ID NO: 499795 - DNA, 865 bp, Homo sapiens
cagaggttgcagtgagccaagatcgcgccattgcactccagcctgggcgacaagagtggaaactctgtctcaaaaaaaaaaaaaaaaaaattcagtgaaatacacctttatttttgaaatccaagttccacttttggggatataatgagccagttttctcagtaatggtctactaaaaaaaaagccattaacctttctctaatattggcatgattctaataaaacgtttgtcaacttcttaaaatggttttattggaaatggtgggcattccttggaattttatgactttaaaataatccacgacatggtacagctcttcacttttcagcttttaaatgtccattaatacggttcgaattacgttacaactttttttgtttaccctcaacaaaattaatgggcaattattgttcactttggtgaccaacaaaaaaaacaaaaaaaaaaaaaaaagaagaggagaaaagcagcacacagacagaaacacaacaaaaagagaacacaaaagataaaaaagaaaaccaagcaggagcaatagtagaaaagaatgaggcacacacatgaggggaagcagacgataaataatgaggacgacaaaacttggagagacaaaagatagttagaaaaaaaagataggagaaaggatggaaaaaaaataaacaaaacaatgggaaagataatggagaggaaagagacaaccataactaatagagaaggaagaacacaaaaggaaagaaaaagaaagatggaaagaatttaaaagagaaagagaagaaaaaaaataaaagagaaagcagtgaaagagggaataaaaagaggacgaaaaaaaataaaaaagaacaacaaaagagacacaacatgata

SEQ ID NO: 499796 - DNA, 632 bp, Homo sapiens
  misc_feature (609)..(609): n is a, c, g, or t
  misc_feature (620)..(620): n is a, c, g, or t
ttggctcaagggaatgttgtagctggattgatcttctctttcaaccaaacattctccacatcagcaatatgccttttaattcatgtgataactaaagtagcaattttaatttccaagagcttttcttttgccttcataactcaactgtttgggggaagaagcctagcttttggcctgtcttggtttttgacatgttttctttactaagcttggtcatttctagcttctgatttaaagtgagagattgactcttcctttcacttgaacacttagaggccattgtagtgttattagttagcctagtttcagtattgttgtaacatctcaggaaatagggaggcccaaggagagggagagagatgagggagcagctggttggtggaaaaatcagaacacaaacatttataggttaggtttgctgtcttacatgagcgcagtttctggcgcaccaaaatgattacagtagtaacatcaaaaaatatcacagatgaccctaatggctataataataataaagcagtctgaaatattgtgaaaattatcaaaatatgacagacgtgaagcgagcacaagccgttggatgatgccagcgcttgcctcatacagggntgccacgcttncattcgtttgct

SEQ ID NO: 499797 - DNA, 897 bp, Homo sapiens
  misc_feature (32)..(32): n is a, c, g, or t
  misc_feature (100)..(100): n is a, c, g, or t
  misc_feature (109)..(109): n is a, c, g, or t
  misc_feature (209)..(209): n is a, c, g, or t
  misc_feature (311)..(311): n is a, c, g, or t
  misc_feature (323)..(323): n is a, c, g, or t
  misc_feature (351)..(351): n is a, c, g, or t
  misc_feature (473)..(473): n is a, c, g, or t
  misc_feature (483)..(483): n is a, c, g, or t
  misc_feature (513)..(513): n is a, c, g, or t
  misc_feature (549)..(549): n is a, c, g, or t
  misc_feature (553)..(553): n is a, c, g, or t
  misc_feature (569)..(569): n is a, c, g, or t
  misc_feature (573)..(573): n is a, c, g, or t
  misc_feature (595)..(595): n is a, c, g, or t
  misc_feature (597)..(597): n is a, c, g, or t
  misc_feature (605)..(605): n is a, c, g, or t
  misc_feature (611)..(611): n is a, c, g, or t
  misc_feature (619)..(619): n is a, c, g, or t
  misc_feature (659)..(659): n is a, c, g, or t
  misc_feature (781)..(781): n is a, c, g, or t
  misc_feature (792)..(792): n is a, c, g, or t
  misc_feature (838)..(838): n is a, c, g, or t
ggcttcatgtggatgcataaaattttccagtnggtaagttgcaggtgccgaggtgtgtggatcagaaaaaaaggcaggaagctgggttcccactcgcctnccatgagcnctccgcagctcaccggccatcacttgaagcaaacactcctgagggagcaggttgaggaagggcagatatccggcttcttgccctggtacaactggcaganaagggtaaggagctgggtctgatcttccaagggtttcccattgacggtgacccagggcacatactcgtgtggtggctggagagcatcttttcgctgggcgtnggcgtgcatgancagcatgccgcggtcccccattgcacantccatgaaagtttttggcgacacctggggcgtagagctgcaggcatagtggcagagttctctacatgtgctcaaactcttccatgcagaaaatggtcaggaaggctagctccatgttaagtncatccaacangcaggcctccaccttgttgaatttgcactnctcttctccatgctggcacttgaactcccacctgcnactnacattttgttcctgtncgtntccgtaggcaccagcgtgaaantnaggatctncatgancaacagcnatgttgggaagagctcccggatcaggaaggctcggcagcnaccgcacagtgcttcatagtagagggtcacattgacaagcggtacattggactgcttcaggggccccgcagttatagattgcctgtcttgtagttaactggtggcccattcccaaagaagtntaacgcttgcngaggggacgcctgcccgccgccgtggggacgtcagcagcagcagcngccgtggcaggaacagcagaagtagcgacagggtcatcgcagccggggcaaaggtgtgg

SEQ ID NO: 499798 - DNA, 873 bp, Homo sapiens
  misc_feature (621)..(621): n is a, c, g, or t
gggtccctccatcgtgcaccgcaatggtttctaagtggactcaggagatgcgtagatttgctggaagaaagtttgcccgctgggcaagatgcggaactacctgccatgctagccctcacgaaacctgaaagtatcgcgttcgataggacgaacatcgggtcctgtgaagttttgtcattcttgagtactccggcagcgtggactgtgtatgaacctggttgtgtgatcttgaccctttgtctttgaatctataccctgtaccccttggaataagcgggtcacgggcatgagtgtgtaccggggagatttgcttctagaggctggtcaacgtagctcacgttgtgtgttggtcctagggcggggatctggcagggtgtggtgtgtcctagtcggtaggagcccagtttcctatttttaaggcttgagtgtactatggtgctcgagaacgatcagtgtgaatgtgttacttggactagatgtgaaaatgggggttagtgatataccgccctgtaaaatgtattcattcttaatttatgtacggttttttggtacgcaattctcgattcttgtgaagagatgacaacaaatttgtggtttctacttgttatgtgagacacattnaggccccagcaaacacggtcattgttgtaggcacccctacacagtgctggcggtaggcaaagagagagaaacccacacacaaaaaaaccttggggggcagccgcggccaggaaaagattcttaacccatcgtggggggccggcgcccatatttagaggacaggggcggagctgtccagacaccgggggaactgggggggttccccaaaacccgggcgggtgacccccgggcgggaggccacgggcggctcgc

SEQ ID NO: 499799 - DNA, 681 bp, Homo sapiens
aacagtacctgcacccctcccccctattgcacacgccccgtcctcgtgcgactggaggacacgccccctcctttgctaccggaatctaatcctccctcgcaccggaccaccttctctgggtataggggaggcgacttgcggtcgtggttggcactgcactgactgcctcactgacgcccgctcccttaccctgtggggtgaggggagcacccgcttttattccacggagtagcttaataggacccgcccgctcctggctgggtgccccaactccccttcgtgcggcatgcttaatgcttctggggagtgagggcggctggtcccagccggagccggactcttcgcccgactccggggagaaacgcgaggggctgagtgtagagcgatcctgggaaatcctttgatccgggagccctagtgtttcctctccagccaacggtggcgtcagttgccttaaattgggaggagcactcggaagggtatggaaaagggcctgaaactctcccaagtggacatagccccttttccggtatggggtctcactacaccccacgacgcaagcactctccggtcagcgttgactgcctctacagactacctatacgttcctttttacgccccaagtgggaattgagaggtaaggtctctctctggtaaatccagcagcaagaggaagggacc

SEQ ID NO: 499800 - DNA, 181 bp, Homo sapiens
caatctgggctctcacacacactcacacattcagtcttacacacattctcacacacacattctcacgcgcacacacactcactctcgaggagcgtcacacacccctcattcttttccacctgttctccacagcaggagggacagagtgcctggtgcctggcatgcgtgtgatctgtggggt

SEQ ID NO: 499801 - DNA, 1101 bp, Homo sapiens
  misc_feature (22)..(22): n is a, c, g, or t
  misc_feature (864)..(864): n is a, c, g, or t
ggctcgttctcttcgcgaccgnctgctgcgctgatgccacctgtgtccccacggcgggcagcagcggcggcggggcggctgaacgcggagggggcggagggagcccgcggcggcggcagcagctacagcgaaatggcggagaccgtggctgacacccggcggttgatcaccaagccgcagaacctgaatgacgcctacggaccccccagcaacttcctcgagatcgatgtgagcaacccgcaaacggtgggggtcggccggggccgttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgttttgcgtcagcttccttttagaggagatgatggaatattggatgacaattttatgtgaggaaagaaaaccaagggctggagcagtttataaacaaggtcgctggtcatcctctggcacagaacgaacgtgtcttcacatgtttttacaagatgaaataatagataaaagctatactccatctaaaataagaaatgcctgaaattgtggcaagaaggggcaaaaacgtgactattaagtgatgtggataagcaccagtgaagaagttctaacttttagcatgctgacagaaatggtataacatgccttcagtatactaacactcatatgctcagttggtgtggtggggcagtggacaagaagttaatggcgttagtaaaaatcctcattccaggctttttatataaatagctctttcgtgtgttgtagtgtggtgacaatatagnctcaacaactgtattcagtgtaatctggagtgtcgaactaagtagtggttggtctatgtgacaagtttgcgttggggtttgatttgtaatagaaatttttcttcccttaattggtgttggcctttgtgggggctacctggtcaattgcactagtaattggggaagatttcgggaaccaggaaagggattttgtaaagattaatttggatgtgaaagttggaaaaaagggtgaggggg

SEQ ID NO: 499802 - DNA, 941 bp, Homo sapiens
  misc_feature (103)..(103): n is a, c, g, or t
  misc_feature (138)..(138): n is a, c, g, or t
  misc_feature (732)..(732): n is a, c, g, or t
  misc_feature (810)..(810): n is a, c, g, or t
  misc_feature (921)..(921): n is a, c, g, or t
catagagctagatacaaggagggtttttagaagactgactgaacaaatgagaagtcaaggcaaaggactctggaatctgactgcttgggttcaaatgccaganctgtggttcctgagtggtgggaccttgagcaagtnacttaatgcttctacaaagagttgtcatggggattacgcatcatcatgtgtgaactatagggcgcactccagcctgaagacatagactcagtggagccagcactgtactgtgagccagcgtggttaactgcactgtgacagcttgacagaacactgatgctgtgtgcaggtgggtgtgtcaccagagctctggtgtaggaggctggtgatctggggcaaatcatttcccttttgtggaacaaagacaaaggcctggacacatgccctctgtgagcccttcctgctctggcctccatacgtgccgtggggttgagagtttgtgagccgttccctgctctgggggtctggagagcacattttcagcagaggctctgccccagtttctgacctgactttccagctggagacctcctttccctgccctcccctcctcctccagccgtccctgccacaaccctgcatccccaggagggtaccagcgctccactgctgagtaggatcatgaagatgatgaatgtctcgaaccagctgtgctccacgatgtggtagcaggtcttgcgcaaccgccaccagaccttccctggggcctgtgtngtgtcaccgcacagcagggacagcgccggacacagcctatgggagagagttagggtcaggcccacctcagggcctgtnaatgcccacatctaatggcagaaggttggatggttgaagagatgactgagagaaagagctacgatgatgggggtggcgaacagggcaatatggtgagcagggccgtgtgancaaggccgtggcacacccgt

SEQ ID NO: 499803 - DNA, 290 bp, Homo sapiens
cccctccccctcccccagcccctagaaaaccactcatgactttgcatctccatgaatttgcctattctgaacatgtgaaatgaatgagatcatataatagatgagattttgtgtctggcttctgtcactcagcatcatgttgctgagggtcgcctgcattgtagcctgcgcctgtgcttcactccttttcatggctgggtaatattctgttgcacagatatggaactcatctacgtttgatgcagttgtccagagaaccatttagggtgaaaataaaatcctttaagcta

SEQ ID NO: 499804 - DNA, 857 bp, Homo sapiens
ttcccaggcagtgcagtgagccaagatcataccactgcattccagcctgggcaacagagtgagactctgtctaaaaaaaaaaaaaatcagggactaggggagatgatcgcatgacctcgtgaatatatttaaaacgacggggctgtatgtacactttacaagaatgaacatttatgtgtatggggagttatatctcaacaatgattttaagggtttggttggttggttggttggttggttggtgtttcaatcagggccaaggccacacacagtgggctcatgtctgtaatcacggcaccttggggcaggtggcggcaggaagatcacttgaggccaggaattcgagaccaacctgggcaacacagtgagaccagcatctccaaaaaaattcgaaaaaccagctgcagtatggggaccaagtgaccgttctcccagcaccccggaggctgaggcgggaggaaacctaaggccaggaatgtgacggctacagtgagccggatgcaccagttcagttcacgcctgggggaaccaggaggaggacccaacccgtgtatcccgaggttttccggtggcaaaaaaaacagggtcatgcataggcatctgctagtgtggtccagtaataccgcgtggggcagttattccaaacgactggcgcgggcgtcaatagaactgtttgccccctgtgttcagggagcttattccaatggcaagggggtacccccccatggtccctagagagaggaggtaacagcagggatctatgccaggaattatgcgtaaaaaagactgcgggcgagccagcggtaaacatggcgaggggggcccactcgtgagcactgacagggccttcgataaag

SEQ ID NO: 499805 - DNA, 128 bp, Homo sapiens
ccaaaaggccttcaaatcatcgtttgttttccaaaaacccaagtccttgtttttgggtttgaaaaaccttttccccgaataaatgggaaagggttttttttaaatatatatatttttttaaaaagcca

SEQ ID NO: 499806 - DNA, 960 bp, Homo sapiens
tttcacttatagtgttctcaaggttcatccaacctgaatttcattcacttttaaggctgaataatattccatgctatgtgcaccatgggtcgtttatctaatcatcctccgatggacactcggttgcttccaccttttggccattgggaatagtgctgctacgagcatgagtgtacaattatctgtgtgagttcctgctttaccaattcttttgggtatatgcccaaaagtggaattgttggctcctatggaaattgtgtttttactttcttgaggaagcatcatactgtttttcatggtcgctataccactgtacactctcaccagcagtgtacaagtgttgtgacttctccacatcttcgccaacacttggactagtgaagtccagcatattttcatgtgcctattgcccatttgtatatcttctttggaggaattgtctattcatgttgttcactcatttttgcaatgagcattgtagttaactgttgttaacgtcatagtactttatgtattctggatattaattctttatcaggtatataactggcaaatatttcctcccattctgtgcatatttcttttaactctgtaataggtgtcccttgatatatcaaaaaggctttaaatttagatagcctaataatagttacttaatggttgtgctttgatcaccagacaagcagccattgcacatccacatgtctaaattacttcacagtctccaaacaattatcggtgaccaactaagtgagtcctgaacaatctgattacatggtaatagaataggagacgggaacataattgacaaaccatattcgatcgggaatagagtcaggaccaaaaaaggagaacctcaaacagacatagcgcgcgcaaagaaacaaagggcaatccggcacaagaacgtaagcaaaaaagggaaaacagaagtaatagacactattctgttatacgaat

SEQ ID NO: 499807 - DNA, 168 bp, Homo sapiens
ttacagaagtatttggcggaactgtgccatgaggcagattgacatcgatgcgtgatgccatgtggtgctgctcggctgtgacaccactctcatccgacataccccccagccctcacccagcagcagcttcaatgagggtctgctcactgtgtgtggccacatgtgcat

SEQ ID NO: 499808 - DNA, 851 bp, Homo sapiens
gcaatggaggtcactccactgtcactacaaattcctgggaaggaaacttccccagattcctccacttggaggtgtgtgctcgggctcagtgctaggagggaacaggtgagaaagcagccagtgtggtgtgggtttgcatgctgatggagacaccccaggggcaaacatgcttgaccccagacaggatgtccaaagaaatggcctgctgacgtcctgataatcccttatgcccctggacgctgcctctgccttgcatgagtgcaagctgtcccctgcagccatgcccctgggctctgcctggcggtgatgtgaccctggctgggtcagggggttgtacttggacacttggtcccagcccaattcaaaattggttgaattttatggacgcctgttgacagtccgaaattgccaatcactcccacttggctgatgacacactacatgatgcatgccacggcctctatgactgaattgccccgacacccggagtgcctggggtgtcgctgctggaatcaaccaaaatgaccttgggtgtttcaagtgccgctccaactgagacgaccgttgtatggtatatgtcgaggccagctaaaggttgcccagtccagaggtttccctggcttcttgggctgtcctgttgtgggctggtacctcagagaaagctagacagggacgtcactgtcctccggttcaccttccccgggctctgttgccggcctccacattggcttgttgggtcttcccccagccctcccccgcggccccctagcttcattgtgtcttggggggctgtccccttggcgtggttcttgtttggatttttgggcacagtgcggagccggctggtgact

SEQ ID NO: 499809 - DNA, 479 bp, Homo sapiens
  misc_feature (82)..(82): n is a, c, g, or t
  misc_feature (149)..(149): n is a, c, g, or t
  misc_feature (235)..(235): n is a, c, g, or t
aagacctttgttcccatggtaacaaagagaaaaacgtgaaaaaataataatcatattttcctatgggcctagcaaagagctnttgagacaagaaagccttgacgaattgaattccaaagagaagctgacattcaaagaaagtcagagancctggtggctttcatacttggtctggacaaatagaagagcagttctatcacaaagggagacgcttggcagagcaagaaaaagtcantcaaaccttagattgcagagtaggctggtgggacagattggaatatggaggagactaaaaatacaaaacagaaacgctgggcgtggcagcactcacctgtggtcctggctactgaggcaagaggatctcttgagcccaggttttcaacgttacactgagctatttctgtgccactgcattctagcctgggcaacagagtgctgcctcacctctaaaaataaaataataattcttaaagaaaaaa

SEQ ID NO: 499810 - DNA, 94 bp, Homo sapiens
ttggctgtgtatctctgtgccagcagcgccgggacagggcaggcggggggcactgaagctttctttggacaaggcaccagactcacagttgtag

SEQ ID NO: 499811 - DNA, 615 bp, Homo sapiens
aagggcactagtaactttaaaacggtccaatgcccaactttttgtaaatgtgagccttaggacaagacgcgcaaccgctttgtatacctttactgtaccgtagggatcaacgtctctccctgagaagtgagctggtaacatcacagcatcaaagcattagaaagatttagtattttgtcatgtaagtacccctgtagtgatggcggttgcggttgtcaataacgttggtgttcagaagttcaggttgtgcatgcgcattcccgcgttcatgtttgtctagttttagacgagcgttcagtgcttgaaaagtggtgtcatccggccattgttaagtgtgtcagtatgagaggatcctgttgttcaccagggtcatcaaaataagcgtaaccggtcgcattcaataaaggtcattagacgccattctcgattccctcattgttcgagtcatctgtatatagcttctaatacctccgcccatgaaatgcatcgttcaacagttaggtacgggtctcacacagtgagttcacactttcagcaacaactcatgtagagtctggtccagacagagtgtacaggtcacagcaatgtagtcctataaggcatggtaggagcaag

SEQ ID NO: 499812 - DNA, 237 bp, Homo sapiens
gccacccaaatgtgtggatgaacttggccaaagaaacaaaaaccgccacttccgcttcctgtgggctccatttccgacccctcctccaatagagcgtttaacactccgggggtcccgcagcctcctgtcagcatttccccggggaagctgagcacgtgaatctcgctgttttttttcgaagggttgtcttggtgctgaataaagggggttaatatctaggcatataaatagaaatga

SEQ ID NO: 499813 - DNA, 130 bp, Homo sapiens
agtcctgcaatgagtttgagtacacaatttgattacacgttcagctagcgcactgtggtgagttttgatgtaatattggtttctcgccaggcgcggtggcttacgcctgtaatctgagcactttgggagg

SEQ ID NO: 499814 - DNA, 687 bp, Homo sapiens
  misc_feature (464)..(464): n is a, c, g, or t
  misc_feature (471)..(471): n is a, c, g, or t
  misc_feature (573)..(573): n is a, c, g, or t
  misc_feature (579)..(579): n is a, c, g, or t
  misc_feature (602)..(602): n is a, c, g, or t
gatccagtttcattctcctacatgtggctagccaattatcccagcaccatttgttgaaaagggtgtcctttccccactttatgtttttgtttgctttgttgcagatcaattggctgtaagtatttgggtttatttctgtgttctctattctgttccattggtctatgtgcctatttttataccagtgccatgctgttttggtgactatggatttatatcataggttgaaatcaggtagtgtgatgcctctagatttgttctttttgcttagtcttgccttggctatgcagctcttttatggttccatatgaattttaatatttttttccaactctgtgaagaataatgttggtatttttatggggattgcattgaatttgtagattgcttttgacagtatgggcattttcacaatattgattttacccatccttgagcatgggatgtgtttccacttgtgttgnctatganttctttcagcagtattttgagttttccttgtagagtctttcaccttcttggttaggtatattcctaaagtatttaattaaattttttgcagctatttgtggngttgangttcttgattagattctctgttnggtcactggtggtatatagaagaacttgtgatttgtggacattaatcttggattccgctttgcttgattattttaatagtcctgc

SEQ ID NO: 499815 - DNA, 174 bp, Homo sapiens
acttttgcatgcggccggaggcctaccttgcaggccctctccctaactgctgtccccactcgaccccagtcaccctagcttggtctgatagtctgtcgtgtgagcagttgcatccttcatggcatctccaatgatgaacgccccatgtggcactcatgatacatgcacaccgag

SEQ ID NO: 499816 - DNA, 139 bp, Homo sapiens
cgggaatcttccagctgtatgcctattcagtatgatcttggccgtggataaaaactagtagctcttattatgttgagatacattcaatcaatagctagttcatagagtgtttttagcatgaaggggacgcgggtgaact

SEQ ID NO: 499817 - DNA, 471 bp, Homo sapiens
tggggaaaaggggggggatatttgggcccggggtttgaaacctgccggggaattatgggaaaccccgttttccaaaaaagggaaacacaacaaacaaaaaaacaccaagaggccgcaccaaaaaacaaaccaacacacatcgaaaaaaaaaatttgtgggcgcgcgccgcgcgcgggcccagaaaaaagagtttctaaacaccactgggtgcgtgggcgcggcgcgggcgaccaaggtagtgttgatggaaaccaaggggggccacacgggctgttcccaagaaggagaaccctggtggacaacagaaatcggggtggtgtctcttccccaaaaaaaaagcggcgggcggggaacacagcggcggtgcttttcgaccaccaccaaggagggtctgggagcgacacaaggggggcttacaacaagggggggaccaacagagagcggaaaataaacttcgcgccccgcgggca

SEQ ID NO: 499818 - DNA, 148 bp, Homo sapiens
tggttgggacccggggcccttatattgagaggcatatcattagaaaaagggggcggggctccccataggtgtcccccgattctccgctctctttatacaaggtggtgtcttcatatacatagtggcacacacactgtgtgtgtatgga

SEQ ID NO: 499819 - DNA, 1283 bp, Homo sapiens
  misc_feature (75)..(75): n is a, c, g, or t
  misc_feature (171)..(171): n is a, c, g, or t
cttctgggcagtgacagtcatggtcataatcctgaccctgagccagtgccaggtctccaagtgccttctgaatgnccacaggcgattggttttagtggtaggtgtgtggggatctgttctggtcatctggatgctggtcatcggtgtgcagtattgatcaggacctgcaancccaaaagcttatgggagctggcacgtcacacaaaagacacacacaaacccaagcccacagcctggacagctctgcatccaggcaacaggtgcaggcaacagccacacccatcgcggcacaccatcgccacagccagatcagccaggcagcatacaccatggcagcatcctggtgccagcactagcagctcacacagcaaggcccctataaagcaacacggagcgtcggaacaccaaaaccacaccagggcaccctcgacaagcaccaccacgggggaaacacacactgggacgtaccctggccggaagacactggataggcacactccaatgggcctaacacggaatggggatccatgtgacaaggccaccaaacgccaatgagcaggcgaaggcctaccacacccgacgccatccctgggcaaaccgacagagacattcaaccggggcctcgtggccgcgcagaacaaccgcgacagcaccaccataccttgaccgacgcacgaacccaacgactccggggcgaccccaacccaagcacgagcgacccagccggacgtggcgcacagatagagcaggaccaaaacaggaccccggacaaggacaccagcaccatagccaagaaaacacagccccgagacgcagcccacatcaccccatcgccgggacacgccaccaaccagacaccaaaatcacacccgacaagacccccgggcccccgaccacccaacaagggggcgacagccggacaaagccccggcagggcgcaggcacacaccacagcgtgcccaacgccacaagaacaacgggaaaggagacacggaaccgcgccaggcgacacgatgcagaggaacgtgcgacgcagcacgccagaggcgaacccggaagcaccgacagggacgcacaagaggaggacagcagaggggacccacagagcgaaccaggccacagcaccaagtaacaaaagccgacgacacacgcgcacgcgacagcaacccacgcaagacgcacagcggctgccaacgagccgaagccaacacgaaacgcacacaccaggcgcgacgaccggacgaacagacaagaagacaaaaacgaaacccagacggcaggcc

SEQ ID NO: 499820 - DNA, 534 bp, Homo sapiens
  misc_feature (75)..(75): n is a, c, g, or t
  misc_feature (171)..(171): n is a, c, g, or t
cttctgggcagtgacagtcatggtcataatcctgaccctgagccagtgccaggtctccaagtgccttctgaatgnccacaggcgattggttttagtggtaggtgtgtggggatctgttctggtcatctggatgctggtcatcggtgtgcagtattgatcaggacctgcaancccaaaagcttatgggagctggcacgtcacccacagcctggcagctctgatcaggaaagtgaggaacagcaacaattccggaacattttcaagcagatagcaggagatgacatggtgatctgtgcagattttttttttttggtccttaacacaaccgtttttctacacaaggacctgaagacacacgccttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaat

SEQ ID NO: 499821 - DNA, 177 bp, Homo sapiens
atctgacgacgtgacgagcagattacaactgccagaggcttactcttacagatcgcgtatctggagattacatcgtttgacagacgtttgtgcaggaataaatttaagattcttaggctaggacttctctgatcttctgaggtcttaccattaattaggaagcagttcctttcgaag

SEQ ID NO: 499822 - DNA, 167 bp, Homo sapiens
ccaggatctacagaggcacaaggaggtgtagtaaggccattctctcatcaaacattttattggatctctggttagatgaacctcttgatttcatcataattcaccatgtctcccatggagccaggacgaccaggcaagccagtgctccccggaaggccccgtgagct

SEQ ID NO: 499823 - DNA, 552 bp, Homo sapiens
ggcctggctcacgtaaggtcaaaccatttgtttatgaacattactgtgagctccagagctggatctgcatggtccagctccagcaactgcatcccacctggaaactcctatgcatgcctcaagacccaactcaggccaagtaaggtggctcatgactgcaatcccagcactttgggaggccaaggtgggaggatggattgagctcaagagttcaagtccagcaatatagtgagagcccttctttacaaaaacattttttaaaaagagccaggcatggtggcatgcctctgtgtcccagctattcaggaagctgaggtgggagcattgcttgagcccaggagttcaaggttgcagtgaggtatgatcgtgccactgcactccagcctgggtgagagcccatctctaaaaagaaaaaagacccaactcaaatgttccgtcctcccgtgaagtagctccgtctgcttccccgtgggctccttcatctattctcccacagcctttccccctgactccaagtgggacctcgatcaaggtcctgtgattccctgtgga

SEQ ID NO: 499824 - DNA, 268 bp, Homo sapiens
gatgttatggggtgacagtggcattcagccctagatgcttcctttcatgtaacctgcagtccagtctaaccaggagataatagacacattttaattgagggacattcgtgcaaaatatctgcccagtactcttcgaaactgtcaaggtcatcaaaaacgaggaaagtctgagaaggagcctagagacacataactcaattgtaactggggtgttctgttggataccacactcagggacgtgatttttaaaggctaaggaaagtgtcat

SEQ ID NO: 499825 - DNA, 876 bp, Homo sapiens
  misc_feature (117)..(118): n is a, c, g, or t
  misc_feature (153)..(153): n is a, c, g, or t
  misc_feature (165)..(165): n is a, c, g, or t
  misc_feature (167)..(167): n is a, c, g, or t
tctttctgtttccaaaacttgaaaatatgtagatggactcatgcataagactgttttcaaagcttcctcacattttaaagtgtgattttcctttaatatacattatttcttaagcanntatatccaaccatgacttggagatatacctataancaatatacacgngntatgaagcagctttctcaaatgtggcttcagatgtgcaagtggccaaatttcatgtatggtagaatacaatttgggttttaaactgtattcaatctatttctccaagatgctttcatatagagtgaaatatcccaggataactgcttctgtgtcagtcgcattgtgacgcataagtgcacaaatgacaccagtgtctactctgggtggtgcataaccttacatgtataatttcggcatctgtgttcacaaatgcattgtgttagcaaaatcacctttatttataagtgacactaatgacgttacggcatataaagaaacctgcaatttgtaagtccagcgtcgctccatttgtccataacaccactgtcatggactgtgcacagccattccgtactccgtcgtaaccaactccagatcataacatctggcaaacagttttcaacctaacaacaacagcactaccactcaaaacacagtgcgccccactgaccaggaacgtctcaagcacacgtgtggcgcggccccactggaagtaaagggcaaagggacacagaaacccggagaaagggtgccccaaacaaccgggcccggggtcagaaccagggtcggccagtggtacaagccagcaaataccgcggggaaaccaccacgacagcagcagacaaccaacgacaacaaagagccagacaccaaacactaccagacagg

SEQ ID NO: 499826 - DNA, 983 bp, Homo sapiens
gtgggtatatgatatatatatgttaatttaaaagggtaataatgagggctggtaagtaaacaggatatgttccttgaaatgtaaatttcgtccggtcacttgattttcaggatttgtcagactgctgatgctgtgtacaggagggggttgaaggaaaggttcgagacctcttgaaggacatcgtgtagcgctgtaacctgaggggccgcattggtatctgtgggtgctcctacgtcactaggctgtgattttggggaaatggggccctccaccttatgtagatccagagtccgtggctctgagcatcctccctttgcccactggacctgcctgcagtgtctgccttgggaatggtcaagacagagatggtatcgtgcagcctctggtctccacacagtgagagtccagggctcagggctgctcaagaccaaggcttcccttgatgcgtcacttcgggtgatcagacatgggggacctgtttatctcttagtagccggcaaaggcaatcgtaaaacatcgtgattgtgaaccttgcaggacttgtcactgctaagaacaccttaatccacaatttgctcatgctgctcctctttgcagaggggacagggagctccaggcccgagagcctattattaagcagtgaggagcagaagcagcggatagctgtactatgccacagaagaacaagaggagctcaaggtagcaggggacagatgggctttcaagcagagctcggcgccaacacatagcctagtgtgcctgtacctggggctgactaggggagcagtagagctgcgtgcagaacgcacggggaggggtctttactagagtttactgtctgcaggtctgtggtggatcctgacaaggtgtccctggtgttagacatggcagtatcatgatccaagagggccagggagagggggaggtacagtcataggactctttcttcagtctctttaaggtgcaagaggacttttcatgag

SEQ ID NO: 499827 - DNA, 204 bp, Homo sapiens
cgcaatcacagcgcagggcaagctggcttggcagttcattatgcctgtatcaactggtgacgccatatgaatataagcaagcagcagagagagaagctcttataatagcaatgccgatattcctgcctcgtcatcagcaacacatggttcagctccttcctgattcctcctattattctgtattactgcagaaacaaattctga

SEQ ID NO: 499828 - DNA, 855 bp, Homo sapiens
cttaagcgggtggccgaagtgtggatggatgagtacgcagagtacatataccagcgccggcctgaaataccgtcacctctccgctggggatgtcgcagtccagaaaaagctccgcgagctcccttaactgcatagagtttcaagtggtttatgacgacagcatagtcctggggacctgcccatgattctacccaaccgtggaatggcccccggttgcaggcatgtggggggagatccgaaagtgtgggcacagggctgtgttgctgagctactgaagtcagccggggcctatgggctctccactaagggctagagggctgcgtccgaggccggtggggaggctgtctggagcaaaatgcaggtatgcacctttcggccttgaatgcagaggacatctccggcctggtagaaccctgagtcaacttactcaagaagtttctagcttatgattgctcgatttccgcaaggacctagccacgcgtgatctacggctggtacgaactgcacagcagcagtggaatgggcaaccagtcgttgtgagaaagagtaccgtcgaaggacactgaaccttgtatcacactctgtcagtggctagctgcattggacatgacgagctgaaaacgtggaacaatagggatctttctatggaagcaccgtggcatagccagcatccctcgtcttcagcccatggaggttgggcattgttttgaagcacatccaactcaaacaagtctttgggaaaggatgcaagttacggagactggagccactcatgtgccccttggtagggcccccccaggggtcatggcactccattgcagaacttgctcatacacagggaggcagggccctgtg

SEQ ID NO: 499829 - DNA, 284 bp, Homo sapiens
acacggggaacggaagccacacaaccccagtggcttcctaaggcagaagggaagctgcgtcaatcctaagaacacttacaatagtgtttgtggggaggggctgggggaaccagactcaaacaagccaagtctaaaaattatatacaaaaaaggccgggcatggtgactcacgcctgcagtctcagcactttgggaggctgaagcgggaggatcgcctgagcccaggaatttgagatcagcccgggcaacatagggagacaccatctccactaaatttttttttt

SEQ ID NO: 499830 - DNA, 512 bp, Homo sapiens
  misc_feature (77)..(77): n is a, c, g, or t
ttggactgagccctgtcacctctgtgatagtcttcactctgacaggcaatggtgactgtgtgtgtttcctggggagnaggttagcagggacggttgcctttcctgggaagggcggtttgcagaaccaggggtttatattgcagggagtgtattttctgaattctaagtcagaacaagcagtctgatacaggatccatggctgggtcacttctgggtgcaagaggctttctagaccttagacactcaagattacggtcccgggccagtaacagcacctgggagcttggtagaaatgcagaatcttagcctaggcaacatagggagacctcatctctgcaaaaaataacaaaattagccgggcatggtggtgcacacctgtagtcccagctattctccaggctgaggtgggaggatcgcttgagcccaagaggttgaggctgcagtgagccatgatcgcaccactgcactccagcttaggcaatacagcgagaccttgtctcaaaaaaagacaa

SEQ ID NO: 499831 - DNA, 482 bp, Homo sapiens
cctggaccttctggagtcacatgctggtgcttgacgttctggagatttcagggtttccaggtcctcttgatcccgcaaaacttctagtgacttcgtagagactctctgtatgctaaaagattttactgcctctaatgctctgcgtctttgagtgactttaagaactcttgactcctcattatcaagcaggtctagctatctcctggtcaagagacttctgctggttctagatccactttttctgggtgtcttaatgtcttctgatcctgttcgcctagatacctccgtcgctgttgagtctctttttcaaggagttctccttgtctcttggtcctgttcttctaaagacctctgtgatttgtgattctctgtttctagaggtctcacaatactctggtcctcttcttctagagtcttcagtggctcctggttctctttttctagagatctaaaggcctctttgttctcatcttcaagagacc

SEQ ID NO: 499832 - DNA, 535 bp, Homo sapiens
  misc_feature (408)..(408): n is a, c, g, or t
gtctcagccggcaggaattcctcaggtatctggggactcctgggtggtcccattggaagaggggaagactaagagcggacggggacctgaagccggtgcacggtgaccatctacaagggccctctcactaggcggtcggcgggggaatctgactaaataacctcacgcatctcttctggggcagagaagtttcccactctgtctgcaagctacagaccgggctacctgtggttctgagagctgagtgaggagaagcggggggtgggagaagtcctcagcattcgagagggctgcatttaccccacactccggtcgggggaaaaggcccccaccttcaacggggcctagagtccctcatccagaaaggctgggtcagtctctccggtgagcgagcactcagacttcggncggggggggggggacaggccctcaggggcatgaggtgagggcaacagctggtcggtttcctaaacagttctcagccaattctgcttctggtctttaccctccccattctcacttctagggtttaatt

SEQ ID NO: 499833 - DNA, 2493 bp, Homo sapiens
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 499834 - DNA, 727 bp, Homo sapiens
gttcgtgggggcattctttcctccactgctgctggcctgcctacatcacggcccaccttcctcacggcttcggtgcatctggggttgctggttctctgtctctctctctccaggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 499835 - DNA, 888 bp, Homo sapiens
  misc_feature (619)..(619): n is a, c, g, or t
  misc_feature (623)..(623): n is a, c, g, or t
  misc_feature (625)..(625): n is a, c, g, or t
  misc_feature (634)..(634): n is a, c, g, or t
  misc_feature (644)..(644): n is a, c, g, or t
  misc_feature (659)..(659): n is a, c, g, or t
  misc_feature (667)..(667): n is a, c, g, or t
  misc_feature (672)..(672): n is a, c, g, or t
  misc_feature (677)..(677): n is a, c, g, or t
  misc_feature (681)..(681): n is a, c, g, or t
  misc_feature (685)..(685): n is a, c, g, or t
  misc_feature (696)..(696): n is a, c, g, or t
  misc_feature (698)..(698): n is a, c, g, or t
  misc_feature (721)..(721): n is a, c, g, or t
  misc_feature (724)..(724): n is a, c, g, or t
  misc_feature (727)..(727): n is a, c, g, or t
  misc_feature (754)..(754): n is a, c, g, or t
  misc_feature (769)..(769): n is a, c, g, or t
  misc_feature (773)..(773): n is a, c, g, or t
  misc_feature (788)..(788): n is a, c, g, or t
  misc_feature (795)..(796): n is a, c, g, or t
  misc_feature (826)..(826): n is a, c, g, or t
  misc_feature (830)..(830): n is a, c, g, or t
  misc_feature (832)..(832): n is a, c, g, or t
  misc_feature (834)..(834): n is a, c, g, or t
  misc_feature (836)..(837): n is a, c, g, or t
gcctgcgctctccttgcctcggtcacgctgttccccaaccccctgacggacccgctgtgcattccctcacgttggcttattcgtctgattgcccccctaccacggtggcacacagcctcatggcgctatagccgcaagggaacgatcaatggaggcaagcttcaggacgtgtggcccacgtgctgcttgtcctttccctcgatctagatccgttgttctattgttccgaggttcacctgtatgcaacatgccaagccagcgtagctccaagtgccctgcgtcactatcgatgtggaagaagtgttcagcctgcttcagtagggcctggagcgcttcctaggtgtcaccaggacccgcacgagttctcaacatcactcatctacacgcataccactggcgaagctccgggctgcggggcacgcacacgtaatcccaagggacacagcatcccttcaagtgatgacagggtaagaccagacgcctgaaatgtcgaccagccggcacacgtgcctggccatgtcccatgtccacctttctccccgggaataactggccctgagacccctagacccaaggaggcctgtccatgccaagcatccgggaagcatggctggccttntccncnccatggtcncgtcggttcncaggggcagcatggnagttcttnggggncaacngganagtntgggtgggganangggacttgtccaagcagaaggcnggnccntgggaaatgcataatgtaaggacatcnataatagtattattntttntgtaagggaaaatcnatatgtnnattctgaaatcattttctctgtaaatggtngatntntncnnccctaaagggagcttaaaggagaagataatattaataataaaaccagctcc

SEQ ID NO: 499836 - DNA, 2319 bp, Homo sapiens
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacattacctggcagctgtggacaagtggttgggagtccttctgcccaagatgaagcctctcctctatcagaatggagggccagttataacagtgcaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaatgatgatgtcactgtttttaatgtgcaggtattgaattatatggtctgacttaaatcataactagacttgagtgggctgaataaaccacttcactaacttgaagttcaaaggatgaaataaagaataaaaattgggccttgttggctctcacggtggaactttgcggccgttcctttagtgagggtaattatgatcctcgtacggctcgtgggctgggg

SEQ ID NO: 499837 - DNA, 2357 bp, Homo sapiens
agctcggtcgcttgtgcgttccgctccggccgccctttgcgcttggatccacttccccatctgtaacgaggtgttgagacgagaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 499838 - DNA, 336 bp, Homo sapiens
cgtcatacttcttgtgtcttaccttcttcaacgtccctgagaccctgtggcaggacttttgagtgatatcacactgggcctttgaatgtggcagcgcacactggtgcatcatagatctggaaagtgacggcgtcataggagatgaacatgcatctgagcctgctaatcgagaccaccaccgaatgtctaatgtctgtgcctcctatccacctaccctcccggacatgggcaaagccacctcctccctcaacaacgggagagacctcatacaggatgaacccatggatgcttcttgaatgctcgctactataattcctttactcatccccacgcact

SEQ ID NO: 499839 - DNA, 2637 bp, Homo sapiens
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctggttctgctgcttctgggccctacgcgcggcttgcgctctcgattccttccttgggcttttcatctgccacggcaagcgcctaagtctcagctgccgcttcacaaaagaggtaccaagactgcaccgaatgagcacgcaagcagcaacaggagtgggagaagaaggaggcggcagcagtggaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 499840 - DNA, 2368 bp, Homo sapiens
gggaactcctgacctcaggcgatccgcccgcctcggcctcccaaagtgctgggattacaggcgtgagcaggattttcattctaacaagttccagaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 499841 - DNA, 2312 bp, Homo sapiens
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctggttctgctgcttctgggccctacgcgcggcttgcgcaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 499842 - DNA, 864 bp, Homo sapiens
  misc_feature (395)..(396): n is a, c, g, or t
gcctcgcgccgtagccgggctgtgccaaacagcccaattatggacgacttcgatgatcgtgtgtcgcatgcggagaaggtacgcatacgctgctaaaattcatcactcatgcacccccaggggaattttactgactgtattccacattgaccgtccggctactacttacactcaatgaccaatctcctcaagggaacagggcggcagacacattgccttttgccccagttataaccatggatcagttccacgcccttgtgaaagtattacgcaaggatcatgaaggatccagcgtcttaattcacaggagcactgggaccccgcgcgctaatcacgcaggatttttcagatccaatgaaaacaaacaattttccttttcaaatttttgacccacnntcttcacgtgacaaagaaagggccaaaacgggggttttgggaacaaaacccaccacacgagcacacactcaaccatcaaaaaataagtgggtgcgttacactccctcacagtcctacaataaaacagatgatggtgtgaaaaatcacaaaatatgaagcacggatgggggtccgctaccgaaaaaaacaaagacctagactgagcgtgggggcggcaaacaccacacacaacagcacgaaagcacttgcaggcgagagacaccaaacacaacaaagagagacgctgcattgaagaagagcgagggaggcaagacccgtaaaacaaccacaacacgataggggacggtgcgtggctgcttcttctgaagagaggacctcttaaaaatgttacgtgacgcccacaaacaggagagaggtgagattgagtgggagaggggagggaaacagcaaaacaaaaccacgagaggg

SEQ ID NO: 499843 - DNA, 2145 bp, Homo sapiens
agctcggtcgcttgtgcgttccgctccggccgccctttgcgcttggatccacttccccatctgtaacgaggtgttgagacgagaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacattacctggcagctgtggacaagtggttgggagtccttctgcccaagatgaagcctctcctctatcagaatggagggccagttataacagtgcaggttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 499844 - DNA, 338 bp, Homo sapiens
  misc_feature (65)..(65): n is a, c, g, or t
  misc_feature (337)..(338): n is a, c, g, or t
atagaatgaaaagcaatttgaggctgggtaattgagaaagtcctcaagcttccgtatttcccagnctttgttcaccttatcccctccccttctgcccaaagttttcagggaataatagagttaggagaaggtctgggaagtccaaagtccctctgagtaatttcataattaaacccttctggtatgtttctttaataaaagtaggtaagaacagcagatacccaatgccctcatgttgtcaagtgtgcatcattttaatgagacaaaatgagatgagctgatgtaataggttacagaaaatattaccatcaacattcatcactgatataaattcaann

SEQ ID NO: 499845 - DNA, 2016 bp, Homo sapiens
acagcggggcggggcgcggggctgaacaagcgcgagggctggctgctgggccgacgaggggcggtgccaggccgtgggtccttagtcaagtgacgcgaagcggccggcctgggcgccgactgcagagccgggaggctggtggtcatgccggggttcctggttcgcatcctccttctgctgctggttctgctgcttctgggccctacgcgcggcttgcgcgttgaaaatgaatatggcagctactttgcctgtgattttgactacctgcgcttcctgcagaagcgctttcgccaccatctgggggatgatgtggttctgtttaccactgatggagcacataaaacattcctgaaatgtggggccctgcagggcctctacaccacggtggactttggaacaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 499846 - DNA, 246 bp, Homo sapiens
ggagttcaggtgggggacgttgcgccaatgcaacctacatcaagagcaccatgacttaccatgctacattcgtggctaaaccatttggctccgcgaggcttgaggtggcaggactgctcgctggagagctgctgcaggaaagaacattcagaggtgtccagcactacaaagctgactgcatactgtctaacacagatcacctacctctgatgcgacccgctcccacactcgatggaacactgactc

SEQ ID NO: 499847 - DNA, 2176 bp, Homo sapiens
agctcggtcgcttgtgcgttccgctccggccgccctttgcgcttggatccacttccccatctgtaacgaggtgttgagacgagaatgccacccagaggatgtttgaaattgactatagccgggactccttcctcaaggatggccagccatttcgctacatctcaggaagcattcactactcccgtgtgccccgcttctactggaaggaccggctgctgaagatgaagatggctgggctgaacgccatccagacgtatgtgccctggaactttcatgagccctggccaggacagtaccagttttctgaggaccatgatgtggaatattttcttcggctggctcatgagctgggactgctggttatcctgaggcccgggccctacatctgtgcagagtgggaaatgggaggattacctgcttggctgctagagaaagagtctattcttctccgctcctccgacccagattacctggcagctgtggacaagtggttgggagtccttctgcccaagatgaagcctctcctctatcagaatggagggccagttataacagtgcaggcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgcgaaacatcatccagaagtttgaaaaagtaccagaaggtcctatccctccatctacaccaaagtttgcatatggaaaggtcactttggaaaagttaaagacagtgggagcagctctggacattctgtgtccctctgggcccatcaaaagcctttatcccttgacatttatccaggtgaaacagcattatgggtttgtgctgtaccggacaacacttcctcaagattgcagcaacccagcacctctctcttcacccctcaatggagtccacgatcgagcatatgttgctgtggatgggatcccccagggagtccttgagcgaaacaatgtgatcactctgaacataacagggaaagctggagccactctggaccttctggtagagaacatgggacgtgtgaactatggtgcatatatcaacgattttaagggtttggtttctaacctgactctcagttccaatatcctcacggactggacgatctttccactggacactgaggatgcagtgcgcagccacctggggggctggggacaccgtgacagtggccaccatgatgaagcctgggcccacaactcatccaactacacgctcccggccttttatatggggaacttctccattcccagtgggatcccagacttgccccaggacacctttatccagtttcctggatggaccaagggccaggtctggattaatggctttaaccttggccgctattggccagcccggggccctcagttgaccttgtttgtgccccagcacatcctgatgacctcggccccaaacaccatcaccgtgctggaactggagtgggcaccctgcagcagtgatgatccagaactatgtgctgtgacgttcgtggacaggccagttattggctcatctgtgacctacgatcatccctccaaacctgttgaaaaaagactcatgcccccacccccgcaaaaaaacaaagattcatggctggaccatgtatgatgatgaaagcctgtgtctttgagggattctaccctgaacatacctcacagatcctccctgtcatgccacatttcactgattggaatgtggaaatggaaaaggaatttaggatgtgcattttcacctgaggtttccctgcatccctgcagtgccaaagccccaccttcagggaccacctggaatgtgtgaggggctgacagcacagtaacgtgcatacatatctgcagggctggaatggaagctttaaaggtggtagtgatttttattttggaagaatcatgttacctttttgttaaataaaatttgtactcaaaa

SEQ ID NO: 499848 - DNA, 492 bp, Homo sapiens
  misc_feature (51)..(51): n is a, c, g, or t
  misc_feature (64)..(64): n is a, c, g, or t
  misc_feature (107)..(107): n is a, c, g, or t
  misc_feature (164)..(164): n is a, c, g, or t
  misc_feature (201)..(201): n is a, c, g, or t
  misc_feature (204)..(204): n is a, c, g, or t
  misc_feature (208)..(209): n is a, c, g, or t
  misc_feature (232)..(232): n is a, c, g, or t
  misc_feature (236)..(236): n is a, c, g, or t
  misc_feature (254)..(254): n is a, c, g, or t
  misc_feature (271)..(271): n is a, c, g, or t
  misc_feature (280)..(280): n is a, c, g, or t
  misc_feature (283)..(283): n is a, c, g, or t
  misc_feature (460)..(460): n is a, c, g, or t
tggccgaactggagggcgccggggaacggggctcgggcggtccccgaagcncggcggacgggcntctggggtgtctgcggcggcgccgggggaaagggctggggatngggcgcctaaccgggcggtggccggggcctcggccaagttcgcggggctgcaagacntgggcgtgacaaaagcaaagacctaaaagaaaacctnaanaaanncaaggaaccgctcaaagccaaanaaanaaattccaaaaaaaaaanagtgtgctgctgccaantcttcaatnaancctccccttcttggaactgcaagggaagccgcggctggaattccaacaatcggtaatcaaaaaactgcgggaaaaactgctggaacaaatttcaaccaacgcttcggaagggaaagctaaagaaaagtaaaaaaaactggaaaaacttctagaaaaaaacttttctctggtgaaaangccgtccctacaacccgtggtgatgtgcgtca

SEQ ID NO: 499849 - DNA, 467 bp, Homo sapiens
  misc_feature (454)..(454): n is a, c, g, or t
cttccccgcccctcccctcccccgccgccgcccccagccagctctgcctcgcagcctggggagggcggcgtggggcccgcgcggctgcggcgcgctcccggggaacttttgcctggccggggcccaggtgcggctgagaggcgcgggggccggcggggtccagccaaaagcggacacacctcgaagctggcctcatcaatcctcctctcaccgggcgcccctgctagggggatccgacctccagctgccaagatgtgtgggcaggaggggcgcgagcggagcgatggacgcccgcagggccgcgcgaacccggggccttagacgcgggtgccgccagtcccagggatcctccgggtcgcgcctccctgcaggcgctcctcgcggcgcggggctctagcgtgctgcagcctgcccggagaccgcaaactcccgcagccagagtttcccgcagctntgggaggcggccg

SEQ ID NO: 499850 - DNA, 394 bp, Homo sapiens
ccggttggtttggttgggggagctggttggggtccttggggttgaacgtggttggggatgggcaggatcctggaatccgttaccaggccaaaaggcagatcttggggaaaacctttacgggcaggaccataaccctggagggggagcccagggacaccatcgaaaaggggaaggccaggatccaggatagggaaggcattccccccgaccagcaaaggttaatttttgcaggcaggcagttgatggccctgcgtctgaaagggggaatgcaaatcttggggaagaccttgaccggcaggaccataaccctgaaagtggagccaagggacaccatcgaaattgtgaaggccaagatccaggttaaagaagcgatccttccggaccagaagaggct

SEQ ID NO: 499851 - DNA, 1038 bp, Homo sapiens
gcctcgcgcaggacgtgtgcgatggactagagtccaatgagatagcaaatcgagtcttaaataagtccggggagaaagacgcccggggtagatttagagtgagcagccttgcgacgggagtggattcagaagccgcatagagtttttttcctccccatctcagtagcacggagtccgaattaattggatttcattcactggcggcaggaacaaaaactatctgggcagcttcatcgagagagattcacttgacactaatgagccagcggctgcgaagctgggtgcagagagaacctccggcttatacttctgtctcagtctgccccaaccgatagcctcggactatgggtaaggcagaggcggaattaaagccccgctccgagcagcggcagcttcgccgcgcggtgcgctcggcctatgcctagacccgaggggcgtctggtaggcaccccgccctactcccgtcagcttcggaccccgcatggatcgatacgctcagtacccgtgcccttcgccgtcggaacatggctgacccagcaaagacggagagagaagatgactcaacggaacccaagctgcgagcctgcgccacacgagccgggctgcctgctgccaggacttgccgggccgacaggaagcctatacggacgtcgatcgcaccatcgagcaccggacaattcacacgttgcgccttcccccggggtatcactggctggcggcgtccttgacgcacggtggtaacccttcccggtatggcgcctctcgtccttcagggccgcgggtcgacgtagacctggggcccggtatgctgcccgggcgcctgttgacatcccggctcgacaagaagaggagcctcccaaccggaacaaacacggccaggcagtcgcacatgggaacccggaagagacatcacccgccaaggtagcaagtcacacgcaaccatcggcggcgctgccaggtaacgcaaacaaagccacgacaggaccgaaggagcacagcacggaggagtacaagaagcgttgcacaagacagcaacag

SEQ ID NO: 499852 - DNA, 91 bp, Homo sapiens
  misc_feature (44)..(44): n is a, c, g, or t
gtattatatgtttaatttggtttcctgttttatatttagaaaanaaaaatttattagtcactctgttatggcattaatctgtttcaagcgg

SEQ ID NO: 499853 - DNA, 955 bp, Homo sapiens
ccttgtggaccggccctgtcccgtgcgcgtggtgattccgggcccaaggaaaggcccccgttcttgtttcccccgcgcacgtgtgaccccccgtaaggccctgctgcccctgtcgccccctgggtgtttctcttgttccggcacggtaacatccaaggggcatctttcaaggacatcaatccccgggcccggctcctgggcgcccctcgcccaggtggtcttcccgggatccctatcctgttttagaaccggtctggactggttcattggcccccggagggcattcacccgggccccatttggggtattgcggccagaaaggccccaactccaaccattggccaaagtgctcccccgtgggccacccaagcccgagaggtcaccaatcgtgtgctgccccggagagagaaagacctggaggaccctgggccaaacattggccccgggccataccagggaacattatggccccccgtgttatcttgccccaccaaccctctggggaccccagaaagaccccgtggttgaaacattgccctcccggctgccccaagaaaggtgtatactcctccagccccaccagagacttgtggtttggttgtggttggcttggaggttggcccgaattgcacccaaccccttcttgaaggctggcccgggcgcgttacccaccaaatatattaaggcccaagaggaactgcctggcccacgagtaccggggtgtggcccatgaatccctgtggagccatcccttttgggaggtggccaacccacccagccacaatctggccaaacccctcccacccatcccgccagagatgccccctgctggcccgccgaaatgggtcttccttgctgcccccccgactggacgtctccggggaacccagactgtgcccggagaaagagaactagtgctgagggccctcccattaagatttgtgtttatgcccca

SEQ ID NO: 499854 - DNA, 196 bp, Homo sapiens
tagctgtcagcaggaccttacaccgtgtgagaatcggttcctggaaagtaactgttacagttttgagcctggatgatgcttcttcctctcagcacaccactgcatccaacattttaacaaaaggtcagaagaattctctgatcctgagtagctgggactataggcgcacgcaaccatacccaactacttttttttt

SEQ ID NO: 499855 - DNA, 151 bp, Homo sapiens
tgcttatagcaggtggcagattattttaattaggaaacaaatgcttagcaggagaggagagccaaagaagtgacagggaagctacatggttacaacatgatttgtgacctccgccaagcacagtggtggcaggtcctagctgctactgttg

SEQ ID NO: 499856 - DNA, 445 bp, Homo sapiens
ctcataggagaagcgcgattaagacgcgtactccttagctaatgtcctcccgtcatcttactcggctgacttcttagtcctcatctagtggtggtatgccttatacaagacatcttgaggccagcgcggtttgtataccctatacttcactacctctgagtcgaaatcagaagaagtggaacctgtgtcccagactacatcatcttcggaatctactgagtccacatcaacatacatgcatctaatagaggaacttgcgactctccccagaaggagctatcctgatctcttcttcaagaaagttgccgccactgactaccgtcctcatcctcctcctacatctagaagagcctatactagaatcctcctcattaatctacagcatcttcatccgcagcactgctcggggttctagcttgtaagcttgagatatgggacacgaaat

SEQ ID NO: 499857 - DNA, 844 bp, Homo sapiens
tcctgtcaccgctggtttcctgggccgggcgggcagtgcagtggtgactgtgatgtggctgcaatgggcctgggacatggtgttgccctgccagccccgcttgctcgctggtctaatgtctgccgccctgggccagccgccgctgccgctgctgctgccactattgctgctgcttctgcgcgctgcagccctgccatctgtggagcctggcctggtgtgtgatgcccctgtgctgctgttgcctgatgtgcccctgtgtggtctggcccaagtgtgtgcttggacttatgctgtgtgctgccttaaccacttcacctggtgaccatgcgcacctgtgcctgctggtgaaccagacccacatgcgctctcgactgcttgtctcctgtgggacccgcatgcgctgtagcttgagaagtacttgcagacaagatagatagccctgtgatgctagcaggactttgcacagttgtgagaaggcatgtgctacagcaagggccaatccccattgggatgcgctaggtagcagggaggtgttccctagtgatgctgtgcaagctgatgcacacaacccaccaaccaacaagggtttgtagcccttcctgcttgcctgcctgtgtgaattttgtgagtgagggccctgcatggtgcctgaaggctgccggtttctttgcaccaagtgagctgcatttgaccactagtgatgagttcaaccccttgagggcgttcagggcggcccaggaggcctgcagctcccagggcctcatcctgcatgtgctcggtgcatctcttacctgtggctcggacgggcccgggtgtggacgatttgcagccctcaaggacccga

SEQ ID NO: 499858 - DNA, 267 bp, Homo sapiens
  misc_feature (13)..(13): n is a, c, g, or t
  misc_feature (47)..(47): n is a, c, g, or t
  misc_feature (117)..(117): n is a, c, g, or t
  misc_feature (246)..(246): n is a, c, g, or t
gcggaagagatgntgagagagtggagacactatccgcttccatccgncgcgcagaccctgccggagccgctgccgctatggatgatcgagaggatctggtgtaccaggcgaagtggnccgagcaggctgagcgatacgacgaaatggtggagtcaatgaagaaagtagcagggatggatgtggagctgacagttgaagaaagaaacctcctatctgttgcatataagaatgtgattggagcttagnagagcctcctggcagaatgta

SEQ ID NO: 499859 - DNA, 194 bp, Homo sapiens
actcctaccccatacatacacctacccacctgtaaggcaggcttcctctctcaccttcattcttgcaaaagcctcaagtctctctgaacagagctggcccaaggcctgggcccatccttctgcttcctgtgttactgggcagcccaggggcccatcacccacctcagacaccgtcgacgcggccgcgaatttag

SEQ ID NO: 499860 - DNA, 907 bp, Homo sapiens
cagcttctggggctggggcccctggcagctgggcaggccgtgctgacctcgacctccgccgtgcgggcccgaccggtgagtcatgcccggcagtcgcagtgaccctggcctgcagcctctccctccacctctccctgcccccagcgccaggctgcggtgctgccgctctggtggctgtgcggctggggccctcagtgctggccatgtgctggcatggcctgcctgtgggcctgggtcctgctgcctgcgctggcttgagtggctgctgagcgagcctgtgagcgctggctgcaagctgctggcgaactggaggagcacccgtacagcgcggcggggcgtctcgcgtgctcgagcccgccgctgcagctctactggacctggctgctccagtggatccctgctctggattggcccccaagctccatcacccttgctggggctcgccgtcaacgtggtcaccacgctcgtgctcatctcctactgtcccacgtgcaccgaagaggcaccatactggacataccttttatgtgcactggggactttttatttaccagtcactggatgctattgatgggaaacaagccagaagacaaactcttgttccccctttagggggagctcttttgaccattggctgttgactctctttccacagtattatggcagtggggaccctcaatttgccgctcgcttagggaaacttaattccttgactgggtataaaatatcatggctacattataatatggggaatgataagcgagtagaaagtgggcggctcaatgggccgagaatttaattgttaacacagagccaattgtttgaaggaattatgggaaaccccgaaagttatacgaataagaataaggaattaaaaacgaaaattaacgcggaccctgaataaatt

SEQ ID NO: 499861 - DNA, 191 bp, Homo sapiens
ttcgattgtgcgtgcaacttagtgagacctcatctctgcaaaaaaattagccaggcaaggcgaggtaggagggtcacttaagcctgggaggcagaagttgcagtgagctcagatcaagtcactgcactccagcctaggcaacaaagcaagagcctgtctcagaaaaaacaaaaaaggggctgcatgtggag

SEQ ID NO: 499862 - DNA, 1205 bp, Homo sapiens
actattctctacaaaccacaaagatattggaacactatacctattattcggcgcatgagctggagtcctaggcacagctctaagccatccttattcagagtccgagactgggtccagaccaggcgaaccgttctagtgtaacgaccacatctacaacgtttatcggtcacagcccatgacatttgtagataatcgttcgttcataggtaatacccatcatagatcggatggcttctggctaactgatctagttcccacgtaataattctggtgtcccccgagtatggtcgtttccgccgcgattcaacaacgagtaagcttctgacgtcttactctcgcctctctccttacttccatgctcgtcatctgcttatagtgcgaggcctggagcaggaacgaggttgaacagtcataccctccctttagcagtggaacttactcctcacctctggagcctccgatagaccctaatccatcttctccttacacctagcaggtgtctcctctatcttaggggccatcaagtttcatcacaatcaattatcaatataaaaccccctgccataacccaataccaaacgcccctcttcgtctgatccgtcctaatcactagcacgtcctacttctccttatttctcccagtcctaggctgctggcatcaccgagtatacttaacagaccgcagtctcaaagcaccttcttcgagccgaccggaggaggagaacccaattctataccaaacacctattctgatctctcgggtcaccctgaagtttatacattccttattctaaccaggcttcgaataatctccatattgtaacttaataatcggaaaacagaccttggcttcataggtatggctcgagagcttgatatcaatggactcccaagggcattacgcgtgtttacacccaacatttatttacgctacgaattaaacattcaacaacacacatattttaactccgaacaaatatatacccactccacacgaggataaaaactacgtaattaccacacacagaggacatacaccaactgcacaccttacataacagatatacttcactatgaccacatccactcatacacaacaaactactacacacaaacaatgacactccatcaccagtagactctaactatcagctctgcacaacaacattctactcccccctccataacttatcctgatcctatcc

SEQ ID NO: 499863 - DNA, 86 bp, Homo sapiens
actgaagacagtgccacttacttttgtgctcttggggaactaaccgaccgggggcccacttacaccctttgacagcacaactcttc

SEQ ID NO: 499864 - DNA, 103 bp, Homo sapiens
  misc_feature (7)..(7): n is a, c, g, or t
tcatgtngtttaaccaggatttttttaatctcaaaaaacctagtaataacaaggcaatcagtggttaaactgaactttacatataggggaattccattggggg

SEQ ID NO: 499865 - DNA, 188 bp, Homo sapiens
ccggggggggggggggttttttgggcccacgggccctttcccccccaaaatttttcccctggggggggggggccccaatttggggggtttttttggccccaaggggggggggaaacgccccttttttttttttttttggcccggggggttttttttttttttttttttttaaacccccccccccctta

SEQ ID NO: 499866 - DNA, 403 bp, Homo sapiens
aggatctttggagcaggacactggggtgggacattcattgctgcacgtggacgctgcggaattgggtgttgccaggctcagcactcagcacctttctgcacgtggatggtgtggaactgggcattgccggctcagcactcagacctttctgcacgtggacgctgcggaactgggtattgccgtgccgaaagtggacgccgcggaattgggtggtggtgtgccgggctcagcactcagtaccttatccgcacgtggacgctgtggaactgggtatagccggactcagcactcagcacctatctggggttacacgcatgctgagaactaccttgaggcctcatgggctcaggctggtaactctagaaaccaaaactcaggagccacaggccttccttgtctggac

SEQ ID NO: 499867 - DNA, 395 bp, Homo sapiens
  misc_feature (6)..(6): n is a, c, g, or t
  misc_feature (23)..(23): n is a, c, g, or t
gggggngtttttttttttaaacntccccaaattgggtggggcccccccttttttcgaggttgggggccctttttaaaaggtttttttttgacccctttatttcctggcccccccccccccaaaagggtgggggttttttcccgggaaaatttttccccccggggggtttttttttgggggggggggggggccttccccccccttttgagggtggggggccattttccccccattggggggggcccccggggggtttttttttcccttttttcccccaccccccaaaaaggggggccccccccccccccccttttttccccccccccctttggggcccgggtttttttttttttttttacccccccccccaaaaaaaaaaaaaggggggcccgtga

SEQ ID NO: 499868 - DNA, 569 bp, Homo sapiens
cagcgtgccagcacccccccgtggtgaccatcgctccagaccaaaaccgtgaatggtgtctggaggagtgagagccggcaggatgccggctccaggagcagcagtggaggtcgggaaccgcctcaattgtgtgagcccccagattccgctcaggagacaggcgaggtggaccagccaatccccatcgcacgcctggctcagcaccaccacgtagcccgttcgagccctcataccccccagacatcacgattgatgcaagaggattttccacaggcatttaccccgggcccagacttacaaaaacccttcccaatgaacggaaaaccctggtttggtaactcaaacggtttgggagttgacgccacaacacatgtataaaaaccgatgcaaacacgaaggagaagcataatcacctgacagcaatgacttaccagagaccctaacaccagaggccagcacagacagacacctaccctgaactagatacctacaccattggcactacgcaacgattcgtggacccatagaggaaaacaaccgagacacagcagggacctggcagcacccta

SEQ ID NO: 499869 - DNA, 352 bp, Homo sapiens
cctagaggaccggcgtgtgttacttgtgtgtacgtaatatatgtcagagttagatctgctggtgtgaaagaagctagtgatgcagtatggcagatgcatgatatggaaatagaagcgatactcagttagccaagaaatatcgtggattatactgataaactgatttgttaacaggaaattttagcattcagtcatataacatctggttatcaatgcacgtatacacaatacatacttgagtggaggcaagttcaccacgatgagcaatagagtagaaactatatcttaaactagttgacctagatcgtattaatagctacttaagatgtctcaaccgataggacgctattgc

SEQ ID NO: 499870 - DNA, 225 bp, Homo sapiens
atggctgcacgccgctggtcgctcaagatcccgcccacgtgacccccgcatcacgacaccaagccgagtgcatcccgttcttccgctccatgcccggcttgcactgggagccacatcagcatccgcaaccagatcaacgcgctcacttccttcgttgacgccagcatggtgtacggcagcgagaagcccctggacaggaacctgcgcaaacatgtccaagcagct

SEQ ID NO: 499871 - DNA, 613 bp, Homo sapiens
cacggtgaagagacatgagaggtgtgcatttgccagggaaaatgctatctcaatgatccatgagaaaatgaatagcctcgaaaagaatgtcctgagtgtttgatatcagcactggatggtagaaccttgtggctcgattgtgacctctgtatttgaacgttaactgttccccgtttggtattaaaacgtgtcagggctgagtgtacgtgggaattcctcatagagggctgaaaagaaacccaaggttgtttgggtctgggcgggtctgacaagggtggcgaaacagtccaagccgtaggaccacagtttccttatcattagctagatgtcttggggccaaaaccaccgtggggctgttactgtgctttgtgaggtgcgaaggcggttgtgcatttttacgccttgtaaatgtatttcaattcttaatttatgtaagggttttttggtaccgcaattctcgatttcttgggaagagatgaacaaccaaattgggtttctaactggttatgtgagaacattagcgcccccagcaaacacggtcatttgtggttaggaacaactacaagtgcctgccgataaccaaaaaaaaaaacacaaacaacaaaaacaacag

SEQ ID NO: 499872 - DNA, 200 bp, Homo sapiens
gatcgctcgacatcgagaagacttgttttttctctttgcaagcttaagatctttctctcgttcctgctctctttctatctctcactctatcattctcgatctcgctctctccctccctcgcacgttttctctctgtgtctatcgctcacgccctctatctatctttctatatgtatctatcactctctctatctctctat

SEQ ID NO: 499873 - DNA, 434 bp, Homo sapiens
ctgaaggacgagggatgggttttcatgtaaccaagagtattccatttttactaaggcagtgttttcacctaatatgctatgttagaagtccaggcagagccattaaaacattcctgtgaaaggcaaaaaaaaaaaaaaaaaaaaaaaaaaaaaaaaaaaaaaataaaaaaaaaaaaaaaaaaaaaaaaaaaaacaaaaaaaacaaaaaaaaaaaaaaaaaatttaataaaaaaaaaaaaaaaaaaaaaaaaaaacttgtgggcccttttggcccatccctttttaaacttggcaaagtttttacatgcggcccaaattggggccaatttggccaatatccctttatggggggctatttaaaaatcctgggcccctgttttaaaaacgtagacggggaaaaacctggggggtccccaattaaaaccctttggaaa

SEQ ID NO: 499874 - DNA, 182 bp, Homo sapiens
  misc_feature (151)..(151): n is a, c, g, or t
  misc_feature (167)..(167): n is a, c, g, or t
aggatcatcccgtctgggtagctgggattgtatggtgctgcaactatgcccggctaatttttgtatttttagtggagatgagttttgccatgttggccaggctggtcttgaactcctgactccaggtgatccaccctcctcagcctcccanaagtgctgggattacnaggcgtgacgcaccc

SEQ ID NO: 499875 - DNA, 132 bp, Homo sapiens
atctatacggaccgatctatacactttatactggacctatcttactacctatctatactacctatctatactacctatctatactcctatctatactacatatctatactgacctatctatacctccgcgcc

SEQ ID NO: 499876 - DNA, 772 bp, Homo sapiens
  misc_feature (53)..(53): n is a, c, g, or t
  misc_feature (57)..(57): n is a, c, g, or t
  misc_feature (77)..(77): n is a, c, g, or t
  misc_feature (80)..(80): n is a, c, g, or t
  misc_feature (98)..(98): n is a, c, g, or t
  misc_feature (102)..(102): n is a, c, g, or t
  misc_feature (109)..(110): n is a, c, g, or t
  misc_feature (162)..(162): n is a, c, g, or t
  misc_feature (182)..(182): n is a, c, g, or t
atgagcagctcagaggaggtgtcctggatttcctggttctgtgggctccgtgncaantgaattcttctgtgaagtgnatnaagactacatccaggacnaatnaatcttnnctggactcaatgagcaggtccctcactatcgacaagctctagacatgatctnggacctggagcctgatgaanaactggaagacaaccccaaccagagtgacctgattgagcaggcagctcgtagatgctttatggattgatccacgcccgctacatccgttaccaaccgtggcatcgtccacagatcgattggaaaagtaccagcaaggagactatcggttactagtctctcagctgtgctactagtcgagaagccgacgctcaatagccttcccaatctggcactatctcagaacatgcaccgaggtcgaagcacagtggatagaagactgctacgtgccaccaagtgcataggatgtgtacacaccacaagtcatcaagacaccatcacacggatggcgcctacattcggcagctagtattccctcacatgctcattcatggtgcatcccgagtaccggcccaagagacctgccaaccagtgtatgtgccacaggctctacaggtgttcaagatccatgcacgatggcgatacacatgctgcagatccaagcgcagccagcaacttcaagagcccacgtcaagacgatgtcggtgattccctcccccaccgtgtcctgcagtctatgacatgtcctttcttttagccaccctttcaggca

SEQ ID NO: 499877 - DNA, 311 bp, Homo sapiens
gagcagtataatggtcagtagaacaacagccagctactgggattaatcccaggactgcagtgatctcagagggtagattcccaggtccacctctacctttcccaactccagagtctctagtaactatgagtaaccatcaagagaagaaataactcaaggcatccacaccactctatgtcaacatacctgagagaaaacatttgctaaaaaggcagtggccttggagagccagctgaatctacaactctggcacgaaatacacaaagtaagcctggggccgggagtggtggctcatgcctataaccctagca

SEQ ID NO: 499878 - DNA, 954 bp, Homo sapiens
gctgattaagtggctagaaacttgacagctagagctgtgggacaactgcattttcttaagttctggtgtaatgtggccgggcgcagtggctcatgcctgtaatcccggcactttgggaggccgaggcgggcagatcacgaggtcaggagatcgggaccatcctggctaacacggtgaaaccccgtctctgctaaaagtacaaaaaattagccgggtgtggtggtgggtgtctgtggtcccggctactcgggaggctgaggcaggagagtggcatgaacccgggaggtggaggttgcagtgggccgagatcgcgccactgcactccaggcctgggcgacagcgagactccgtctcaaaataaaaaaaaaaagttctggtataatgtaacttgacatttgagatataaaaccaatgggataaaagttctgataaaagttggtcttgatagatcaactagctttattatatgaatatgcagtgtatatcctgtagtatttaataatgagcaacttacagaaattaaaagagatcagtagactagatagcaattctaatctgcaaaatgatgttcaaaacgtactcttatgatgctgtgtaccttagagcacaaaagatattcttcgccggacaatgcaaactttagcactggtaggccttaatcctaaaagactgccagatagtggacagtggccttaaaataaaggaaatagagggtcgaatatacacaaacaacggcgaagaaaggcaaatacgaaaggaaacccaacgaagaaagaacagaaagagacaggcaaaggacgaagaaaaggaagcagagacaaaaaacaaaacaaaaaaaaagagaaacaccaaagagaacagaacgaccaaaccagcagaaagcggaagaacgaaagagaacaacaacaaacaaaaagaaaaagcaacacacaagcagaacaacacagacggaag

SEQ ID NO: 499879 - DNA, 414 bp, Homo sapiens
agcccggatactcatctatggaggacaaaaggctttccatatgtgagaaaaacttggaagtctcatagtactcagcgagacaactgagcagcatgtcagtgtgatgcattcagttggatggaacattctcaatcagtccttccactctaagtaaatatttgtttctcacagaacacaaggcagttcaaagggcctctggttagagatttataggtgtatgaatgggaaacatcatacaagcagtgaaaacaaaaatctttccaggttgtcggattttctccttctaggtcttataaaaagcaactagacatctttaatttaaaaaatacatgcacatatatacaatagtgataggaatgttatttttatccaaaacattatagagtttatctcagatgggcacacattatggag

SEQ ID NO: 499880 - DNA, 425 bp, Homo sapiens
tacagactccccataagcgtaaggatagccttccactaggtccttaaggaggtgatagtcatacgctgtccgaggtgtcatacaccaagttgttaggcgaacatactcctagaggaaccgcacgggctccagccacgactcgatagagcagcaaggagatgcggagcagactctagattggattactgttgcgttacctaccatgttggagggtgtcggaatagagtctgagaagcacaaggaggtctgggagtcatgcaggaatgactaacttctggtccttagggatataggtaacatacaaactacctggtaggtatcaataggccagctggtgcgcgcgatgggcttggagcatagcgtggtcaaaaagcctggatcacggaacggttaggacggcaccagcctcttgaagccagggcagg

SEQ ID NO: 499881 - DNA, 206 bp, Homo sapiens
gcgttgtctagaggatcccgaaacctaatacgaatagagcagagaaatgagggggtctgaggccaaccgctaaaaatgtagctcccagactcaagactaaaatccgttctgctctacacacacaggagaatgtattatttctacaggatgggtccttaatttatcacctcaagcatcactgggaagcagatatcatcttggatttg

SEQ ID NO: 499882 - DNA, 830 bp, Homo sapiens
agcggggggaccgcggcggcctcagcgaggaccctccgccccggagccgcggccggagccgcagcctctgccgcagcgcccccgccactgtcccctccccctccgcctccgccggagccgcctcgtgcactctggggtatggccgtcaatgtgtactccagcatctgtgacccagtgaaaatctgagtcgccatgatcatgcttgcatgggtcaacagactccactggacctcaactataccaagatagaacagctttgttcaggggcacgctactgccagcttcatggacatgctcttcccacggtctgtgtgcaacttgaggaaagtgaagttccaggccaaagctagagcatgaatacatccacaacttcaaggtgcatgcaacgccacgctcttccaacaccgactggcgtgtccgaccacactccattccctcgctcgcaacgacacctcttccgctgacacaggcacacgtcccacagatcccaccctgagctccatctcacgccggctcccaccacaacatcctctgacccgcacaagccactcgatggcaaaagcgattacacaccaccctctgcctgcgcgccgcgccggtgcgccccacgggaccgctacgccgcaccacactccctacacccccagcggtcaactcacgaactctcctcacaccaacaaccttcccaaaagaaccacaccaattcgggaccaccacgccacggttacccagaagcaaagcgaaccacggtccccacccaccacgagacaccaaccaaacacaacactggcacgaaaccaacaagcgcccgcgattgaagccaacctgcg

SEQ ID NO: 499883 - DNA, 501 bp, Homo sapiens
gcagcaccgcctcgatgccaacctgtcgtgtcgtgagtgtcaagtgtgctgttctcccaagacaaaccaggtggtcgagccaactgtcctgctggcaccagtggtaagagatgtgagctctgtgatgaggctggcgtttggagacccctgggtggaagcggccggtgtgagagtgtgccgcctgtgccagtgcagtgacagcatcgatcccaatgcagttggaaattgcaagtcgcgtgacgggagaatgcctgaagtgcatctataacactgctggcttctattgtgaccggtgcaaagacggattttttgggaaggcgctggctcccaatccagcggacagatgcaaggcgctgcaattgcgatctgtatgggaccatgaagcaggagagcagctgtaaaccgtgacggggcagtgtgaatgtttggcgctcacgtggctggccaggactgtggtgcttgtgaccctggattctacaatctgaagtggggggcgggcgc

SEQ ID NO: 499884 - DNA, 868 bp, Homo sapiens
ggcagtcgccacacctttgcccctgctgcgatgaccctgtcgccacttctgctgttcctgccacctgctgctgctgctgctggactgtccccacggctggctggtgcatggctgtcccctactgcaaggcgttagacttctcttgggaattgggccaccatgttaactagcaagacaggcaatctatacctgctgggggcccctgaacgaagtccaagtgcacctgcttgtcacatgtgaccctctacctatgaagcacttgtgcggttggctgccaagccttcctgatcctgggagctcttcccaaacgatggctgttgggtcatggcagattcctcagatgtcacgctggtgccctacggaaacgcacatggaaccaaagatgtcagtcgtgcaggtgggagttcaacgtgccagcatgggccgaaccaggagttgcaacattcacccaaggtggacggcctgcgtgctgcactgaacttgaccatgcagctagcctttcctgaccatagtctggcatgccacgagtggagcgacctgcacgagaagtctgccacttattgcctgcagcgtctacgccccagggctgtcgcaaggaacttatcatgggagtggtgcactgggcggaccgcggtatgctgctcactccacgccaagggccacagcgcacacgatggtctccagccacggaccgacgtatgtgccttggggtcaccgccaaacggggaccacccctgggcacgatacgacccacgctccttaccgtgggacgacaatcggaacaagggcaagcagccggatgatggccgtcaccagcaggtcaccacgaggcacgggtccagggacgccgcgaacagcggaacccacg

SEQ ID NO: 499885 - DNA, 316 bp, Homo sapiens
gttagattagcggctgagcatcccatctaggtgccatgctgcattgcctccataggctgctgataagaagttgttctgcagtgtcgagactcccagctctgtgaggatggacgtctgccggcatactggacaggatagcgtcaggctctgggcaggcatatagttttggagacatctttcacagaaggtgtgcaggcaaggaagaaccttggggcactggtaccgatccaggcagatgctgcataccaggaactgcttgtccattggctggacctctgggccagggctgtcctccctctttgccatggcgcccaca

SEQ ID NO: 499886 - DNA, 222 bp, Homo sapiens
tagtccaataatctgaaatccaaaatgctccaaaatccggaagtttttgagtatcaacatgatgctcaaaggtaatgctctttggagcatttcagatttcagattttcagactacagatgctaaccagtaaaaataatgcaaggaatccaaaatccgaaaaaaatcaaaatctgaaacatttctgatgccgagcatctttagcagcatccttggtctctaaa

SEQ ID NO: 499887 - DNA, 935 bp, Homo sapiens
cggtgacggcttgctgattgcgtgttgctctgcgcccgacgacttcgccttggtttcctccgcggctttcgggctcctttctgcacatatcagtccttgcgggcacatccgttttcgcttcccgggtaacagcggggtttcccccgcgcgacagttgtgggtgtcccggcggcgcaaggtttagtggtcgccctcctcgcggggccctatggtaggggtctccgcacctgtctctggcgccttggggttctgctttgttgtccaccgcaaggggcccggccggcctcgtggttgccccacgtcctcttagagcgttggtgcttcccgcgacgtggtgcctgggtggccccctcgctagtgtgccttccacatgggacgtatttcgtccctcctaatgaggcgttcacctcccgggcttcccccatatttcccggaacccccgtgggcccgacgctttgccccccgatcccgtttcactatgcataattcactcgggcgttaaagggtcgaaagttgttgtgggccgcacgcagcacctttgtcttcgggccaatacccgcggagatgccccgcaaccgtatccggcgtatgccccgccaggcccaccaccccacctctggagcactcccttcatacactccgggaggtcacatcaaactttgtccgaacgcgcccggtaaaatcgaatagctgttgcaggattgaggaaaacccccagcgttcggaccggcaaaccgtcgccgatagagtaagaaaagaacccttccctcaacctcggggggcaaaaaatgcggaggccccccccccccgcccccctctttcgcgaggacgccgggaagacgatgagaactctagacccccaaaagggaggaggacaaccgaacccccccacacggtgggtttaacccacccccggccccccaatctttcctaca

SEQ ID NO: 499888 - DNA, 394 bp, Homo sapiens
ggattatctgcagtgagcctgatacctgcattaatgaatcggcagaggaaggcgccgggtctgtgtcctggcgaccgtagcaccgaaaggcgaagacgctgacggataaccgcctgacgagcaagagataagataaagggacatcaggaccaaaggagaatacacataacagggaaccacgaaagacagaaggagatgaacacacaacgaacgcaaggatgacacaaccggagcatacacataatacgggtcaagaaaaggcacggacgagacgaagaaaaaaaaagaccaggaccaaaaggagaatcaaacacaaagaaggaccaacaaacgaagaaaaacaacgagccaaaagaacacgaccaagacaacaagaaatagacaaagagaaaaa

SEQ ID NO: 499889 - DNA, 110 bp, Homo sapiens
cctcacagaccctgaactctacacaacatatttcctcaccaagatcctgtttctaacctccctgttcttatgaattcgaagcagcatacccccgattccgctgcaaacca

SEQ ID NO: 499890 - DNA, 683 bp, Homo sapiens
  misc_feature (667)..(667): n is a, c, g, or t
  misc_feature (676)..(676): n is a, c, g, or t
  misc_feature (683)..(683): n is a, c, g, or t
actaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaagagaatttctgtgccactgtgcccaaggatggacgttcctatttcccaactctntttgcacanacaggtn

SEQ ID NO: 499891 - DNA, 478 bp, Homo sapiens
cgagatttggctgcatgctcgattctagaggtataaccatgatgcgtcacattgtacgattcagaattccacaggtccaaggctctgatatcagtgatagatagacttgtggtttgcactcatcctcatcctcagtagatcttgcggcaagttttcctttctctctaagactcagtcttcgtactaaaatggagatcacagagcaaatagccaccccaaaattgtagttcatttaaatgacacgtttaacacagagcctgcactaagactttatgatttcctccttatctaaatagaattgatcatcaagatggctgaggcggtgttagctgtaatatttaggttatgattcccccaaaaccctgtggtcacattggactttgggctccattttcccaatctccatcgcccctagctgataaagagaagggcctaatgtggagcggcaaacctgaaccacctccaggatgcacacttc

SEQ ID NO: 499892 - DNA, 283 bp, Homo sapiens
  misc_feature (1)..(1): n is a, c, g, or t
  misc_feature (5)..(5): n is a, c, g, or t
  misc_feature (40)..(40): n is a, c, g, or t
  misc_feature (164)..(164): n is a, c, g, or t
  misc_feature (188)..(188): n is a, c, g, or t
  misc_feature (209)..(209): n is a, c, g, or t
  misc_feature (245)..(245): n is a, c, g, or t
ngagnagaggggtagcacagcggtaggcacgttgggtgtntattttgggattaatttacatgtagctcatgtaactcagcatccatagtgatctgctggcagcaccaagggctggatgagtctgaggatctcctttacccaaagtatgaatgctaaagagtctnagggaatgggtcccggaaagagcnacacccacagacatatcatanggtaactatgactctaatgctccacaaaagtaaaangaattccaaattaatgtcactctgccaccctagatcca

SEQ ID NO: 499893 - DNA, 849 bp, Homo sapiens
tctgatgtcagtgccgcatgtcctcgtgtgacggtgatctgccgtacccctggaatgtcaatttcttcccattcagggcccttcactatgtggcccccttcacctgggtcatgtgcaagaacactttgatgaatatgaaacatgtgtccacgtgctccagttgacccccgtccagttactttaggggtattaagactcacattggagtagagcaatgtccaggtcatggaagcatggttaatcaaatcagtgttaagagtagatcctgtcaaaatagtccgatgccatgaacatatagaaatccttacagtagatggggaatactctgttgtagacaaagagaagggccttgtatccaacccctaagatcacttcatgaaaatatccttttatcctgcaaaaccgagcaggtgtgataagcggagcatcaaattggtactcagtggggcaagatatcatgtgtccaggctaaagcttctcctgagctaagctaaaccctgctgctgtagataccatgtgtgcgtatcatgccagaggaaaacagatgctctatgtgtgggcgtcatgaacgatgtcgtgtagaagacattgagaacgtcataacaggacttgccttgacaatctccattattgaactgatggggtgggggatatgaggacttataaatgaggactcagagggattggacctggttaaattgcaattgggcggagccgaggcgggatgggttggaacatgagaaaaggcgggggagcgtgaaatccacaaggggaataacaagaataaaaaattttcggggcgggagaaattaaaaaaaggggtgggcccagaaaaagtgagggtaaaac

SEQ ID NO: 499894 - DNA, 620 bp, Homo sapiens
acagagcctcgcctttgcctgatccgccgcccgtccacaccctgccgccagctcaccatggatgatgatatctgccgcgctcgtctgtcgacaacggctccgtgcatgtgcaatggcctggcttcgctggtgcgactgatgccccccgtggcctgtcttcccctccatctgtggtggctgccccatggcaccatgtggactgtgatgtgtgtggctatggtgtcaagaatgtgattccgtactgtgtgtgctgacagatggcccatgagcaagagaggcatcctcaccctgaagtaccccatctgagcacggcatcgtcaccaactgggacgacatggagaaaatctggcaccacaccttctacaatgatgcagcgtagtggctcccgaggatgcacccctgtgctgctgacctgaggcccccctgaaccccaatggccaaccgcagagaagatgacccagatcatgttttgagaccttcaacaccccagccatgtacagttgctatccagtgcttgtgctatccctagtacagcctctggccgtaccactggcatcgtgatggactccggtgacaggggtcacccacaactgtgcccatctacgaaggggtatgcctcc

SEQ ID NO: 499895 - DNA, 155 bp, Homo sapiens
gtcagagctcggtacccccaccatgctatggtatagcataaaggccctcaccagatgctggagccatgctcttggacttcccatcctccagaattgtgagaaataattgattttctttacagatacgcagtctgtgatactctgttattgcaaca

SEQ ID NO: 499896 - DNA, 404 bp, Homo sapiens
catattgtggtgttatgagcaagctctgtacttgctttggtcagtgtcatatctggccatctgattggagagtacaaagtaggtactggcgatctccaaatgtaagcactgctcaaccaggtaattggttagtaggtcacaaaaaggaagttaatttggaggtaggggaccaagctggccttaaactctgagaggtctgctttcagggtaccatcaaagttcagggaggtagtgatggaggaagtctggtccaagcagtggttaaagtatgtggggccctgggggtataggttgcaatgacatgtgttggtccattgtctcccaagaagacacagtccaagggttccagggtggcacggtggtcaggatagagttgtagggttccaccataacaccacacaatt

SEQ ID NO: 499897 - DNA, 110 bp, Homo sapiens
aaggccttgttttttccctttttattttttggattaaaaatttttcttaaaaatgttttattgtcttctctaagccaaaagtttttaataaacatagtatttctctctga

SEQ ID NO: 499898 - DNA, 124 bp, Homo sapiens
atatacatcaaatgcatcatgttaaataatgtttatatattaatatgttatacactaatactaaatataaaatatactgcatattatatttttaatataaaatgaataccactccattcatttc

SEQ ID NO: 499899 - DNA, 172 bp, Homo sapiens
  misc_feature (56)..(56): n is a, c, g, or t
ggaggagaatctgaactgaggaggaagccctgcccagcagcctgggggtcccaggnatgtctgctgcatggagactgcagaaacctgtggtggggcagagagttccagtttggccgtgtgttgactgccctcatgcagactctaccagcggccaaagcggtgtctggagacg

SEQ ID NO: 499900 - DNA, 133 bp, Homo sapiens
gtatgtggctgactattctcacgcgcgagtctcagcgccgcagacgcaccctggaaagcactaaaccctcagaagactctctttcacggacagaacgggtgcactctgtacagcaacgcttcctaccgggccc

SEQ ID NO: 499901 - DNA, 470 bp, Homo sapiens
acttgaatctgagttttagctactgtagaggtctcagacctttcctttttagtactattagccaggtaaaactttggttcttgtgagtggtagggatgagtttttaggacagtattcaaagcctttttaaaggaaccaactactcaaatgctctacaatgccaaaaaaaaaaaaaaaaaaaaaaaaaagaaaagaaaagaaaaactagttgggtatggtgttgtgtacctgtggtcccagctactcaggaggctgaagtgggaggagcacctgagcccaggaggtagaccaggctggagtgcaatgctgtgatcttggctcactgcaacctccggctcccaagttaaagcaattctcctgtctcagcctcccaagtagctgggattacaggtgcatgctatcacactgggctaatttgtatttttagtagagcctgggcaacatagtgagaccttgtctctatttaaaaa

SEQ ID NO: 499902 - DNA, 243 bp, Homo sapiens
tagctcagggaacttttcagggtggacaatcttcatggcctccatcttgaggatgacatggggacccttcaggcaggacatgaggaggcccggccagccactgcccgcctcgggcccggggtcagagggcatccggctgtctccagtcagactggatgttcgggtgggtgggggcgttgtgtggggctggggggcaggtgacagggcagcatcctggtcccgccaggcctggggggggccccg

SEQ ID NO: 499903 - DNA, 1592 bp, Homo sapiens
  misc_feature (358)..(358): n is a, c, g, or t
  misc_feature (382)..(382): n is a, c, g, or t
  misc_feature (1010)..(1010): n is a, c, g, or t
tataaaacccccttccataaatggaaaaatacaaaaaatattcaaaccccttttatacaaaagtggcagatatttagggggggggttttaaagccaaaggtgatgtgtttgtggagtgtgttaaaggtgaaaatatttaggtgtgggggatgtagaagcaaatatatgtgtgaggagaacatgtgttgagcgcccatatatatgtgtacgggtagtaagagcgcccgggtgagaacactctgtgtgtgtgcgctctcacaaaatatgtgttgtgtagcgcgcgcgagtaaatatgcgccgcgtcgagaaaatgtgtggtgaaggcgagagacactctctaaaggatactctctgtggnagcgcctgtgtgtagagaaggggngggtatcacatatatgaaagaacacccgacgtgatataaacatgtgtgtggtatatatataggccgacggtggtgcgtgtgagacatatatatatgtgagggggtcatcatgcgagagtgtgtgtgattctctataatatatagacacctctatgtgggggtgagaaagaactctctgcaggggtgagaaatgtgaaaatatctctctctgtgtgagatggcgagagatatatatatcagcggagagtgtgtgtgttttacgagagagtgtgggggacacactctctatgagagggggggatatttttagcgcgagcggggagtagaaaacgcccccctgtgtgtgaggggggggggccccacaatgtggcgccactctcctctactataatatggggagaggggggagcactaaacggggggggaccactaaagccgacgtgttggagacagtcgtgtgggttacaacaacagaggggggcctctacaagaaacaaacacacaccctgttgtggagaaaagacaaagcacaaaaaccaacactcctccttctgctgcagacggcgggggtaactcatattaaacgatactgacgggggggagagaatatatatattatccccggcangcgaataataatctagacaaaaaagggggggggcccccttatcttttggtggggacacccccaccgttgtgtgtgcatgtctcttcaatcagagagggagtgggccccccaattctggagggacacaaaattcgataggggcagctaatctccaccccccgcgggggtgcggtacaaaccacaacttcgcgagcgcggccgcccaacactcaccacagactggggggggacatacaataatactgggcggcgcacacccacagaccagcgtgtacgacagacgaggcaataactacaaacgagccaaggagaggcgcccacctcaaacatacacatagagtgtaagcagggagagaagccccgcgcaacatacaatgcgacagacgacgggcggcacacgccgctcgagaaaaaaacaacccacccacaccaacggtcggcccatgccgggcgccccgccagaagaaggtgccaacaaaatacatagcaagacagaggggcgcggcactaaccaaaaggagggcgcccccccccttgatgacaataaggggaggggcatccatcagctagggagaagaggga

SEQ ID NO: 499904 - DNA, 407 bp, Homo sapiens
ttgctgaggtgactctacaggatcttactcctacccacgcgcccgctaaagtgtttacactgaacagggatcttttctttatcaaagacccacagatacgtggacaaaaaaagaaagctagaagtctccactgcctaatgtgtgcacataaaacaggcacgaagaaacaaacgtgtgtatactcttaattcctatatcacaaatatagcagaagcagcaatctgtacagtaaaatgcagtcatgggcaaaacaaatctcttctaaaagcatctgaaatacttaaaaatgtttaactttgaaaatgcataagtgatcaggaaaggaatacttaggcaagagaagcagctgaactcccacgttcacatgaagcatcccccatcgatccttaaagcatatgtaaagtagg

SEQ ID NO: 499905 - DNA, 292 bp, Homo sapiens
  misc_feature (28)..(28): n is a, c, g, or t
  misc_feature (68)..(68): n is a, c, g, or t
  misc_feature (86)..(86): n is a, c, g, or t
tagtgagctgtttgcaggaaccaccccncgacgctgattaattttgagacatggagctttggacccangacctgagctggactctntgttcacttcaccttcaccgagctgcgtgggcttggagggatggtatgttctgtaacctcatctgcaaaacggggatgtaaaagcaactgtctcagagtgaccgaaagaccaagtgagctatacatgcaaaatgttgtcactgtgtctgctccatattcagaaatatttaataaatgaggattattcttattaataatattaaaaa

SEQ ID NO: 499906 - DNA, 664 bp, Homo sapiens
gttcaacgccacgtccgagttctgccgcaccttgggggagatccccacctacgggctggctggcaatctgcgaggagcagtgagtgagctcatggactttgaacgggatgagtgagcgctcagccaacggtggctccgaatctgacgtgtggagtgagaacatctggctgtgagcacgtgtgaacctggacgaggagaagcagcagcaggatttctctgcttcctccaccaccatcctggacgaggaacctgatctgtgaatatgtggtggctgtgcagctgccctgctcctgtgtcagaacaaatgggctgctggatgaccacatgtgcagaatgtgtggccctggtgtgaatgtgcccccaacaatgtctgctgccctcagcctgtgtactgcatcgatggataagatgtgccatctgatgacaatgtacatgcctgtgagtggagtgaatacctgatgtgcttcacacatggacttcaatgtgacgaatgtgactgtgctacaaaacccgacgttaagatcgaatacgtggattgagactgggccgtgaaactcacacccaaggaggctttcctggcagctgtcgcaccgcttccatggcaagggctcaggcaagatgaagacagagcggcggatgaagaatgctggacgagggaggcgct

SEQ ID NO: 499907 - DNA, 164 bp, Homo sapiens
gccaggaaaagctcatcattatgcgtggtgaagtcagcaacgtaaaaaagggtagatagaagtattcgaagtatagatgggaggatagcttgagcctgggaggcgaaggttgaggttgcagtgagctgagattgtaccactgcactccagcctgtgtgacaaag

SEQ ID NO: 499908 - DNA, 204 bp, Homo sapiens
tggggtaccaaaaagccttaatttattccttggttttttcccgggaaagggcaaggggaggggaaaagtctcagcttgggtgttcaaaaaagtgttttaaaaaagtgggaacaggaagttccccgagttacagccaaaactcaaccatcagaataaacaccccccgaggtgaagtgggtgtctcaccaaagccccaagaggggc

SEQ ID NO: 499909 - DNA, 156 bp, Homo sapiens
acatgtacttatctacatagtctctatagggtgatagatggccatgggtgtgaggagtcagtatatgtttgggatttaggtagtggtgttgagcttgacgcttcttaattggtgctgctttaggcctactatgggtgtcaatttcttactctctct

SEQ ID NO: 499910 - DNA, 357 bp, Homo sapiens
tgagttacggctctgacccctccatcatctccttacaaggcttcacagcagcacagatgggcaatgaagcagtgcagcagattctgagtggtcattcgtagatagtgatcattctacttcagccttaatggtgatcttgagacgggaagatttagaaggaaatctatccagcatgtcttcactgtcaacatgaagagtacacctatacgtacttctgatgttgattatcgactcttagaggcatctaaagctggagacttggaaactgtgaagcaactttgcagctctcaaaatgtgaattgtagagacttagagggccggcattccacgcccttacacttcgcagcaggctacaac

SEQ ID NO: 499911 - DNA, 2028 bp, Homo sapiens
ctctctctctctctctctctcgctcgctcgctcgctcgctcgctcgcttgcttgcttacatgctttcttgcttcccgttttcttgctttctttctttggttctattacatagcttgctttctatgctatgcttgcttgctttcagtagcttaactatgcaatcctagtataactttctattctttcagtattcttatactatgctattgctattcatgctatgcttgcttacagtgctaaactatgatatatctctgctatactatatactatactatataagtaaactaaatactagctatagctatatctatagctatgctatagctataacaatagactttactattgctattactaagtatatacatttactatatactatataagtattctattacttatgctgatgctatatctatagctatcctatagtatataactaagctatatctatagctatagcaatgctattcagatgctattctaagctatatctattctaaaagataaactttctatagctattgctttctttgctatcctatgataaactttgcttttctttgctttgctttgcattttctgtgcttttctttctttgctaatctttaacttatctatacatatactataatacttatctttctttgctttcaaatatctttcattcattcattcttatctattccattaccttttacataatacaataccataaattatacaaatcctttacatttcttatcatttcttttactctccttttctatttcatatcttaactggattacgtcccattttgagaaaagaagctttcacacacttgattcccacggctaagaagtgccactgggcgaaacttgatcatacaccgaaaccatacgcctcccgggttaaaacgatcacgtacaaaaccccaaaaggtgaaacatggagaccccaccttctagtaagtcatcattgaacacaccaacactaacatagagccttcgccaacattacctaccgccataatacagacacaaaatatcttcttctttactataatatttatattataatataaaataaattggcacataccaaacacacacccacacccaaactataacaaatacaacacatctacaaaccacatcactacactataacacacaaacaatcaacatacacaacatcaccacacgaccaaactacataatatacaaacacatcggaccacgccgtaccgatcaaccgaaccaacgagtcgcggaggatagagaacagacaaacagccaacacacagcagcgaacgagagaaagcatcggacacgacagagacagacgaagcgagaaaagccgcaccgacggagcacagaacaacaaagacagaactgaaaggcagaggacgacaggaactgcgaacgacgatcaagaagaacatgagagacaagcgaagacacgacgctagacaaacacacgacgcctgacagaagagaagacacaaaaaacatataacacatatacaacacataaactatatatgacacaataacaccaatacacatacaaagaacacatcacacaaccatacaataacaacatcaaaaaataaaacaaacaaacaaataaagcaataatatacaaaacacccaacactacacaacaaaaactctactcacacaatatctaaaacacacaaacaataacaaaaaacaaaatacaaaatagaacgaaccacgccaccggcataagagcaaaacaagccgacgaacgctaagcacgacacgacgcacaccacaccgaggacgcacgaaagaaccaccaagagcccgcacacaacaacagaagcacccgaccacagaccccacagaacgacagaagcgccgaacaccgacacgacacgaacaacgcacccgaccaacaacaacaccaccaccaccgacacaccacaaatcacgccacaacaacgcgcagacaaaccacgcaaccatcacagcaaccacataacaccaactaccacacacacacacacacacaaat

SEQ ID NO: 499912 - DNA, 343 bp, Homo sapiens
  misc_feature (7)..(7): n is a, c, g, or t
  misc_feature (9)..(9): n is a, c, g, or t
ccggccncncgacacggctgcgagagacgacagaggggtagaggaagatctcagatagagacactggggcgggcgtggtggctctgcctctatcccgcatttcagaagctaaggcgggtggatctcaaggtcaagagattgagaccagcctggccaacatggggaaacttgtctctaccaaaaatataaaaaattagccagatgtggtggcgggcacctgtatcccagctacttgggaggctgaggcaggagaatcgtttgaacccgggaggcgggggttgcagtgagctgagatcgcaccactgcactccagcctgggtgacagagtgagattccatctcac

SEQ ID NO: 499913 - DNA, 362 bp, Homo sapiens
catggggtctgtaccgtggagcaaaaggctcccttcctccgcagtgctcggaccaacaccagccagcctcagccccgcggatgatgcaggccgccgcgtctgctgccccgcctctggtggctgccacgccctattcttcctacatcccctacaaccctcagcagttcccaggccagccagccatgatgcagcccatggcccactacccctcacagccggtgtttgcccccatgcttcagagcaacccacgcatgctgacgtcgggcagccatccccaggccatcgtgtcatcctctacccctcagtacccttctgcagagcagcctaccccccaagccctttatgccactgttcaccagtcc

SEQ ID NO: 499914 - DNA, 902 bp, Homo sapiens
agtgtgtgcgtgtgttcccgtgtcgtgtgtagtgtttctgggacgcctggtaccgcttgttacccatgctgttcccagaccggcggttcttgtaggctcccattcttacaacttaaagtttcgtgccgtcccgaacatgccgggttgccctttgcgcgggcccgcggaattcatggttggtccctcttttgcgcgtggaataccttccggttccgccaaagggccctgacgcgcgttgtttgaccagctgcctccgctgggggccggccacacccgcacgggatgccttgtgggggcctcttcccccctaggttcgcactcaatagggggtttcttccccttctacagggctgctatactccccctgggttgccgcctttgttgacgagaacccccctgggccccaccaggattgaggccgcaaagagcctcctgctcctttatatatttcgcgcgtgggtaataatggtaaacttctgggggccacacagacgcacttgttcgcggcgctaatctggcgaaaatggccccaaacgctaagtatgggacctcccgccgaagttcactgaatcaccccccagttgacattctcgtcttaatcctgtagggctcaagtctatttgcttttaacacacgcggagaatattcaaaataattgtttacgatctttgaaaacccctttctgctttctccctagctagattcgctctctatatgtggaaggtgaccctcccattacaacctgcggggtaactaatattgagaccccccccccccgcccccccttctgcaaagaccccgtcatacacctatcaattctgccgcccaaaaagaatgagatcctctacccccccaacggggttcaaaccaacccccgggcccccagattttttaaaaaaaaa

SEQ ID NO: 499915 - DNA, 109 bp, Homo sapiens
tcgaattcaagcttctaacgatgtacggggacatggcagtgggaaaaatgtaggagactgtttggaaattgattttgaacctgatgaaaataaagaatggaaagcttca

SEQ ID NO: 499916 - DNA, 438 bp, Homo sapiens
  misc_feature (25)..(25): n is a, c, g, or t
  misc_feature (69)..(69): n is a, c, g, or t
tgggcctgccaggaaattcgggccncgagtgatgactggaagaaaaacatcaaaaagtgtgcctaaccnaataagccactttttgtgatgaatgaaaatattcctgtatcctgtgtccctcccaagacagcccactagccacatgtggttaagaagtcttttaaaatggccgagcatggtggcttatgcctgtaatcccagcactatgggaggttgaggcaggtggatcacctgaggtcaggagttcgagaccagcctggccagcatggtgaaaccccttctctactaaaaatacaaaaattagtcaggcatggtgtcacttgggaggctgagagaggagaatttcttgaacccaggaggcggaggttgcagtgagccaagatcgtgccggtgtactccagcctggacgacaagagtgaaacttcgtctcaaaaaagg

SEQ ID NO: 499917 - DNA, 392 bp, Homo sapiens
  misc_feature (109)..(109): n is a, c, g, or t
  misc_feature (111)..(112): n is a, c, g, or t
  misc_feature (119)..(119): n is a, c, g, or t
  misc_feature (121)..(121): n is a, c, g, or t
  misc_feature (129)..(129): n is a, c, g, or t
acgctgataacccagagaaagtgctgcctgaccattctggaagccaacaccagcaccaaccctattttgggtatggattccagcagcgctggtcgccatatcacatggncnnacccatngntccttggngactgatccggcgatcctgccgacgcatctttccattcacatcactacgcaaactctcgaaactatcgttcaacgccgagaaccgtgcatctgtatagctattggccgccgccatactgttatccaattgcgttttactcactccatcggttgccaacatacctgcagccatcgtcaccttgcgtacattgagcgagctgcctagcgaatccatgcccaccgaactcgtttgcacctcatcactactctgagagctacccccc

SEQ ID NO: 499918 - DNA, 509 bp, Homo sapiens
ggcgcgaattcactagtgattgtgagctgagatcgcacccggtccaagcactggctttgagataagcaatattaaaaacattttcagcttcatcagatgctgactaactgacctccaaccactgttccaccagccataactacagctttggttggacaagtgactgatcccagtaactttttcctgacaaggtgactacccatcatggactggttctggctggcttacagagctcctgcacttgcatgtactttgtgtactgaaaagaccttttgccatatagggcctaattataatacatttaaatgttaagtctccaccccaaagtgaacatgggttgtatgttgcatgcatgtttgttcaatatgcatgtgtcagaaccactttcatgaatattcatagctcctcatgtaacctgttggatgtgtatgtttagtcaatccattgagcatgaagctcctatcctaaaccctccttctttgaagtggctgtctcttgtcttggctgga

SEQ ID NO: 499919 - DNA, 163 bp, Homo sapiens
gaacacacacattatggcaaggtttatttacttgatgtccagaggaacatcagggtcagaagtttgatgtacagtcctgtgaagattatagtcagattatgcttggatgaaacgtggagagcacatgggctgtgtgttcagcaggatggtcaggttgcacggt

SEQ ID NO: 499920 - DNA, 334 bp, Homo sapiens
  misc_feature (116)..(116): n is a, c, g, or t
agcctgggactctttgtgaaggtcctcctcacctctatctttctttctctctctctcaaactctccttaaagtcctcattgcctttgcactgcttctgtgaacagtctttgtctcncttttcctttggtgggaagtgcggggcagtcctggtcaagacactcatgccctggcaatgtggctcccagagaatgttgttgctaacccaccagtctcttgttgatttggagagctccagacaggcccctaactgcctcgaagcgacatttacacaccttctttactgtcacttcgcgatctcatgacctcataacacctcacaaatcctcaacacac

SEQ ID NO: 499921 - DNA, 1679 bp, Homo sapiens
atgtgctgcccgccgcggaggtttgtttgatcggcccctctgcctgccgacagatggcttggcggcctgtgcgtggttgtcaggtcacgcgtggttgtcccccacgcggcgcgcgtgtgtgttgtcatctcgtgtgctcccatcgggggggagtgggggggcgtcgcgtcaatcgagtgactgtcgcttggttggccttcgccgacatggtcgcggcggatctgtttttttgtgatcgcatgcgccccccccgctgtgttgtggtatcgtagatgtggaggtggttggctctctctccgccttgatggtggggggcgtctcgacttcgtgacatctcgtttaaacaaccgaacgggtggtttggcgtcgacccccaaccacttattggtatggccgcgtgtagtgagacgtcaccgctttgtcgtgtagtgagcaacaccgatctgagcgtagaatatagtttttttaagaagtacggctgtttttgtcgaccaccccccgctgccagattatttgtttcttagacgaggacagtgggaagaacttaattgtatttttactgtggtgttttattgcacacacacaaagtaggtcggcgttggtttagtataacaaacacatccgtggtaggtaagcatgcaagttgttgtggttgtgccgcagcgagcccccgtgagggtggttgttcttctgcgcagaacgaggtaggtggttattgtctccccccgcgaggaagaaatttttctttggtttgtatgtttatatataggttttgcgagctacgcgctcacagacagttgtttgatagagaaagaggatgtttgtgtagtcgcaccccacggcgctgttttagagtaggggagtggttgttatatacagtttttggtggcgacgcacaccacacacataccacaaatttatttttgtggagaaattcttctcccctgggagacgcgccccactttggttgttttctctcacccgacactacacgcgctgccaagataagtgatatttttttctactcaacacacctagatacttcttgggaaaagtatatatattatgtagactcgagacaaagacgtatgtttgttgttttagtatagtcgcgagcacattttttattgttggaggagacacgtataccacaccacgccacacactctctttatttagtatgtatagatatagagagagacactcatcagcagagaagagtgtatcatcttgctgtcctccgccactgcgctggctatcatatcatccacgctcgcagatacactcacacagacatgcgtggtgcaccagcgcgagcagatgattaatatttttctgcgttgttctttatctctctatataataatatggagagagagagagaaaaaattcaactgtagtctctcgatttctatatcaaacgatacaatttatatttatgtggtaccaccacaataaaaatgtttctccctacttattctctgcacgctctttttttatgacgagaacaaaatattttctcattcttttaccacctggttattctcttgtccgccagaaatatctgcacgcattcgtccccctggttgtgcgaaacacaaacagaccactttttgttttttttttaaaaaagaggggcccccaaatatttccccacaaaagatttttttttttttcta

SEQ ID NO: 499922 - DNA, 238 bp, Homo sapiens
tatccgtcactactaccgcatacctactactcaactataaacatccagaaccacaaccctactactatctcgcacctgaaacaagataacatgactaacaccctataattccatccaccctccactccctaggaggcctgcccccgctaaccggctttaagaccaaatgggcctttatcgaaaaattcaccaaaaacaatagcctcatcatccccaccgcatgagtccacaataaaag

SEQ ID NO: 499923 - DNA, 509 bp, Homo sapiens
  misc_feature (69)..(69): n is a, c, g, or t
  misc_feature (90)..(90): n is a, c, g, or t
  misc_feature (322)..(322): n is a, c, g, or t
  misc_feature (492)..(493): n is a, c, g, or t
ggtaacaaatttctggtttatttcaaatgtatacatatactcatcacttatagaggaaagaaatctagngcttctctcatcttgtcccangactataaacaaattgacatccttttttcattagagatccatctgttctgtgatttttttaccttgtgatttataaaaattaggacctaaatctataatataaacttcttggatgccagtcttactcatagctgacacattttagatcctactggaaaactaagaaatgcctcttatttcaataatccaaaacttaacatactcttagtaaattcttactttgctttattcncagaacacagaccaccagtgcatttcaggaaatagctccatctaaaaagccagtgatttgatgaaacaagaagagagctgccaattaaagctaacaggtgtgtatctgtctctataactattaaaagggatatttattccattctgagaaccctggggattgtttattcnncaatccctttttaaat

SEQ ID NO: 499924 - DNA, 190 bp, Homo sapiens
tgtgcccatgttccagatagccataaaatccgggccatccatcccaacaggagctggagtgtaaactcagaaacaggttagggacaatgtagtcagtgtgggcaccatcaatcagccattatcggttgttgtggacgaaccagcagtacaaccttcgtgccgatgctggcatcccttctgtcgtcttctc

SEQ ID NO: 499925 - DNA, 885 bp, Homo sapiens
ggagaagtgctcctgccctgtgggagaggctcagcacagaaggagtgaaggacagcacagcctatcgagctcgtggctctaggtaagtttgctgagatcctagtgctcagtctccacatgaggatgaatatgacagagcgacaagaagaaccaatggagtgccgcctactcgagcacctcctccactgacacatcagactactaatcacactggtaaagagggtgctccatgacatcatcatgcactcgacttgcttaacactctctggagaaaccgtgacgctattcgagataggctccaaaggatcaccgagtgtagagaggcgcacgtagtcctatccgccaaaaacgatgttatccagaagagggagaaatggtatagtatcttatcgtgaacgtttgttccgcaacagaatttggctctcagaaagtctgtgcatggcatacaatctttggatcacgaaagagaccaaacgtgattggcaccctcgtatccattgtgacatttacctagtcgatactgtaaggttacgacgtggaccaagatatagcgtaattactaatggcgccatgcaatatcgagcggggaccgagaagatcagatagtattcctaatgcaatctcactgtgatgagttccagacattgttcaacaccggggaagcacgcaggaatccttataagactttaccaccattcactaaaaagcgcagggtgcatacggaactagaaggagttaagctggcattattcccaccattcaaactgtataccttgaagcttgaccaatgccctacattcaccactcaaggaactcaaaagccatggggacgaatcaagggatgtcttaaagccttccagctggtgaaccctaagagtgagaaac

SEQ ID NO: 499926 - DNA, 201 bp, Homo sapiens
tagtaaagtgcctataaggtgaagcatttaatttatcattggaaaattttgtgaacttgctagatgtcactgaggcccctgttgctagtggtagaatttcagtagaggccacggaaggttaagatttcaccagagattgaggctgaggctggtcgtcgtggttcgaatgtgtagaataggcataggggatcgggtgatagg

SEQ ID NO: 499927 - DNA, 3215 bp, Homo sapiens
gtatggggagacttttcccgtgttcaagctcgcacgctgcatcacgaggaaatgacactgaccagattaaggctacaaatacaagtctcgcagccagtctcaaagtctgtaaccccaataacattttttaggtaaataaaaattgttactgggtggtcttcccttctccaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 499928 - DNA, 5431 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 499929 - DNA, 1131 bp, Homo sapiens
gcgtgggctgcgtactgccctgcgagcacagagcctcgcctttgccgatcctgacgcccgtccacaccctgcctgacagctcaccatggatgatgatatcagcctgcgctcgtcaatcgacaactgagctcctggcatgtgcaatggcctgtgcattctgctgtggcgacagatgcacccccgtggcctgtcttcccctccatacgtggtgagcgccccagtgacaccagtggctgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaattgagctgcgtgtggctcccgaggagcaccccgtgctgctgaccgaggaccccctgaaccccaaggccaaccagcgagacgatgacccagatcatgtatgagaccttcaacaacaccagccatgtacgttgctatccaggctgtgctatccctgtacgcctctggccgtaaccagtggccactcgtgaatggactccagcgtgacggagatcaccacaactgtgccatcatacgaccgcggtctgccactacaccacattgcatcctgagtatggacctggctggccgggacatgacagatactcatgaacgactcctccacaccgaggcgccgagctaccgcgttcagacagccaactaggaccacacggggtacaaatcgtggcgttacccatacgggcgccaagatgagcaaaggtagaccatgaacctccgagacaaaaaatcgccacgcgtgaacaaatacgcccgtggagacagcaaccaagctcgctgaggacaaagacatcacgcgtgtcaagagaacggacccgctgcccccagggagacgactcacagccaccaacttcaggaacaagacagggacgaccaccacacccccgacactacgagacagccgggagaacaccacacgctgtaccacagaacttcgagcaccaacgacgcagtaacatcgacactaggcagaaaaaagaagcggtagaaacacagaacacgcgcaccaagacagatgacacagcaggaaat

SEQ ID NO: 499930 - DNA, 6396 bp, Homo sapiens
  misc_feature (436)..(436): n is a, c, g, or t
  misc_feature (6039)..(6039): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctccttatacctancactgcttgaagtggagttacaccgactactggccacctaccaggcgggattaatgcatccttttggaaggcttttttctctgcctggaattccatttataaagtctaaatgtcaattgggctggttaaacttaattgaaactgtttttgttgcaaaatactgcctccgggcacaaatataaaacaccaaaacaaaaaaaaattggggccgtccatcctatagcttaaaacttcccttcagcggttgaacatcgcccatatgtgaaacccttttcttatataaacgcccctcctccaatcctttggtaaacgctctttcctactactactattactgcctcttctccgcggctctca

SEQ ID NO: 499931 - DNA, 2587 bp, Homo sapiens
aggtggtaaatatgtagagggagtatagggctgtgactagtatgtagagtcctgtaagtaggagagtgatattcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 499932 - DNA, 148 bp, Homo sapiens
tgctaggtaggcgagtggacatggatagatgagaatgacaacatcacagatgtcctagcattctgcgtggcccagactgccagccgattgagccatcacccgtttatgcccagtcatggtgtgcgattgtcatcccaacaatgatctg

SEQ ID NO: 499933 - DNA, 182 bp, Homo sapiens
cgtttaagttggggctgccagctgcccacaccataattggcccccgccgcattcacacagtcctgtgtgctggggatggtaacaatgaaatacctgtgccctgagtgttggacgtggggaatttctcctgtgggctcagacgtgttgtactctgtaacaactcagagatgctatcttgacgt

SEQ ID NO: 499934 - DNA, 3009 bp, Homo sapiens
cggctgcagattctgtttgtcatctgctggaaatgtccacgatggatttaattttaaaaaacttttttctttcccaatttagggaatacccactctggtgtacagacacgactggaactatgaacatctctttatggacatcaagaacaaaatggcacaggtgatcccgataaacctgatcctgtgcacggggctttctgccttctcagtgtgtttccctccgtgttaggcctactccagccttgccccgggtgtttgctgtgagcccacagtttctgcggcctcccttacagagagcaagcaagacagcaaatcagcaagttttcttgtagagtaaaagcagattgacatcttgtgggtttgattcttaggaatgatgttgatgcatggccatgcctgctgaagcgggaagtccatggaaccgatttgttcctgctctccgcatgcgggtactgataggtagacctgtgtgtctccatggcctccaggaactgcctgcacaccgtgcgcccaagtgtcagctgttagagagttggccccccgcatgtggcttgggcagtgaaggggctcggctctcttaccaggtggtgagatgccagaaacccagcccacagacatccctctcctgcttttcatttcccaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca
